United States Patent 10,407,724 (METHODS AND COMPOSITIONS FOR SCREENING AND TREATING DEVELOPMENTAL DISORDERS) - sequence listing, part 81

SEQ ID NO: 2392 - DNA, 1288729 bp, Homo sapiens
tacttcccaatataaccaactacggcgtgggggagcggaactgcgagaaggcggcagccaaagtgccattaaagctcggggcggagaggatgcgttacctgggtcccgtctgctgcgagaggcagggcaagctggaggattccctctgaatgattaagaactccgcaattcgcctctgccacaggctgcaaaggacccgaggaaccgctctctctgaactgtgctgatgggcaggaggatgggagacaggaattgagagtcacagaggaaggacagtggagtctggcatcttattggtaagtggctgacattcctttgccagtgactgcgttctgtgattgtgcacttcatctcccagccacttaggatttttgacacactctgttctgcaaagccatcctttcttgccatgttgccagaatgtaaaaactgtaagatgaagcttttttaaataaaggaaacaaaacacgactttatttcctgctgggattttatggcaaaaagttgaaacaagagtaaatataacctatttgtatatctcctaatgccacccaaaataagagtaagcaattcctacacgcaaattgcaaattgtaaggcaataaatgccaggataaagtgaggatgtttctacaaaagaaactaaatgtttggaaaataggatgccgttctcaggtactgaatgtatgccttatgtttgagcaatgagtttccgagactaaataattgggcatctggcattgcaataacttgttaaaattcagtagggatgctctataagtggagttctacaaagttcgtgagactgagaaaaactgtatcttggattatgctgagcttttttctaaaggttgtataggattgtgatagattaaaaaattatgttcagacatccttaccatgttttgtagggagatatacggaagagaatatcaatttgcacatacacaaacctgagaattactctgatgacctgaacaataagttgtttcaactatatttatttgcgaaagaaccagaatccactaaatattttagaattatattacttttaaatcttagaactgttctcccaagaaaaatacaatttcatgtggtaatttaaatgcaggtgagaagcaaaaaacttttaaactgttgtatgttcaatgccttacctacatttcattcatttgtttcttaatttaaaagagaaaatcatttagagggtcaatacttctactttgattctcaattacgactgtggaaataaggatgaaagaagtagatgttcattagaatactagcatttaaaattatagacaaatagtcaaatttaaaaattaatgcagatatcatcgattactgttgaattgcaacagaattacagaagtacttatgaccattacagggagcttaaaggagttcattatgattaatattgtgactctcagtattttaaaaaataatgattaggtcattaactgtttttgaaaatgcctgtagtcaattttgagcaattctcatggttgcttgcatattctcctatttcatgctcaaattattctaagttaagtggggactagtatgctgagtcttaaacttaacaggcataagtttactctgactctaatcgaaaagaggtatgagtaagaatatgtcatataaaactaatgataacaaattaaagatattacataaaaagatcatctaagtccattaaagggaaaaaggcaaaaaaaatcagagttaaagttataaaaagggaaattcaatataaagaatagaatttgacaaatagctggagtgtgagggaatgatattaaagcctatctgaaaatagaaagtcagtgaaatgattattacaagtgccagtgtttttgcttaggaattggtgtatcctttaaattatttaaaacttctgaaaattgagaaaggaggagaaaaactgctaattttaatttctttctgattccatagacaactgaacagaaagttagattcttaaaagttatataaaaatataatcccatagattaactaaatgccggactttgtctataagttgtgaggcacatgcacaccaaggtgcttttggaaatacatccaaaaagctacagttgtggaatttttaaatgaatagctgaaatacctgaatgtttctcaaggtgagcagttagtacttcaagtattaggtggtctgaaacaattcttagtcagggagccaacctgaaatcaaatcatgaatctatacatagaatatgtttatgtaagatgaatcattaaaattagtagcatgtaaaaatttacttcaatcttatgtgtccaattaagtagcgctatctgttagaaatgtaccaggtttggctgatatgtatttctttaaatgtctcttttacttcacagtttagaaaatcttgaccactttcagggtagaggtaggagtgtgattgtctgtcacagctgacttagcaatatggaccagagggtgccagtaaagggcaaagggcccgcataggctggccaaagcattttggagtttgtcttacttctagacaaaataaaggcataatttgtgaagattaaaataaaaatgatgaaaacttctctagatggctgtaatactgtgaagatgatttgactgtagagagtttgattggctaaaacaaagttgtagcagagtttagtgtctccttcatcagtcaaaaactaatccagaattttatgaggctcagatatttacaatattgtaatttgccgaatccattctttctcatgtatcttgattacctattgtctttgaactttcttttaaaatacgggtttttaaatttttaccaagtcgttggaaatttatttctcttactttaaataataaactcatacattcatgtagtttgttttcttgaaattctgactccaggagttgattttatctctctttcttctttctgacaatccaagcataaagtaagagagtaatatgtttctcacaagatgttaagaaccgtgttgtaaggctgtgctaacatgttacatgaacttcttaacactttatagcaggaaagagactggtcggaagctcaaagcggtagaatcactgcagaggtctattttctgagcatttgtgatcaataactccacattagaggctggtacattttaaaaagtaatgaagtatataaaactcctaatgcttaagatttaagattaaaaactattatgaactatattccatctccctacccactcaagtaagaaatcctgttttatgatttttggagattcaaatgtgtattgttagaagtgttctaataaactgaatattattagtttatgttttttccagacacttaaacagtgttttagttaattattttatttaaattgaatgacacaaaatatagtgttttaatacagtggctataaaagcaatttttaaagggaaacatgaatttgctttttaagaaaactggttttacaatggatttctttcatcaaaattattttgaagtattgaattgaatcccaagaaattgacacaacactgtataacttcagttatgttttgcctattataaatatttgcataagctaattgtagataattttatgtctattaatccccataaattaaaacacacgtctttagttttatatcccagagtagtgcatgttatatttttgacattataccctcctcaaacataagctcatacgtgttacaaagctattcaaagtatggtagtttctcttttctccagtgcagggaactgggaactttccagagaggccacaaagtaattgtgaaaaataaatcaagattgtctgttttatggaaataaaaaaaagaatctcatttttaatctaatataaaatagtgtgagatctatcattcatgagaatcttaagaaattacagtcatattcatttcctgtgtatttcttaagctagaatttcttgtgatcactgccatttttaaacgtttcagaaaatgtttcattagatacattttaaaacacgggtgtaaagttgttttttctctttttctaagtggttcttaaaaactcataatgatctaaataacttgttgcccaatggccactttttatttatttatttattttcacaaatgaccttctcataacagatccgacaggactcacctatttcctcttatgccagtcatgtttccaaatatttctcacactcaatttgcatagagcggagatctagataaaaagcaagaagccaatacattttatgagttttctatgaaaaatattgttacagttagtatctttactagaaaatatggagccaattaaagggaaagtgactaaactgaacagaatccaaataagcaattgcattttaggcaaggaatatttcatttatctgaatgatcaaaaattctctttcataaccattgactggaaaagtataattatatatttaaacattttatgaagggcgtagagatgttcttcataggattcttatagctgctaacaacccagaaaggagaacatctcatcttccattactatccagtagtaaacgtagcatatgtttaggaagagaaatgttgctgattatataggtgataaaaagttgattgaaattctcttccttttgtgagttataatattggcagaagcattcatcatgaggctaaaaatactgagatgctctcatcgagagatattataatgatagtaataaagtatctggagctgcaaccaggtctattaatgtatttttacaaatatttcattagttgcaggagtttgtatttatcatataaatagtagagaaatgggatgttgattttgtgagaaatttacttttaagtatataaagttttatctttattttcttaaataattaatgttatacttagaagtattaaggatttttttctgaaattaaacgaaatataaaggcaatactcaagaatttagaacaactattctaattcacctaggttctcccatttcagttacatgcaagaacttactttcaattatgcaatatttgttgagatactattgttcttgagcctttaagtgtactaaactagacaaaatccctgatgattaaaagtaatattattggaagttacaggtgagtgacaacaggaatttttaaaagaattttattgttttctaaaaatacatttttatttaattggcagtttcatgatcattaaatatgataggaattcctgggcactggaacagattgaccccaaatatatctgaaaacactgtgaaaagtctcatgtttaatctgttaggtattgtattttgccttattttgttattttaaaaccttcttcttcatattcttttctaaaagatatagactggcttaatattatctcccatatagcaaaaattattaaaacaacttgttagtgaccactatttcttttctaattttgtattttcaatgataagaatttcaaaagttatggcattgataagagaattgaaactctaagcttcataattctatttaatactctcttcctccttctgtgatgctgttattctaatgtgtgagctggtgaatgagagttcatgctaaaataaccgtatcattcaaattcagcacaaatctcatgatttattgatgattaattgtggaacccttaggaaaaagtgacagaataaataccatttaatattggaaggggccatgcgagctcatatttttacctactcataataaacaaagtttcttcactaataagcaagggtataaaaaggtgaagtgatgtgttcaacattgcaagtaatgcaaaagatggaattagaacccacatctcttaaatttgaagatcagagctttttatggcttatacttcattttagactgtggacatcttgattatttttgtatctattcaaatcaaatccttatattagaatataaatatatgtaatttccttgttgccactgattatacataaaacattgtcttttaagattagaaatttaagatccaattatattaactcagtggaaactgctatacccgcattctcttaaccaacaactacagaacttaattgctagatgtgaactttttcacaatgaacttggtatgcactcaccagctacatcaaatgacagaaggggttttttttttgacagttttaattatgaaacttgggaatcttttagagtattataatgaagtagaaaaaaggatttaagtgattttattccatggcatatatgtaagggaacatccatttgccctataatacttcttaatttttcccagactggcaggttttctttttttcctagtaataaatgtttaatggaagccctaaatcaaacagaaactcagcaagaaatgtagatgagagtatatttctgtgtttgacaaattttgggtaaactttaattcatgggctttttaaaggtagtagcgattttagagcatttgataataaagcagagaatatatctcttgaaatatgcactacttttctgtgttttaaaattcaaatgtcaacttgtatataaattctagtttttctgttacaatattaaaggaggttaatagacaacaaatttgaaaccgtaatagtatttaatcgtcattgtatctgaaccaaagtttacttatgcttaattttaataatgtcatataaattgttttagaatgaatatatacactaaaaattcctcagtagaactgaatatgataaaacataaaattaccatagtgcaattgagtggaaggcagtttaaatattgctgaatttctggtattacattgcttgtacagatgccttctcctgatgctttaattgacaaattatgacaagcaatttatgtgtttgggggaatgaattcaagttttaagactttttctttaaacactgaatatttaaagatggcgcgataagtgtagcagagatgaggtaaaagacggtgactaaaaaggttaatattttatctgaagtcttttatatcctaagtatataaccccagtttgcaaataaaataaagaaaatataaaacatgtccttgaagcccaatgaatagtcattttagttctttgaatttttactttccttagttatttattttcctaaaacttacattcaattctttaacattttcaaataacagtaatcttagtaagaaggagtagttatctgagattgaagttaagtgatccagaattgattttatgaaaattatacatattaactgttttaaaaatatatgactgtgtttgtttgtttctcattctttaacgtggtcttgttagtaagtgccacagtgagtaatttaatgcaatttcaacattaatttactcacataaatggtctactgtggacagtggcagtacaaaggaagaatataaaagagaataaatagttcaaacctggtggaggaaatacacccatagggtgaatataattcaatgtgaaatgtgcagtcatagaggtatatgtgactaagatacagattttcaatatttctccttctggagacttctgttacttttctcctaatgagtctttccagcttggacaatttcatgctaacattagttctctaactgctgcatttacttttcagtgcctaagttattttaaagtgactttggttccaagattcacctaaccactttaaatgaatgtgatgttttttgacatctcattatgttgctaactttaatatctcagagccatctaatctctcatggtatagccaaactcaaggtaaaaatgaatgtggctgagatgctgtggaaaaaaatgccatttctatatgttataaataagactgatttctttcatttatgtagtatgatatattaatgctgctgataaaacttattttgcaggagtggattaactatgaagccaatgaagctttgcttatatggccgtttccaaatagtaatagtagtaatagtggcagaagtcatagtaaacattattttaataattataataatatagctaacatagggagtcatatggattaaaggatgtggtatttgaattttaggttcagttttgactttaaaacttattagctgtataattttggacaagtaaaatctttctttacgtacaaaatacctgtcataatattatatacaagaaaaaatatctacttttcaatggtaaaaaaattatagtattaaaatcattaaaggtttgagtctaggaagaaatttttattttacttcaattttcattctaagcttatctgtctacccaaatattctattttttttttaatgagacacaatcctgttctaattgtggaaggggatattgagatctttagaacatcagcatttaaagattattctgtgtatctcatcttttattcaaagaattttcttgaatgtatacttctaataaatctggtatgtttgataccatatgcttttggggattcaaaggaagtgagaagtttgaccactgacattgaaaagatggaaaatcgttcagtcaggacacagcttaataagaaacttaaggaaaaaatacctgtaaaagactgtagaaacactggaggaacagaaatggtcattgtggtgatggattaaactgacttcttagacaaactcttttcagttggtgggaagagaggcagaaacaaaacaaatgtgtaggaaaacagtaggaaagctaattaatgtacagaaagaatgcttttaatgcaaagagagaggttaaaaattataaaatgaggaaatttggaggattctaagataaactgaaaaaattgggattttgttccaaagcaagagaataatatttatctcaagattagatgatatttgagtttcttctcagtttttccctttactgtgacttgtacaggtcaccttgcttctctccctagtttattaatttctcaatcaaaagaattataatcaatgaatttaaagcatattcttcaggttttgatccactgttactctatgactgtgtgagttaggaggttttgacaaagagaagaatggaatgaaatgaaaatctagggattgacaactgcatctagaatgaactccacagaagagagagaagagagaagaaaccacattcatggcatatggtgaggtcacaaaaagagcatgggcttcttagactcaggtttaacccaggtgtttccctgagcaacaccataacctttctatgttttcatttctttccctgtaaaagatgatattgactactaactcatagtttttttttgcgagaaggaaatgagactgtagatttaggaatcaaaattacttccttcatatctttagctatagatgcttacaaaatttctttttatccttagactttttaaggtataaaattatttaaattttgtataaatatatgtggatacaatgactctagtattctaaatatgcagaaaatcactattttcttggctggatgctgtgtattcatgtatgtttgctgatggtgacatgttttattttaatgaccttattttatttgctcattttgacagtgattacctcttctggacattttactttaattttgttttgttgggctagaaaagggatgtccttcatttccctttacaaaattatttagagcatagattctattttgtaagtagaggaagatatttcacataatgtcttttgaatcctgtgtgataacaaaatagtacagaatacattcatttgaaattaataatgttccccaattatattattttttcacttttattgtctgttttgctacttcaaaaaagtgatcttatgaaacagacttgtgctataaatgtggcgtctaatgctaactctcttttttttttttttttttgagatggaatctcgctctgtcgcccaggctggagtgcagtggcgcgatctcggttcactgcaacctccgcctcccgggttcacgccattctgctgcctcagcctcccgagtagctgcgactggaggcgctcgccaccacgcctggctaatttttatttttatttttatttttgtatttttagtagagactgggtttcaccgtgttagccaggatggtcttgatctcctgacctcgtgatccgcccgtctcggcctcccaaagtgctgggattacaggcgtgagccaccacgcctggcctaatgctaactctttaaaacaaactgaaactgaaatcttttaaattgtgaattgtaattgtattttacagcaaaaatacaatgatttaagcttgcaaacattttacaattttttttccaaaaatgacatctagatatattactatggtagcttttttggattggctactatgtcaatgagttattataaaataaaaacacattttattatatgtgtggtaaatcatataatattttaagtatgtatgtcctttatacccgtgcaataagtaaacctcttcctgaaacatttactgattattctactgttgcagaagatataatatagtagaaagaaatggaagaaagaaatctcagataagaatattttctttcaaaaaggtatgagaaaaatttattgggtctggaactattggatagagaggaaaaaaaggtgaagaaagccaccaagcagacaggagagggagctgatagaaagcaattttgtactgttcactgaggaagtcattaaataaatattcataccatgagctatttgaaaaaaaaaccaaacaaacctggaattgatatttcacctgaaacaaaggtgtcttttaatctttgctccatgtatttttcttataagataatagttcttaagatctaaattcatggcttagtttttctttctttttttttttattattatactttaagttttagggtacatgtgcacaatgtgcaggttagttacatatgtatacatgtgccatgctggtgcgctgcacccattaactcgtcatctagcattaggtatatctcccaatgctatccctcccccctccccccaccccacaacagtccccagagtgtgatgttccctttcctgtgtccatgtgttctcattgttcaattcccacctatgagtgagaatatgcggtgtttggttttttgttcttgcgatagtttactgagaatgatgacttccaatttcatccacgtccctaaaaaggacatgaactcatccttttttatggctgcatattattccatggtgtatatgtgccacattttcttaatccagtctatcattgttggacatttgggttggttccaactctttgctattgtgaataatgccgcaataagcatacgtgtgcatgtgtctttatagcagcatgatttatagtcctttgggtatatagccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgcctgttcatgtccttcacccactttttgatggggttgtttgtttttttcttgtaaatctgtttgagttcactgtagattctggatattagccctttgtcagatgagtaggttgcgaaaattttctcccattttgtaggttgcctgttcactctgatggtagtttcttttgctgtgcagaagctctttagtttaattagatcccatatgtcaattttggcttttgttgccattgcttttggtgttttagacatgaagtccttgtccatgcctatgtcctgaatggtattgcctaggttttcttctagggtttttatggttttaggtctaacgtttaagtctttaatccatcttgaattgatttttgtataaggtgtaaggaagggatccagtttcagctttctgcatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttagttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatgggagtggcattgaatctgtaaattaccttgggcagtatggccattttcacgatattgattcttcctacccatgagcatggaatgttcttccatttgtttgtgtcctcttttatttcactgagcagtggtttgtagttctccttgaagaggtccttcacatccgttgtaagttggattcctaggtattttattctctttgaagcaattgtgaatgggagttcactcatgaattggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttcacctgcctaattgccctggccagaacttccaacactatggtgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgttgaattttgtcaaaggccttttctgcatctattgagataatcatgtggtttttgtctttggttctgtttatatgctggattatatttattgatctgtatatattcaaccagccttgcatcccaaggatgaagcccacttgatcatggtggataagctttttgatgtgctgctggattcggtttgccagtattttattgaggatttttgcatcaatgttcatcaaggatattggtctaaaactctcttttttgtttgcgtttctgcccggctttggtatcaggatgatgctggcctcatacaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagaccctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgataacccctttatcattttttattgcgtctatttgattcttctctctttttttctttattagtcttgctagcagtttatcaattttgttgatcctttcaaaaaaccagctcctggattcattaattttttgaagggttttttgcatctctatttccttcagttctgctctgattttagttatttcttgccttctgctagcttttgaatgtgtttgctcttgcttttctagttcttttaattgtgatgttagggtgtcagttttagatctttcctgctttctcttgtgggcatttagtgctataaatttccctgtacacactgctttgaatgtgtcccagagattctggtatgttgtgtctttgttctcgttggtttcaaagaacatctttatttctgccttcatttcattatgtacccagtagtcattcaggagcaggttgttcagtttccatgtagttgagcggttttgagtgagattcttaatcctgagttctagtttgattgcactgtggtctgagagatagtttgttataatttctgttcttttacatttgccgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgctgacagtggggtgttaaagtctcccactgttaatgcgtgggagtctaagtctctttgtaggtcactcaggacttgctttatgaatctgggtgctcctgtattgggtgcatatatatttaggatggttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcaagtgagatgggtttactgaatacagcacactgatgggtcttgactctttatccaatttgccagtctgtgtcttttaattggagaatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccagttgttcctttccatgtttagcacttccttctggagctcttttagggcaggcctggtggtgacaaaatctctcagcatttgcttgtctgtaaagtattttatttctccttcacttatgaagcttagtttggctggatatgaaattctgggttgaaaattcttttctttgagaatgttgaatattggcccccactctcttttggcttgtagagtttctgcccatggcttattttttcacgttgcgtatcgaaatgccagctattcagaaatgccatacagttgcttggataaatattaatttagaaggaagaaatgacctagtgttctcatttataattcttataacttgtccggtttagacattatatatggtccaatatctcctacacatcagatttttttttcccaagatggagtttcactccctcagaagtagtcatcattttatacatgtatcattctatttatagataatgttgtttcaatttttcttaatataattttgggtagctacataacaaaaatgtatctaatttttaatagagtacttttgataaagttatacatgatttatatgaatagttcctcacctaaaattatctatcaatttatttctcatatgaaaacaaataaatatgaaattaaaattcttagttatgaattttatatgagtggatcttgaagtagtattgctaggtcattgagaaggtacacttaaaattttgcttttactgccaagttttcctccatagcgatgatactaatactcccactattagtgtattacagtgtctgtctcgtcccactgtagccaacacactgtgctaccaaactgcttgttctatgcctaacagaatggttctaaaagaaagtatgtttttattttaatttatgtttaatatttgaacatccctttatgtttataacacattttttatttgacctatggttcctacccattcgccagtgatgttctgagttgatctttttcctagtccctttacatattaacagaaacaaacccatagcagcaagaggtcaatctaaaatgctttgaggcattgccagattttataagaaataaaatgcatatctgtgaaaacatagagatgtttgtacaaataccattgtcttcttttctccctccactgtaagcaaaagatccagtggagatccaatgaagagaagataattttatcttcttcaatcacataaaataatccagataaatgagcctgttttctcatattcaaagtagccttctgaatatcactcactcaacactgcttcagggaatctcactgggaatttttttcaccagactggtttctctccctctattctccaacatgtcaataattctgatgggataatctttcagagactcaagcttgtcatgtcatttctttgctctaaaagctttaatcgtttctactgcttaaagaatacatttcagatttggcagtgttccattaaggagttctataactgtccttcagcaactcttttctaggctcctttgcagctacaacaatgcatatattttaaattgagtcacagtactaccaaaacctatcattagttgtcccatctctatacttttgctgacatcattttctgccaaaattaatgctctgggacatatttttccttcttttttcttttcttttttttttttttttttttttaacatggagtctcgctctcttacccagggtggattgcagtgatgcgatctcggttcacagcaacctccatctctcaggttcaagcaattctctgcctcagcgtcccaagtagctgggattacaagcacgccccaccacgcacagctaatttttgtatttttagtagagacggggtttcaccatcttggccaggctggtcttgaactcctgacctcatgatccaaaagtgctgggattacaggtgtgagccactgtgcctggccaggacatctctttacaaaaattacttttcctatcaggagattgcaagctgctttaaggataagaaagtgttttgataattttgataaactgctttgcctaacataaacacgggggtatttatttaattaattttttattaatttagagcataatttaatttaattaatttaatacattctgctctaaataatataatgctttaaagaggccaacattgaaaaatacttcataaagaacaattacctttagtgaggtataacacagagtgagctctcagttaagttgttataggttcatttctggtccttgacctaataacatcaataagactaattatttgtccaagctgtagttccctaattggaatcaagatataaaacttgtatattcttaaagaaattatgataaaagtttttttacttttaattgacaaataatagttgtgaatatttataagatacacattgatgttttgataacatcattgatgttacatatactgtagagtgatcagatcagcgtaattagcatatctatcatctcaaatatttatcatttctttgtgttggtaaagatcagtattctccttctagctattataaactatacattcctgttaactgtagtcatcagtggtgtataacaatgctagaactgattcctcctgtctagctgtaaaatttaaaatccattgactcaatgaattttacaacgccttcattgcttgttacaaagcatgtaacattgcttattacaaaaacaagggcagtagaccaacgcttcttttagctctgctgaaacatgaacaaatacttttcattttttacatcatttataattgtccataacttctacaaagttaatacttaacacaaaaagaaggatatatattattttacaatctcttatatagtacatatatagtatatataatacatctttcattataaaatgtaagatgtattattcattttataatgaaagatgtattatacattatatttggacttcaccactgaaccaaagcacaagtagctctgataagtaaaatttcccatctgtaattgaaataaatcttaaacctaattgttgtattgattatataatgctttttcaattcaacaaattcacaactagctaaaatgtcatatttctgtatcagataataaagtcataagaggagtaaataattgaaaactgaaaagacttgttttcaaattaatattaaacgattgaaaattttgaaaactgaattaagaatagagtccattaattcaatttcataaattcatgtagaaacatcagcaataaaaaagaaacaaatatgttgtagaccaaaatgaagatcttaaagaggaattgatttcaacaaaccacaaagcacttctcagcttttcagatcattggctatatttaagaatgggagcagactattacctcttttattcctcttctgcttctatcatctttatcttgagatgccattcttcagaccaatcccttctccacaagagtactgtgtcattaataggaaatactgttgaactgcgtaaaggttccacattcttattttttctatcactagacaaactcagaaaagccatgctgctcttcattgtattcactttgcctcaatagaaaacactaaaagtaaaaatgaaatggaagaccaagacttccccttgagatgagaggaaaagagagagtgtgcaagtgtcaaacacaaagaatgctagctggagtcacgtacatttcagagtcacacaattaaaattaccttcttacctctgtgattttacagaatggtggacagttgcttaacaagggaaagaatgaatgtgtgtgtgtacttgctcctgagcattggatccaaaaacaaagaaaccatttgttgccttagcttgtatggcccttgtgttgagaaatagatggcctgaaagaatcaggagtaccctatctaacatttaaaaggaatgttacttagtatttataaacttctaagaaaaaatgtcagaggtttttacactttaaaatgtgtaggagctcagagtattaagaaaaaactcaaactttctatatttgtttttaatttgttcagtaattttaggcaatagattattgtttcatgcagagaagagatttactgacggttcagtttcatgaaatttatgacactctgataaaaacaattacctagcaaatatttgctcagcagcagatgaatggcatgggaatacagacatgttggactattttgccaaggtacctccaagaagagggaaaaatgatgcaggaagtggaaaaacatgataatctatgatacaaatacatgcaaactttgagataaagataggaaaaatataaaatataattgaatgattagaaccaaaagcattttgtcactgtatttgtgtgtgtgtgttttaaagacaaataccatgaaaactctcaaaaactgaatgtgtagcttaagtaagtcacagagaaagctcttttagcttgtttcaccataaaatttagtatatgtagtaaatacattttataagatatgagataaatattgcatcagcctgattaccataatatggatacttgagaatatttgttgcacattatactaaactttacagttaccagttaatttcatttcttttcacatagcttcactttgaaaaacatgagatataaattcaaagaaaagatgagaaatcaaagaaatgttgagtttatgcaaaagtaaaagtgaaaaaatgagaacaattctattcaacttaggtttatttgatgtttactatgtgcaaggcaagctgacatctgatgacatcaacccatttttaaatattagtagtgtttcaaccttactctgaatgatttattcaaggaacaaaatcttgcaatatcaatttttaaatgttttgttgatgaatatatagagttgcatatttgtgtatgctttcagctaccttttacggtgaaagaagagaaagagttgtcataaatctgaagtatttagcattaacatttctttagtcacaattttagggctcattattaaacttttgaaaactgcaaagtgtaattaatgccattccaatcatcagcatcatcatcaacttaggaggaactaaaccaaatgtattaagagaaagaagtgtaaagtttgttttaattttgaactaatctcctcaaaccttatttctcatttgttcaatgagaacacaaaactgagcctggcctggcctttaattttcagtacattaacttatgtttcatggagtaggtatttaccaccaggagccaactccaataacttttctctttattttaaaatttgcctgtaacatttatttgtgcaaacactttctttccacatctgcttttgttcaatcatttattctctcctcaaggcctctatccttctgatttttgccatatctttaatatcttcagtctctccatttctatcaccttctttcttttagcctaacacatatgcaaagtggtacagtcttaaaaataaaagtaagcctgtttctcctcttgcctctacttaagtaaccactctcacacttcactcatttgtatgcatgccttactttcctcctctgtgttcactgaaaacaatttaactcatctttttatcctcatcacctagtagttacttgcaagtagacaccacatgcttattgaaggaatacatgactgtatgaatcctatcatgttcttttatctcaaattgattgccctcattaagtatagtttttgagatctatgaatgtcacttaaatttactacaataataagtagcataatagcaataaagagcatgccccaatcttttagttcaacacagaaaggtgtcagtgatagtttatgaaggatgtgcaaatggatatctattatatgaataagagctcataatttagttgtaatggctctgagtcaatgataattatttaaatatttttgttgactgataagccctaatctggccatggcactagcctaatttggcaaatgatttcatagaaacaatacaaaagtatatatgccaatgtgtttccaatctctatgactttgcacctgttgctccattggcctgaaacattacttcctctctcttctcctgaataatttctacttatatttcatgtcgagaatatcatttctctagaaatgttgccatcaaatttgtgtctctcattattttctctttcagcaaaatcattgcatacatagcatagcatgtatcattatatataattatttgaacacatactgagtatgtcccttccacagcatacctcccttctttatttttttaggagaacattttatttatttttaaaagtttttctttattatactttaaattctggtgtacatgtgcagaaatacctaacgtagatgacgggttgatgggtgcagcaaaccatcatggcacatgtatacctatgcaacaaacctgcacgttctgcacatgtacctcccttcttcttcttctttttttttttttttttttttttttttgagacagagtctctctctgtcaccccaggctggagtgcagtggcgcaatctcggctcactgcaagctccgcctcctgggttcacaccattctcctgcctcagcctcccgagtagctgggactacaggcgcccgccaccacacccggctaattttttgtattttcagtagagacggggtttcactgtgttagccaggatggtctcgaccttctgaccttgtgatctgcctgtctcggcctctcaaattgttgggattacaggcgtgagccaccgcgcccggccacctcccttctttaaactctaagaattcaactcttatttcatgtatttagcaagcagtacaatgcctggaattcagtgggcactcgataaatacttattgaatgaatgaatgaatgtggatgagcatagacgcagtctgggacaggtgtttaacgtacagctccagtaactgaagaattcacgttttcattgatctctgtagcatgctactttaactcctagggactgcaatccttctcatacatttacattttaatttaaatttctcaagatctatagctctctttgttgtcaggctcaaattatcttgaccattcaccttccattcttttatagagatatcccctggaccttggattaattctgctaaagccgttcctatccttataagaaaataaagagtaaatattaggaaaggagttgcaggaagaaaatatgttttttaaacaacattcgcaaagctcattttttagaattttgttaagaattagaggtttaaaacaaaagtgccataaaaattaacttctaaatttcattagtttatcatattagaataattagaactcgtcatctagcattaggtatatctcccaatgctatccctcccccctccccccaccccaccacagtccccagagtgtgatattccccttcctgtgtccatgtgagttagtgggtgcagcgcaccagcatggcacatgtatacatatgtaactaacctgcacaatgtgcacatgtaccctaaaacttaaagtataataaaaaaaaagaataattagaacttgcacaatcaaagatctggtgggatatacttaaccgaataacagtagaatatataatgccttataattgaggaatggctatttgccattaatgaaaatagactacagggagcttcctattcgaaaaagtggcttatgtgttagcatttacttctgtagtgccattaacttaaaaaatgctaaacttcctttatagatattgagtgaatcatcataatttgctaatattaagtattattcacattcaaatttttctactcataccactctgacacataacaaaattaagacagtctcagtttaaagacatagaggatataatttaggatattagacggcattaactaaatatctcagaatctagaaattctgccagcattgattcagaatgccacctgtagtagcctggcctctgtaatatactatttcatgtgaccatttcagctccgtggatgttcgatgttaaatgagacagtgtgagagaattatgttaatatgcctaaatgtagtccactggttattcagtcaacaaaatgaactaaatccccattatgttctatggtctctcttaaagtgttaatttaacaatatgcactgcagaggggaaaaaataggctttcttagacctagtaggtaaagaacatgaagtaacaatcaaattctattatgagatattgcacataaaagattattacatgcatgaaaaccaggccttcctctaacatttgtggggtctgggacaagaatatatatagtagcctgcaaatcatatctaagtattaaaaaattataaactaagctaacaaaattctattctccaactttggtaactatccctttataagtcccaaaaagccagttgtgaatttggaattttctaactccttttattttggtacgaaaatgtgaaatctggaagaagctggctccaggtccctgtctctaatctgcagcccgcccatcttatttacaacaccaaaaagggctttgtgcacaaaaatgagcagtctagtcctcatttccaagctccattcacctcttccacatcttctttaccactccaacctacaagtatacacagcagtccagccacagagatggaccaagtaaagaggcctacctatgcaggccctgttgacaggccttggatcattttgccacagaattctgagatccaagtgttctacatatgttctagagcagacttggcatggataattctcgttggctgtcaaaatccttttcccgaggggtggggcgtggctagagaaaagccaaagcagggtcctctgtaaagtgtcgggtcctctataaagtgtcaggtcctgataggatgataataatgcaaatataaggaaactcttatggggaaattttacacggtctctctactatcaatgttattaggagagacagcacaacatagtgaacaaacaagttgcctgagtacaaaacccaactttaccacttactctcctggtgtagttattccacctttctgtacctcagtctcctcatgtataaaatgataatactacttattgcatgatgttattgtgaagattaggtgctatgcaaagcccatgaaatacctggcatatagaaaacactaaataagtattagtaatgattattttgaagtgctaaagaatgattgatacagtcaggatgcatcccatgtagggtgtgaacaagttagtatgccacatctaagaaggaagataaaatcattttaatcccagagtgatacttcctttatattatgtgattttaaatcttttgatttcaattacaagtaaagcatttattaaacattaggtgaaataattatacatatatcaaacagcacacaaataatacttattgactgcatgcctgatagcatgctaaaaacattttatgcaacatcacatttaattctcaaagctaacttaaaattatgcactcttttctaatctgtgtgcaaatgagcatctacgaaagcatgtttttcatctggtcccataaaatacattacctgagcaaattaatatagttgtatctgtatgtacaaactttattggcaaatgagaactgcaataaattacaaaagattttactttagctttctacatgagaagttctaaaagccatttcagaactgaggacaattttttgaagtatgctatgcattttcatcatatatctcaggattattgccagatagaagtatcattactcctaatcttaatagattgcaaaactttaagcatcggggtgttcaataacaggattgactaatgtaaaggaagtaatacttagtaaacaagctgattacatttaacataatttaaagaaatctcactgggcaaataacccattgaaaaccagtggtaacatggatgtaaaactactctgccgtaggtgagtaggtctcacctaataaacacttcaaaaccaaggtagagtcttgagtagcaggtgagaataaatcaagctgctgtcagtcaagttattattccaggatagcctacagccagtagtggacataaatggaatatgtacccaggtaaataactctgtgtatagagacctgtaacttgcaaaagtctaaggagtgagacctggtgcggtggctcacgcctgtaattccagcactttgagaggccaaggtgggtggattgcttgggcccaggggtgcgagaccagactgggcgacatggcaaaaccccatctctactaaaaatacaaaaaaaaatctgggtgtggtggtgcacacctgtaatcccagctacttgggaggctgatgcctgagaatcgcttgaacccaggaggtggaggttgcggtgagccaagattgagccactgcactccagcctgggtgacacagcgagacccagtctcaaaaaagaaaagtctaagaaatacacatttagggactgtaagtgttcactgtgggatgctagaaaaatactataaatataggatattagaaaaatagtgtacattataaataaaacttgtctgcagtccttttcttgaaaaatatatagtatttatagattttgttacctgtttcataaaactcctttatgatacattgtttataaattatttaccagtttactcactgggtggtacaagagagtcattttctcagcactctagctaggaatttaagccgagaaaggtataatatcttcatgaggtttttgtttatttattttagttttttcatcaattcaagaaaatatcttacacaggcaggatatgtactagaaaagtagtaatactacataatacaaataaggaaactcaaatgtcttactaataatgcaatattgcaaataagaatactcaaacatcttactaataatgcaataaatataacttgcccattgctatattataaattgtcaggcttaactggagtttagcattttaagataaagtctcatgtataattgacgaagtcccttattttatctcagaaatgatttcataaaattgaagtgaattaggaaaaagaaacatttttaaaagttacttcgtgttaaagtttattcattatatttataatatacattttttattaaaacagtataattctgctgtgtccatctatctttttaacatgttggtaagagagagagaaagtatgaattttgtcattttaaacatggcaatgattatccatttttaagtgattaaccaaaacaagaagaatatgagtaaatatcaaaatgtttttcagtatatttgaaaccaaaaagtaacaaaatcaataacagccaatatttacatattaagaacttactatcttcatagccttttatattctagtcttctactctaacttctttctgcacatgtgaaatagatgtgttataaaattatcagtattgagaaatggtaatatgcaacactgatcttattgaattttggcaaaaaaaaaaaaaaaccaaaaaagtgtatgtgtatggcgtgtgtctttcaaaataagggcatttaaattgaaattataaaatataaattgtaactaacattgtatgtaaaataaatagataatttaacagtcttctaagagctccaaaagtaagtatataacattttgttacaataatcatgtggacatcagtttccagcaattaatctggtaaaagttcatcgataaattcagccatctgagcactgaaaataactcgttattaatggaatcaactggtctacttttcagtatatgagattttactctattaatcagaacagatcttcaaaatgcctaaattaacacctccacaaatgatagcacggactgacattttcacagctcatatacaaattaaacaagtatcctgtgactcctgtgtcaaatatggcagcatttacatatatttttatacaattattttaactttcaatagttgtgcaaattgacttgtactcttgaaggagtacagtttatgggacttttacatgatttgtgcagttatgttaaatgtatctaacatattttcaaaatgtgtatggaaagttaattcttttttcatttcttttcatgaaaaaaagcagtatattttatttttttccaaaatataattggaaataaaatgagctgattcacagacgtatatactctaaagcttaaaaaaaaatcatggcatcctatttaaagcattttggaataactttttctttttgtttagatgagttcacagtcaatgcacaaagtctttaaatgatagtaaatcagactgtgacatcagcttataggtaaagtccaaggtgacccaaaatactaactcaatggagtaactttaagatctgcactaaataggtttaggaactaatgtgcaacctaagacagaacaagggtatctcagtacaatggtgatgtcacattaaaatgctatggcatcaatcactgcaaacaaaacaaaaagcacattaatcaaccttaagggaaaaaatcaatatccaaatgattcattttcccccagtatttctctattttcagaaattacttcatataaattttcacatagcaaaaatattacccagtatcttcatttaaatgttttcacattaattagttataaaataaattattggctagggaattgatacatattgattattcatacttttcacctgaagtgtatttttctggtgcctttctaagtcatagtgcatcatgtgaaacttttagtttttcaactattaccaaactacattatgctacagtttcagtttggcaaagccagtttctgactaatgaggggtacaccacgaaattctgtattgtttagacaagaaattcaagaggaccttaatccagtgaaatgaatactgccattttggcatttcttacatcttaagcccacatcttaggtaaaaatggtttctattctgctgaaatgcaccagaaatggcttcgccttcaattttccttagtgtgttttcatggacaaagttggattaacaatccatgactacagccttgaaaatactgttaatttcatataaacttatagttaatttaaattttggttgctgcttctgctgctgtgtcgttcaatccctctacccttcctgggagagaattgggaaacatggtatagtatatgccatgcctgttctaagtagtaaaacatatgggttaagaatattaatactggagccaaatcacctgggttcaaaattcagtgcttccatttgtacaatttatattctttgcacctgactttccttatctataatgacctgcattacttaataaattgaagttgacttgtgaaattaatttaacttgagcaattgacgtaattgtagcaattgacttaacttcatttgcatatttacctgagttaggtagataaaacagaaaagtaaatatacaaatttcagattttcatagaaattctgctactttttgaaacaggactgaaactaatatattcttctttattaactacagtccatggttaccctaattccttcatgtgctagttactccagacatataacaaaaatctattcatcattgcaggatgggaagctacatgaaataaataaacgtttaaaaaattctccagataaagaacagaaagtgagagaacagaagcaaagtaataataatttttttcaaatcccagtcatctctaggtatccatggaagattgcttccaggaccctccccagcaatggaaaccaaactcaggagaagttcaagtactccagtcagcctttcacatccatggtttctgcatccacagttgggtgaatccacagatgtgtaacccgtagctaccactggctgactgcacttgacttatatatatttgggctcctgtatatccctattgtcaattgtctatacagcactggtaaaaaaaggactgaaaatcaaatattttatatttttattttgttacagccttacatgactctgatcatctctattttccatgttttccaatttaaaaaggaaagaataaagtcttgcttgttctatttctaattttatttccaaagagtgggtgatgttgtgaatctagttgatggtgagagtattatgcaatgaattagtttctatgataactactttttgttttatagcaaacagccattaatttaaaacttgtaaattggaaatccggaacccattgcagtacagctagtagaaacacattctttcagactgtgattacttccataaattcttgagtatcgagaattactgccaaacaaaacatcttcctgatgaaatgtattgactgacacttcagtagaaagaaaagtagaaaatgagactatgagaagaatgtctattttacataatataatttgaaaggcaaactaaagtgatttgtggatttgtttatgttttagggtaaagaaaaaagaagtgcaaaagaaatttataactggtttatcatttgaaatatatgaacttttaaaatttggtagagaatgtcatattctttatttacattaactattaatattagtatttgtcagaaaaaaattctccaatatcaaagtaaatatttcaaatagaaaaaaacctggagaacaaaaagccatactttaaggaaataaagatttctttttaaattgaaagactaaatccaaaagtaatatacaagtgtacacattcaggttaaggtatttaccatgtttgttgaaaaaataaactctttaatggtaaccgaatatatttctaagagttactcacatagttactattgtttatgcattacatatatttagcaacttacaatttttaggggcttcttagagtttcagaattttcatttttttcctcaacaaataaacacataattgaaaaattgaatatatgttttcatatacaataatacttttccgatttaagatgttaatcacagcatgtttttaactacagcttgctcttttaaattcagctcagtctataacaattattatgtatgttactattatgtatgcatatgtatacattaatgtcctacatatgtatttgcgtattaatgtgtatattaatatcatcataagcatacatgtatattacataatacttgcattatttgagttgtatcagcctcaagttcagaatagcatcaattaacatggccaaattacttataggaagaggaagtaaaagaatccctataatttagcaaattaataatttgctgacttcaaccacattactagaagctgtttcaggagatgtgtacttttctccctcatcatattatcctttctaattataaggtggatcttctttttataatgtatttcaagaaaggcatttctaattttacaacttagtttaattcaatgtaatggcatcagtttagttggtcccaaaggaaaagaagcaaataactgaatcgttaatgccatccaaaattttctcccctttgagacctgcttaattttcattatctataacgactgcagccaatggtgcttatgtctgaaagtacagcatttatttgggatactcagcatatcattcataaatttttctgcggtgatttcattttacatgacaaaaatcaccaaggggacttccattactagaaacaagcttggtttatttttgtaaatttattttacttcaacagtcaacagcaggtattgattacccactgcgttgagagcattgtactgtgtattgtaaggaaaccattacataagaagtaaaatatttgctgagagaatcactgacttatcatctaatgaaggagagaaggaaaactttacacaaatgattaggtatcagtcaatccatccgtttgctcttgattcattaattcatcgaagtgtactaagaagtagtctcttttttcagggattgtagtttatataaagacataaggaagtgtttattctttcagaactcgtagtggacaggcaagccatgatagaagtagtcccacaataatagggaaacaatatattatcactaggagtgttagagaagcataatgggaatagttagctctgactattcttaaaggatgaattacattttaatgttgaagattaaagaaagtgtagttcagtagagaaaatacaataaacaaaggcacagaatttggcaagagtagttatgctaaggcagttgtgaagttgtaaatagtggtttagcatggcagaacaaagtgtatgatattgactgggagatgtatggttatatgtaaggatattgtatgcatgttacatattaatggtataaatgtgtgtgtatatgtaacatatgtttacatatatatacacacagagagataacatacatggtataaatgcatgaactttgctgagcaaaatggtaaaaaatcttgaaaagtacagctatgctccatgtaacatttcagccaatgacagaccacatatatatggtcatcccataagattataacgtgctatttttattgtgctttttctatgtctaggtatattttattataatacaaatacttaatgtgttataactgtctacagtattcggtacagtaacatgctgttcagttttgtggcccaggagcaataggctatatagcgcaggtacataatagtgtataagatttaggtttgtgcatacaacactgaaattgcttaatgcatttctaagaacatatccctatcatttcgtgaaacatgactgtatttttaggagttttaatttcattaaagtgctaataaattgggaacatttttgaaagagtagttaatgtggccaaactctcacctctgaaagacatctagtggttacatgttggatgggttgacttggatgaagagtggaaagtattgatacatgtaatagacatgatgataatttagggggaatgttcctgagtcatgttgattctatgtgttctgtgagcctagtctcagactttttcaatctgtctgtaatgctataataaaagaaacttttctaattcttatatctaatgatatcttacataccacaattgcagcaactacaaattaaactttattaaaatttgactctagtacacagtgaaatctcagctccagagcttgacatacagggcccgtcatcctacttttagactaatattcctctatgaccccacctctactccctcttatgtgccaatacatttagtcaatgtacaataatctttctatttgtgtgacaaaaagtttaggaccaatttgctatgctttgaagcctctatttgtggcatatggtcattctaaaaaagtaatgacagagctgagattatttctgtttagaatctactcctatatgtcaaaagtttttgaagagcctactcctaaattctccagtgaactaattttttgctgatagcctgaaatcaagttcaatcgactttcataggaaagaaaaaaataacaactaaacagtcatgccaaatgtacattctttttctaaattcttctggggtcttatgcaactttgggtcttttaagtcatcttctggatcttcttattctgtcttttcaatatatatgtttttttctttttttgcattcacatctgaggtttcttggaacatatgagctgattgatacagctgtgggatccctggtctatagattctttgaattattccaaattgttttctctacttctctttgttgtctttgattttgtaaagtttttgccacaaggatatttcccttttctgaagggtgtttaagatgtaattgaactttgggagtttctgaatggtcacaatagaagtaaaacaggtcagaaagaggagcaagggcagcaggtaatagaggatgatataatgagggcagaagcctaacaagataaaaccattaggcttaagttgtgatttgggagcacctaagtgagagttttaagttttgaaatttttttatttgccttatccaaggaatattttaagaaagtaattttggatcctatatttctgttggaaacttcctcattccctccaaaataatatatcaatcaaataagcagatattggatgtttgttccatcttattctaatgtactttttagatgaataattttgctgtatctgaagttcctcaagtggccgctgtaattctgttatccttggaaagcatgccatttagaaaataaataaatacaaatatttggatattaatataaatacatgtaagatgcaggagtttagtcttcaggatgcaagaactaggactgggacaaacccttgagagtctggaatcacaacttattgcttgtgcaacttgtctttagccctcaacctaatggctggctgttcatgacaaacctggtaatctggtgtttcctgaagggctgggtggctgtttgaagagaagatttctctcaaaccagactttcacagagagaaaaaaaaagctctcaaggtttttgatatgagatgtaacacaacatttgtcttatgaagaggctgattcagcgggccttactttgaactcattggccattcgaagctgactcaaaaacaaacttataggaacctatgtctgccctcttctctatatggacttacacttgtaggaaacgaagaacataggcagagttaaatagtactattgttggcaataaagcagtattccacaaagatgaaggctttccaaagtgttccttaaaacttttccaaagcgttccttaatccttagcttggattagtacaagctaatccaagtattccttaaaaacttatcttctttcctagaagcattgggaaatttgacaaaaaaagtataagctcaaatccaatggaagacttacctcatcaccatggtcagagatccccaagtagaaggctcaaggggtagggtattcataggtgtattgaaaggcaccttaaatcattgataagtcgacttgaataatatgtttttctaaaaaagataatacaattcatattaggatttaagtgctcagtttattgttcagatgagtgttaggaagttcgttaaacaaaaattatttgcaaattcatcttcctaagctaaaaattttctggaatgtgagtcatgctaattctaatgtagaccagtaattctagaactttaaatcgtaattacctagaaggcttattaaaacacatatttctatgccctattcccagaattcaaaatatctgggctaggtccctagaatttccatttacgtgatgctaatgttactgatctgtgaagacactttgagggctactgataaaacatagttttagtcagttttagtcagtaatcccattatgctctatagccagtgaaagcttcacagagaacaaatataactatgagtggcaatgaaattgttttaatacagctcacatttgtcagtttgtaatatctgagatgtttattacttaagaggatattggaatcttactattatgcctgactaatttaagatatccaaattttatgttattcctctaaacaagaaagagatttctctaatgtcaatgaccaactcaatataattaactgagtacaatttactcttatttcctagaatttttttacactatgaaaatagtcaggtcagtcaataagtcttaatataaactgattgaggagacgtgcccattggctttggctgacaatgctacactcagtgcaggttttatcagtatgtgctgacccctgacaatcccattttctccttttctctttcaatatctaattttctcataagctgtatggtgtacattttaatgcttgccatatcccagctcttaccaatcatattcataatcattttataaaaaaagtacactgcctctagatatctgcttatttttcccaaatgcatgctgcccctaagcttagtccattctaacttattgtcagaaccagaatgagtcttgccctgaagggaccctttcaaactcactgttggttctgaatgcatttttgccttcaggctccctctattccttcagaccgatcatccaggctccagtgaatgttgcctttgggttgtctccttcggtttcaatttcaaggcttgcatgctttttaccctcaggttttcccttttcagtttctgtatgagattttaagggcctcgtggctttaaacactttctcattgcagtattttcctgtttcacgctccagtaacatggatatgggcggctgtttcattgatctgatgttccctcttaaaaatttcaatattctcttttcttatttattttttatattatactttatttcaaactataaacttattcactggtaagccatgtagtatatatataaaatgaagtgtctcaccaaatacgtattttctacaggaggaaatgatttccacacctacgcaatcataaccagtggaaatattggtactaaacaaaagatgtgtacttgttttaatttaagcataaatggttttattggaagctagttatgtagctcacagaaataacacagaacttagaaccatgctccaaaaaactaagggtgggtcaaggaggctaaatggaaactagacagctggaaacacagccatgtacatatcaatagaacagtttggttagggcaccaccagtaaagatgctggatactgatgctacccccagaactgctgccagtagatgctggatgccaccagcatcatattttaataatttttagaaatgcctctatttgaatcaccaatatgatgttctaggtccctaggtcccagatgggaacataagattggctgaactaagttcatgcctctaggtctgggtgccagacttcaagctgaagttcaacaagttcccagcttcattgacttggggaatacaagacagggtcctgctgcaattcatggtaagcatgatagtaatgcccagacactgaagtggttcatatgttatgtccaagaaaacattagaaatgtagaaaatatttacaagatcattaccttttacttgtaaatggtatcttacatgtgcttgtactaattttcatttttgaatgtaacttttcttttatttggactgatatttttttcccttactggctgcccaacaccacttttctctttgttctcaactcacctggaatacaaggtaaattatggacactacctgtaggccaaattccagcttatcactaaattgacaagcatgagcagcctcaagaagcacaatttaatctggttacagataacttaaattatgctgtctcttgggatagatggttggattacctttgaaatgcctgaagaattccatgcacctctgtatgttctcatgttgccttcagtgagccagatctgtttatcctgaagattttctagaaaagccatttatctcttcttccaatgtcttgcctttcatgtgtttctgaactctgtctactataaagttcgtatctaaccagtacaaagcaggtttgtattgctcacaaacatattaaaagtttggccttataataaataatgcccttggcttatttcaggatgggaagcgtctgattctttctggtcctttctaagtgtgtttttaacaacactaggacaatgttgccagatggaaaagaaaactgctttatcctacaagtatgtctaggtgactgaaacctatccagaggatggatcgtttgtttcaattatacataaatcaattatgtcttttattgaacatgattttaaagtaaaacttttaattatgatcttttttttagattcaataaaaattagagtgcctactttgtgctaggcactgttctcagggctaagaataaaatactgaaaaaaagaagtggaaaaaaagtgcccactgtaatagagcttatatcctagtagggctgtcagtcatatatgtaataagtaagtgaaacatgaaacataagtgtgtgtgtgtgtgtgtgtgtgtgtgtgtgtatggtcataaatgctgaagtagggaaggatgttggtagtattgaaataggtagaaaagacattgttgaaattttatctagagttgccatagaaggttgtatttaaacagacagtgagggaaaaatccatgtggatataaggaaaataatattctaggtagaggaaacagggttaaaaaactatctgaggcagggacctccctagttttttcctagaaatatagaggaggcaggtttagtttaataagagtgagtattgtggtttggggtaattgaagggatgacgacagaaagaaaattcggaagttactataaagactatgtattttatcctgagtgagttgggaagccctgaagagttttgagcatagtaggctttcttctgactgagtagctcaaccctttggaaagaatgttcaggagctcagtttttatacatcaagtttgtgttagctattaggcagctaagaggctatgtcacataagtggtggtaaaataaacaagtctgacattcagtgaagaggtggaggctggagatatataaatatgacagccataaacacacaaatagtagagaaagctgtatgctattgctgcataactaaatacctcaaaaatcactgtttacatttatatatatgtgtatatatatatattttctcacaatattagagttagggagctataacttgcagagctaagcagctttaccacacatacatagaaagttacatgccaggatttaatttcagagatctttgcttctggagagccagttcaatccattacaagccctgcattctcagctcctcctggagctgtctgctcttcccacagttcctcaccagtctgctgtgtgtcctatgcttgcttctccaatttggccaggttcctttttctgcccaaagtcttccttcattgtcattaatcaaagactggcactcttctggtcatctgagcaggaggcgaggaaaaatgaaaaatgggcaaggtcccacagagctcagaaagataatgagttcaagactctgtagacagcactaaatgatgaggattgaatggaggttggggagaaagggaaactgatggtgggcagttatatatattatataatttataattatacattatatatagttataatttatatatacacatacatacatatataataatgtatatataacttgattaataaaggaaagcatattatccctccctccctccctccttccttccttctctccccttgcctccctccctccccacctctctccctcctttcatcttgtctttttctttttttcagagacatgatgcttatactggtcattggttttaagtatctgggcaagacatccattttataatttgaaaatttattgcaatgaggattcatggtatttatttactaaatggatgggtaggccttgccaattaattttttcttagactttcttgtccttcattatcatggaaacaatatgtagactattcttttacaaaaagcctgaaccattgcttggcagagagggaactttacttcattttacttctgctgtgctctatgaccctcctagtggaagatgcttcattggtttctattaccagcatgcaaacagatttttaaaagtttctcagagctaaatgcacacagaatatggcaaatacttccctttagtcatttatgggtctgaatgaacaataggttttcttctctgaaaacatttgtagagccctttcatcccattcagaattatcctgtggaattcacacaccttctcattgaaagagtccttgctgccaagtgttattaacattcctgtaatatcctatttacaatctgtattttgagtttccagtctctctattaatagttctattaatattcctatactgtttcatcttctctcattagtaataatgccatatatacagactccagtgtggttattttctcttcttattaagggattctacatatccccaaggtttcttttgtacatatgtgatgggtaaagtttaattccagtaatattattgctagttatataaatgccacttgtgattgtaataattgctcataaagtcatctaactgtagaaatcagtggttcataaaacatgatagtaatctcacatatataattcaaatgcaatttcatagtaagatacatatttagtatatattgttcatttgctgatttgaatatattaaaatattgatatttaacatgacaacatagccttctagactggttattttaaagttaattaaactcaggaatgtgaaagagaggagatcagtttacatattataccagtaaatgtgggtatgtatgggcctgtaaataagctgttggttaggaaatatggaattttattttgttaactacaaccaagacaacaataacagtaagtctaatactaggctataatatcagaaaatctcaataccgggcttttgaagaaaaatacaataaaaagaatggaaatattcaagctaagaaatatacagaattttaaatgtgcatatgcatgcaaaatgtatattatctgagaaagtttttattttaaaaatttagatttatacgggttgtagaaagtccacaaattgcagaactgaaaaacaattacactaaagctatcatagttgaaaacatggtcatattctcattaataattaactagcttattatcaggttgatcatttgtactaagatgatgtggaaatagaaaatttgattagtatcagacaggaagaaaagaaatgagcttaaaatatggatttttttttcattatagagaagctatgcaagaaatttgctcatagacctatagggcacaaaaagaaaaaagaactcagacaatgcatcattttgcattgaatttgaatattttattgttgttaaaagcatgtaaccaaaataaacttagtcttctgtccccacattaagatctattcccaaatagtagtatattaaaaataaacaaaaatctgactcaaaagctcttcaaagtgatatgtcttcagtgaaggcttttgaagaggcagcaaaagaagtatcctatgagagagtgcaagtaaggcatcctgactcatgtcttcccaatacctcacacagtattcctactattctaatctccctgcgtctcttcctccaaactccaacccctctggatttccctccttccacaatgttgtaacttcaccacaatttctgagatttttttttctttaagtagcattgtgtaaatacaaatcactttaaattctttgggaattgtccaatccaccactagcccatgatgcttctctgaacaacagatacctgtgatccaacaggttgtaagaaatgacttttcctttgatggccggagggagagggaaacactttgcatatctacattttgtctctttctgaataccactgcatatgaaaatttgtttcaagaaaagaattcatgaaatatgcctcttcatatttcatgcaaagactgagtgtgtggggagagggacagagaggggactgggatggcagtatgtggaaagctgtatcagcagcagtggtagtgaaaatctgattccgcccaactgagtttgcaaagacaccagaagtttctggggtgtgccctcaaccaccaggaaggccagagaggtgaacgtggaatatggacagaccttggcttctacctattgctgctgtaaccactctgatctacttcaggctctcaagaaaagttcttagccaagataaaaaataacacacactccagataagatctacaggcaaagcaaaatcttcataaaagaagatggtatagacttcgatgtgaggacaattttcagttggatttgacttagaaggggagacaatctctgtgaacttgcggtcaggtgcagtggccccacggctgttatcccagcactttgggagactgaggctagaggactgcttgaagctaagagtttgagaccagtctgggcaacatagtgagaccctgtctcaacaacaacaaagaaaaataggcgggcatggtgtcacacatctgtagtcctagatacctgggaggtggaggtgggaggatcacttgagcccaggagttcgaggttacagtgagctacggttgcactacctcactccagtgtgggcaacagagtaagatcctgtctcaaaaaaaaaaaaagtctctgtgaatttataaattgcagattcaataattaaagccagtgcctcttgattaaattgggctcagttggagaacttaggaagttgtagtggagttattcaagatgaagaaaaaaacccaagacaattttgaagcaaattatcttttcaaaaatgagaccatgaaccagattcagactgtgctgatggcttcagcagacctaactaaatctaaagaattcaagacaacaagcaatgttggagcacaacaggcaagatggtctaatgaaagaaatccaaaagggacaattataattgggtagcatatgagaaccaacatgtataccagtcttttagatatagcggcctacctgggcaagggattgggaagcatttctatgtatcagcaaatattttgaccatttaactagtagcattctgacagagaacttaagcagagatgtttgccactggtatgatgtatagaggaacactaacataacagccagtataccactctctacatataggtcacaaaaacttctctaccagaagtattgtgagaaacatttataactctagaaattgactaggataataagggtagagtgaaggggataggacagagatacccaggagaggactcaggataacactatcagtctaccctgcatgcaagcattgaagggggtacattatctgtaatggattttataaacaataataaaatcacttaaagtctgtctgcttttacatcaccacacactagctattctaaacaatgccattgataaaatgccaggaagaatttttctatttaccctcctcccactcttgatacattactagaagaggtcaaaaccagaatccaagaaattgttaaattcagtattttaaggaatcacttggcaaggaagttgacaagaagtagtagtgaaagatacggagattaagaacatagtcatctttactgatgaaataaaagaaagaaaagaataaaagtctaggaaaagaattacacgtcaacatcacaatgacaaccaagggaagtagaagctaatagtctagttatccaagtaaaggtattattgaattgctaaccaagagatgaacagggattttagcaaggacaatttcaggcagagaagttgaagccagatttgctgtcctgggatgaaaactgaaaatttatcacagccagtaaaaggagctttcaagaactatttatttaataatgggaagatgacgataaatacatggcatcattagttcgaggacatgcttctctttcagctggcaagagatttaggctgtatgtaaagccaggtggattccagaggatttcagagaggagattgaggaggagcatcaaagaaccaggatgaaataagagctacagttcaagtaacaaaattgtattgcttactttgtgagtgttaagaatcatataaaagaagaaaacttattgagaaatgtgtaaattggaagaatacaagtttaaaagagaatttactgaaaactcataaataaataaataaataaataaataaataaataaataaataaacgcatgagcatatgtgtgcctgcatgtgtacagaaacattttaggaaaccatacacattaaaggagtcataattcattatatgttcaactacaaaagcaaacatgtctcctcctcttgacactttagcctctttgagaaaatactcttttagactacagtatacatttcttacttaaaattaaataattagccttctttttgaaattttaagaagttgcaaaggggttttgttaagaaaaataaatttgctgcttaatttcatatctctctagaccccatccagtaaaaatggagtaaactgagaaagtaacctctactggcaacatattacaatttgtgtacacatgtacatgactaaataagtgtgcagtttttacctattcaactctcatatcacataaatttatgtgtgcctgagtgtgtgtgacttgctactgcctttcactgtctaattgattcattcatccagaatacattgattaagtagtactggataatgttaattgctgggtcaaatttaccacaacctagattatcatcaactcaaaggaaaacctctttatttaaaatgagtcatgagtcaccccatttgtttagttggttagttttcatgcccttgttgctttgcagctctccacaaccaagttacatcattttcactcttctgtcaatatgttcttactacttttcttctgtcttgtctctttaggggcacttaacttcacttgttagcatagtagctgcatgggcatgatttgccaattcattctgtgtacacatttataattctattggcatcaaatcctaaatattagaatccttaatgagcagcatgtagggaaagagcaacctgaaccagaaaaatgtacagaaaactaaagaaaagattttcattatgaagaagagcagaggttttatcagagaacagtcaaaaggcatctgttagtccagaagtaattgaataccagcaaaagaagacttttttatatttaaagaaatgtgagaaatgactgatgactgtgaatgcctccatccctttatttaccatctgaatcatgagtaaggttcttatagtctttctagcattgaactaaacttgaacccaaatgtttcaaaatgaaatttgtataaaatatcacaatctctaataatacattttatttccttttgatatatcaagattattttcatgctatccacaaagtatgttgtgtcaaaattagaacagcaaatttgcacttacttaaaatattcttgtaaaaaccagtactttggaaggggatagtattatttttattaaaaattaccttacaattttgggaagtctcatatttctaaagttttattcaaattaaatcatgtataaatgttaatttagtaatattaaaatgtatatttcatataaaataaaaagtattcttttttaacttttaataaaattatctaatctaacacttaaaacttaatggtaatttcctattttaaaaaagtttgctttttaatttgctctttataatgaaaacattagcactgattttcataaaataaaaagcaagatgataccaatgtaaaagcatttcagttttttaattaaatgcctgttagagtctgtgtttcccattatagatgaaaatataattgcaaagtaggatacacataacacagtaagaaacacacaagttaatgggaaatattcagattcaccatgaccatgtgcaaatctgaccatattaggagcatgctgttctctccagggctgtgcaaagtaaaatggcatattttcagtagtaaatcatagtcagttgtcctaaaaagaatgaaggaaacagaattccaaaagtcagaaaggaatgtataagcacagaagtcttgagattagaaacaaatagcctccaaacaccagtgaatcttaaaaccatcaataaattgtagaacacaaacatatctcctctactgtcaccatctttatctgcaataaaaggaaatgaattatttcatagtgttgccatctctttatgttgtgttccattaataatagcaatatttacatgtaagtaacttttgaaatctagaggtgattattaactcagaagtaattttaccaaaaagttttaaaggctacatgcacttttgaaaccataccacctacacatgtggacagatatacaaacacagaggcctcattagagttgattcatgctttatgtgacaaaaaggaaaagaagaaaaaaaaaaagcttgattctttttataaagttaaagttgaactataaatacagtgaatgttggacacattttaaaacatacgtgtttggcatattattttgatttcatagttttaactcaatagaagtgtttttaaaattaccttgactctgttgtgaaaacctgataaagcattttattatcattacattctcatctgctcattagtgactgtggaattttttataaattagcatacacataaaatgataaaggaagttatatgttgtttattaaatatagatacacgcatatgccatatattcaaataacttttttgctagtatttatcctttttgtttagagacagagtcttcctctgtcgcccaggctggagttcaatagcacaatctcagctcactgcaaccttcgcctcctgggttcatgcgattctcctgcctcagcctcctgagtagctgggactacaggtgtgtggtaccacgcccagctaattttttgtattttactggagatggggtttcaccatgttgcccagggtggtctcaaactcctgagctcaggcagtctgcctgccttgacctcccaaagtgctaggattacaggcatgagccaccacgcccagcaagctaatatttattctaatggccattactgctgattgtaagtacctataatgttagtgagggtatggccaaacagacaaaattaagatcaacaaatttttctctgttaaatacatgtggaaattgtccatcctttaaaaacagtagctacaactgtttttaaaaagtcttcagtagataaaatcaatacccaacatggatgagatgtgaattagtgttacatcaaggttattccccagtgacctaagccatgtatgtaaagtaaattgtgaccaccatgcctccaagatctgactatgggaacctaattgatcagtggccccagctcttacattgtgaaatccagcactgcatttatgctgaggctacacttcctactcactgccgccaactaattactgagcacagcaggaatactaagttccacagcaggaactaagccagttcctgggaggcatagatctcttttgatggtgactgcgattcaagggcttctcactggccccactaaattttcttagaactagatctaggaccaatccaggggctttcatccaaaatcacttacttccctctcttctgcacaaagatcaaaccttttatttccatgagctagctcccttagccttcttcccacttattttcccttttctatcattagcagttccccagtaaatcacttgcacatcagattccttcttggcatttacttcaccaaggacactgactaatacacaaacatattggtatctttggaatttaatggaggaaactgcttagaaatctcctatagatttctaatatagcaccaaaaagcattcttttagtttttgaaatactcttggcatatgtagtcagaaaatgtggcaatattatcatggtaaccagatcctaatgcagctcaaagcagcctcacatttttattttccttctctttaaaacgctattgttctcctaaaataaatattggcagttctgccaatggagacatgtgcaagggaagcagacaatcaatgttgactaaaaaaaaaaaaaaaaggtgaaatcttccatagaagtctgagagtaggaagaatggctgaagtgtcatctttgtcattgaaatgcaagaatatatgtgtggcacgaagagatatgtaggaaagtgccatgtacagtaagaataaatggtatgggaaggagatattttagagtattcagaagaggagaagtaaagtaaaaattaaaaagctttagaattcaagggaaacttcattagatcactttgtaaaactaaattaatttcaaaagttcaatttctgcctctgtagaagcagaatatattagataatttataatgttgtaatatgaagtctagctctaatattctatgactcatttattaatttattaagtaattaatgcaaaggtgatacagtttggctgtgcccccacccaaaatctcatcttgaattgtaatcctcacaatcctcagaatccccatgcagcaagagagagaccaggtggaggtaattgaatcataggggtggttttccccatgctgttctcgtgatagtgagtgagttatcaggagagctgatggttttataagggtttggtagcttctcctgcattattctccttcttgccaccttgtgaagaaggtgccttgcttccccttcaccttctgccatgattttaaacttcctgtggcttccccagccatgctgaactgtgagtcaattgaacctcttttctttatgaattacctagtctccagcagttctttatagcagtgtaaaaatggtctaattcaacagtagatgcctactttattctagggactaagctacaaatctcctacaagaaacaaagacaagtaatcaacaattgcaattataatgtgatacattctctgaaaaaatatgcctggagtgtcatgggatataggataggagtatttaattcctccctgtgagaagtgtcaagaaagacattttagatgaaagcggagtgcacaggtagactaagatatgggttcaattcctagatggtctagagtagagaaagatagcatctaaaacagcagcttgtttaaaggtattagaatgttaggggatacaatctattggagatattaataccatgccttgagcaaaggatgcccgtgagaagcaggctgggttaggctggagaaatacactggccagttcttaaagcccttaggaaaccaggcatttcattctcaaagctgcgaagagccccagagaaattttactaaaagaagttacacagttaattttggctagaagctcactttgaatgtagtaaatcgttaagtatgtgaagacaaggcagagaaacattaaaattctatacaaaataaactagttcacaatatgggtgactgagtatattttgtttgagtaaatagaaagtaattgtgaaaaaaggcagagagcattagatttctagaagtttgaaaataattttaaaaataatcagatctcctttagaacatgtgaccttaagtgaataaatggaagaggaaatctccctgactctttttctagattcttaccttgtgttagccacagttccaggagagatttccccaccttgtctggcatcattcatggtggttggcgatgactcatccttaccctaatttgaaagcaaaaataggaagccgacaaggttgagcattactggcagactttgaaaatatcagtgtggaatcatttgatagaaaactgacttttccagagttgatcctctggaaaatgaggtgtttttttccccaaattgattcttagattataaatacaaccctcctttcagataattccttaaagtatattactctgaaatttttgctgtaactctttatagcttagaaatgaaccaggccaggcgagggtaatggggccaatgagggtcaggtgaactttaagtggaggtcagaaaaaaagcatgggtgaaggatgattgaaaaagagagtttgtaaatcaaggtaaaaaatataccctgcttcaatttttcctcgaagttgccagtggagaggtcagattgctggatgtcttgacatcatgtatttgtttatgtctctcccatgctgcattgtaatcatctctgttatggcgaatgcattgcaatgtgattattagtttataggtcagtccttcccattgaaataagcttctagagggcaagtactgtgtgttttatgtattcattctcaggaccttacatcagtaccagacatttttcaggtacttaataaatatttgttttagaatacaaaacttgattagtactatttttaaaaagaatttagatagcttgaaaatggcctgttgcttttacataccgggtctttatcctttagctttacttctcttccaggaattaccctactaaacatataaacctcatgagcatccttggctttctgcaaacccctgttcacaccagtgctactgcttattgcagtgcaatagggttaaagcccagccctcaggcttgttttctggcttcagcagggaaggatttaattagccatttaacttcctcaggtgtaggggacagagctccctcttccgataatgaggtctgcgttgccagccagccacactggtttctctcttcaggctgcctctctccagcacagctggtgagctggcttcctgacgaccacttagtccgcactggtatgaaaatggttccgtcaagaactgtcctggccgtgctctgggcagtatcttccccctccctaataacttcaaactggttgtgactccagaatctatctcctgtctctgactattctgctttactgagtgacgagagaagatcatctcatcttctctttttgcacaggtctcaccctttcttccctcaaggagattttgcgtgcaaagggagttttggtttcatttttggtctctctttaaaaattggtatctgtgttcagaaataatgtttcttttcctgaaaataattttaaatggtttctattaataaaaatgcaagcaatacagaaaagtaaggagaagaaaatgaagagaaacagcctgagcccctatatccaggcagaatcatttctagtatttggcaagctacctccatttccatatgcatgcagataaaaaaaaaaagatagatggaccaagagatagacaaatatacttttacaataaatgagatctttatatacatgcttctaattaagtaaaaacaagtattatatttatatgatcttttttgtaccacaccatgctggccatttttaaaccttaaatatattttacagatcaaggtatacccatggttttaaaataacttttttttttttcaaatccactctagtggacctcactcagataatatgtgtacttctccctgttaaacttcaacattaatataattagactagagaacatcaaaaagaagttgctctaatagagcactgtgagtaaaaactaagaagtacaagtagcagtactaatagtaatatagaagctgactctcaacctggaatgaacatgcaaatcatctgtaaatctttctaaaaatgcagatacagactcaataagtctgtgaccggtcctgatattctacaagcttacatggccctgcttgttgctgttgctgaccttgaaatactctttaagcagcaaggcttagagtatacaatgtatcaggcactttgctaggatcattcctcagggttatattcatgatctcattaccaaagcctataactactgcatttataagtgtggaaactgaggctcaaagaacataaaatatatactagaggtcactctactctctgcttaaaaagaggtgtttgaatttagacctgtctggctccaaacagaggttttttttgttttgttttgtttccctgtcatgtaaaacacactaatgcttctttctagaaatcccagtgctgagagtgatgaggttaaaatctgtagcatcattaaattatgcataaactaaaaatgtcaaaagagtccacaaaaccaggacaaagggttaccttaaaaaacaaaacaaaaaaattgcacaagttaaacagaaacatcaatagaattttgcacgtaatatatggattagggaaacattttaaaaagactttgcaaatttatgaatattacagtaaaagttacaattagtaaaagctggaatatatctaacttaagtttagcatcagaaaattttaaagtcaatgtataagccatgtacttcatatatatttgccctataaattatatttttatttttacttcataaagtctagaataactgttgcttactcaaatcatttgctttatttatgaacaacttttcagtatgttaagtgaagtcaatcctaaagattaagtttgttgtcattgtcttaaacatagataaattggacaaattccatgaaaaacacatttatcaaaattggcacaggaagaaataggaaatacaaatactccagcatcaaaaaccttcccataagaaaagtttaagctaaggcataaaggttttaagctattcactggtgaatacaataaaaaaaaagaaggaagtaataatacaatcaaacaaactttttcacaacacatttaacaaatgatcccaaaagaaaattagctgataaagtacttagtgtatatttccatttatatgaagttgaccatttatatgaagttgaacaatggcagaactactcaatgttgatagaaaagtgacagttgattataaagggtttggaatgaatgggaagggagttgagggaacttttctttggtgatgaaattgttgagttgtcaaaagtttatgctcgttttccagaactcaagaatgtgcacatttcccaactgaatttccttaagacaaaaagaaaaaaaaatagataaggtaatttgttctcaaaccaattcatttgcatagtaaattaataaactagcattaagtttggaaaaaaaatgatgtcattggggctattcaattgaataatatcaaaacaggatcttaaaatgttttgaatgataaaattatgattgatataaatatctggcttataatatgattaatttgaaggacataatacatatttgcatataaaatcccattatgtttagtagttgccttatttgtaattacaactgaggttgtaccttaaattgtttcctagttttaccatatttaggaatttgagttcttcctcacctagaggttagttcttccaggatgaataatacaatttttcatgttgctgattattatatgcttactgaatctttttttagcttgctttttgttttaatttctatgctttttaaaaaattgagatatagcatatactcagaaaagtgcgcaaatcttaagtgtaccattcaatgaatgtttacatatgatacacctttgtaaccatctccatggtcaagatatgaacactttctgtatctcaaatgattcctttgcactttattccagccaatagcaccttcttcccacctctaaaaatgatcaccatttgacttctatcactctatattagttttgcctgtttttgaacttcatataaatgaaattgtgcagcatatattctctatttctggcttcttttgctgaatgttatatttgagattcatctttgcagttgttgtgacatattcgctccttcgttttaacttctcattgctatatagtattccataatatggatttagtacaatttatttattctaccattgagggcatttaggttgttgatagcttttggttatacactaagcattcttgtaaatttttttttggtggacttaagcactaatttggtggctatatatcccaaagggagatggttgagtcatagactaagaatatacttagctttcgtagaaattgtctttttagagtttgtctctttgaattaggagccagacatgtgcatgcgttatatttgactggtatgtctctttatggtttggttttttttttttttttttttttttactttaagttctaggatacctgtgctgaatgtgcaggtttgttacataggtatacacgtgtcatggtggtttgctgcacctatcaacccatcatctaggttttaagcctcgcatgcattaggtatttgtcctaatgctttccctccccttgtccccccatcccctgacaggccatggtatatgatgttccccttcctgtgtccatgtgttctcactgttcagctcccactgatgagtgaaaacacgcggtgtttggttttctgttcatgtgttagtttgctgagggtgatggtttccagcttcttccatgtctctgtgaaggaaatgaactcattttttatggctgcatagtattccatggtatatatgtgccacattttctttatccagtctatcttccaagtctttgctattgtaaatagtgctgcagtaaacatatgtgtgcatgtgtctttatagtagaattatttataatcctttgggtatatactcagtaatgggattgctgggtcaaatggtatttctggttctagatccttgaggaatcaccacactgtcttccacaatggttgaacttatttacactcccaccaacagtgtaaaagcgttcccagtttctccacaacctcatcaacatctgtttgtttccagattttttaatgattgccattctaactggcatgagatgttatctcattgtggttttgatttgtatttctctaatgaccagtgatatcgagctttttttcatatgttttttggccacataagtgtattcttttgagaagtgtctgttcatatacttcacccactttttgatggagttgtttttttttcttttaaatttgtttaagttccttgtagattctggatattagacctttgtcagatgggtagattgcaaaaattttctcccattctgtaggttgcctgttcactctgatgatagtttcctttgctgagcagaagctgtttagtttaattagatccaattagtcaattttggcttttgttgcaataacctagaactgtagaaaccctagaagaaaaccttggcaataccatttaggacataggcatggccaaagacttcaagaatatttttatctttttattttcttaatttatagagactgggtctctctatgttgcccaggctgatctcaaactccttggctcaagtaaacttcagcctcccaaattgctgggattacagacgtgagccactgcgcctggcctttgaacctttttaaataaaacttgatgtcacttataaatatctgtttacatcatgcattttttataaagaggctggtgtatattttagagtaatttaaaaagtgtgattgctagtgcaattcatttcaacaagcttttcttgagtatctactatatgcccagaaaggctcagtagattcaaaaagaaaaagaaaaagaaaaacatgcatcacggcacaatgttcttaaattacaacatgtaccagccaatagacatagtgctattagaaactaaaataattgggatgatgtaaaacatgccgcattgaaaaatagcgaggatattgtaatcttttactgcataatatgatgtatacataagaacaaaaaatcagatactctgtatatatgttcaagagagacactcatataaaaacagaagaatgcctagaattggttataaattctgcactttcgtgaattattcactgtttttacaaaacatctaacaatacatcaatactctgcaaagatttaagtttctccaataacatcattgaaaatcacattttgtttctgcaaccaaataaataataaatttattttatattagcacataaatgttcatgtcaatatgatttatttatttttctgatgtatgggcctaaaaacactattttaaatatcactaaacaggaatttttaaaagtatacatgcaaataccagaaagagggattggctcaagatccatactgaacaattgattaaaatacaaatcgtgtaaatactacttttattttagatctgtcttaagtaaaagtagatttacatgtgactggtcatcatctaaactttgaaataaatgtagataaaacaaatcaaaagaaatgtaaaattagaaacaacatttcaacctgaggctagctcaaagctatgaaaatatgaaagagaaattgtagtaatattctttttctattatcaaaggaaactttcttgttttctctctcctataaatattatttatttagcaactttatttccttcttttcatttaatgtcgactgacaactcttaagggaattgtcataaaatatcatatgatcagaaagtaaaactctggtttagatatgaaagtttatgatgatagtagtattggtaggttatcagtaacaactttgttcaccaagttaagactgatgttgcatgcgggaagtgtttgtttttaagatatttttatatttccaaaaaagcagtgaaaaagatacaattatgacagacgtttgaactaaaatacaaactcttgctatgactttatataatatcatttaaaattaagtaacatgtcttttggtgaaatattgctgccatatgcttgacttcaccttcttgatttgaagcaacttatttattccaatacgaactactttacttttgggccaggcacagtggctcacgcctgtaatctcagcacttttggaggccgaggtgggcggattacctgaagtcaggagtttgagaccaacctgaccagcatggtgaaaccctgtctccactgaaaaaaaagaaaattagcctgtcatggtggtgtatgcctgtaacctcagctattcaggaggctgaggcaggagaatcacttgaacctgggagctagaggctgcagtgaaccgaggttgcacccagtgaactgggtgacagagggaggcccttctcaaaaacaaaacaaaacaaaaacaaaccaaaaaaaagtactttacttttgaggagaagctccccattgttggtaaaagtgctgtcttaacactcccaaatatatagaaacatgaaaaccacaaatacacacacacacaagcacacacacacaatttaacctaaagaatcctaaatgtggtaataactgatatgtgaaaatttcaggtaatgatctcagtgtatccaggtttccagactttaatattaaaagataaaaagcactgaagctttttaaaaaatagattaaaagttacctcagtgtttgtcatcctatagatatattcacaaatacaaaaaattggacatttatgtctactgtagtatgacatgatttgttaaaaaaaaagtttctgatattttccacaaaagatacagcatctaattttctttggtatttggaaaatcaatcttatttgtatgaatttctttacaggacacaggagattaaaggaaagagaaatctgatggaaacacatcagggaaaatagttctgtattttccaatgcttgaaaattacagctcattgtgtattttcatttcttttccttttcatgattgcttattttgttatttttctgcttccaaccaaaccaatcatactgttttttacacattactgattataattgagtaatatgaaggttctggtagcccccatgtgtaatttgttttcttctcatactaagtagacaggataagtggtgctagcagttgcattttatgacagtaagtgatggtattgagtttatgtggtcttctgtggcacacacataggcttcaaattcagatatgttggagaaggcatttgggatatgttgcaccccttaacactgttagaaaatgtaaggtttaacaaatgatcaaaatttaaagtaaaagttaagtgatatattgttccaggagcaacaacatcaacaacaaaattacaagcacaatgctactgacatttatataataatagtaatgattaattctttgctaaaacattgacctgaggatatttaatagctccactgaaaacaaataattattatggcattagcctccacacattaagcactactccatagattctggatacagtttgtatattatttattacagtggtccttagtgatacacattttaaatatctctgagatttcttacggagatagaaaatgaccaaattcttatctgtaattttactcatacaaaatcacaggtgaactgtagaactaaaagcatcactaagtggtatggttaggctttgtgtccccatccgaatctcatcttgaattgtaatccccacaatccccacatttcaaggaagaaagcaggtggaagtaattgacccaggagggcagtttttcccaacctgttctgttagtgaatcagttctcaggagatctgatggtttataaggggcacttccccgtttgctaggaacatctccttcctgctgccttgtgaagaaggtgccttgcctcccctttcccttcccctgtaagtttgctgcagcctatccggcagaactgtgagtcaattgaacctctttcctttataaattacccaatctcaggcagttctttatagcagtatgaaaatggacaaatacagcaagattacccttaagctttctttttctcttcaataagccttaaatgttaagtgtatgttggaagttttcatcctatctttgctaatatcactgttaaatttcaattcaattattaattaatggggatttaaaaattatctaaaaatgaacacaaaaattgatattaatgtcatttctatttccttgttcatattagtaatttgatacctaattagtgactatttgtattcacggataatattttttcttgtgtgggaaaggaaattagttttcactgatattaagcatactacttgcagaaagacatgttgaatagatattttaaattgttgattaacaataatctgtgttggtatattggtagaaatgtaaatgtgtacaggtactatggagaacaggttggaggttcctcaaaaagctaaaatagaactaccatatgatccagcaatccctctgctaggtatgtaccccaaagaaaggaaatcagtatatcaaagagatatctggatgcccatatttattgtagcactattcacaatagccaagatttggaattaacctaattgtgcatcaacagatgaataaataaataagatgtggtaatgtggtgtatatatacacacaatgaagtactattcagtcacaaaaaggttaacattctgtcatttgcaagaacatggatagaactggaggacagtacgttaagtgaaataatccaggcacagaaagacaaactacatatgttcttactcatttgtgggagctaaaaattaaagcaattgagcttatggaaatagagactagaaggatggctaccagaggctgggaagggagtgaaatggggagggggaagtgggattggttagtggatataaaaatatagtgagaatgaataagatctagtatttaatagcacaacagggtgattacagtaaacaataatttattgtacatttaaaaaatcactaaaagagtataagtggaatgtccatagcacaaaaaatgacaaatacttgaggtgatggttaccccatctaccttcatgtgattattacacattgtatgcctgtattaaaatattgaatataccctttaaatatatatacccatctacctataaaaattaacaaaatacaataacttgtatgtctataaacttaaagagactccatttaaagagatctcttggcaaatttccatttggataattttaatggtacataattagttagaggaaaacagaacttagaagaggcagatatgaaagacaggattctaagattcatcctgacaacagaaaattaaatctctaataaagaggaaatactgtattaagacttcctgcaagattttccaactctatctagataaacaacacagcaaatccataaagaaatggaattcctgccatatgcactgcagttttagatgctatggttagaaaaaaaaagtggagtagcatgtaatgaccatgatatctatcctgagcatcagtaagcgctgtcaaataaattcaagtgaatctatggggccaaaagtacagaaagttcaaaatcagtaggatcttgcaaattctagaatatgttcactggaaacataagtgacctcacaatttaattggctaacgaatatagaatacaaaattttatgatgtatccagtgcctacctttccagctaaatttatgagccttttcctccttgtagtttatcctcgagccaaaacaaattaactttaggtccttgaaggtgtcacactgtttcacacttctttgcctttgtacatcctatcctttctgactataaagcccttaatcacccgtcaacctggtgaactccaactcattgtttaagacagagctcagagtctctgactgccttcagatagatcagattattgtctcctttctgccaccattgcttcttgcacatgcctgcatgccagctttgtaggaataaagagattgcctttatttatatctgttttctcttctatccttgaactatgtgtggacaggaacagagtactgttatgctttacattccacatgtgtaacacgaagcctaacacattatagatacccaataggtgcaaagtgaataattttattataaaacaaaacttcaaaattaaacatgattttatggtaaattgtttattattgatcataagggctgtgaaaattcataggaagaagagaaaaataaaggcaattgcatttagcataagactgtaaagtggagttcaagttatttattgaatatattaatttgaataggcttgaaagagcatgtagggcattcaaggcaaaggaacaaggtgataatgacaggaatctgaatacgccattacatatttcatctgttatgaggttcctagcaacgactaatcacaaagtggtgtggagagagcatttgaaagcagtggtttagctatggcatcaagttcccacgttcgttccattttctaccctgagtctggtcctcaggttaactcttttaaaggtagcaagattttttgccacagtccactgcgtcagctacaaacaccatcctatcagcagaagagaaggggcagattcccaaatttgctgtttttctcagtatgaggaaagatttaacagatttacctcagccagctccccttaagtggccagaacaaagtcacaaccatttttggacttgggaatgggattaatataactaatatttatcatttgctcctacatcacacagggaggcagcacaaatctctgaggaagagaggaaggaatagctattgaatagggaaccagcagtttctgacacattttaagaaaaataaaaaatagatttgtataagtgttttgaggacgattaaatgaactagatggtctagaaaataaggcattgagcattttagacaacgtgcataacttctatacttctattaagggagaagattttccttagagacagttgcatttgttctttttaagagttgctgcaaattgttgcccacctactgagaaatcagtttttttttttttttttttcagaagaacatataccctgttgtcaggaagctatggagtatatggtaaaatggaaatttttattttccaaatgcatatgcagccccctgaaatataaatataagttcatggaatagtatttaaatatttgtaaacaaaacatcccattgtacattgctttttcaattactccaacaatgttcttcctcatttctcaataaaatggaaaggctgacttttcaaagaaataaatcccttttttgcagcctcttcgatatgtttagtgctttttattgagtggaactcttcacaattaactgtggagctgcaacctcattaatttaacaaagaaatatccttacttccataaacataaagcgtaggcagatgtgtagaaaacatttctcaattttattcacccaaacacacaagctttaatgatcctttctacattttcccaggaaatttggtctagttccttttctctgtttcaattaatctgtaacttaggagaaaaaataataatcacaaatgcatttctcagaagtttcaatctcatacctaaacaatgatctcaggatgatatcatatctacttattgatccttctaacaccaacaaattgaaataaaccactgtaaggtacagcactgatattcttagtctctttccagttattttcaaattattacgtttctataaatcaggtttccttaaacatttatacttaccttctgtcttaagaacaagagtaataaacacacaacttttaaaatgcatagcatgtagtgtaaaaataatcacattgaatattttgttagattagcaggcaggtagggatcttatcaattattaagaaggaatttattaatataatgcttgagactagtagatgtccccgttttagagccattacacccttttaaaaccagtataatatcattttattaaactaaaatgaaattcatagataatataacatacaaaattttaaaaatctatgtaatgaactaactacaacataaaagagaaacaaatgtttgcaattctaaactaactttcatttctgtatgtagatgcttagcaagtctctgtgatgtattatggtggagtagttagatgtttactcctacatacagaatcaccccaggtcctgtgttgccaatgccagtggtgcctaatcattgtaaccgccagtgttctccaaaagcttttttttttttttttgagactgagtcttgccctgtcgtcaggctgcagtgcagtggcgtgatgtctgctcactacaacctccgcctcctgggttcaagctattctcctgcctcaggctgtgagtagctgggactacaggcgcatgccaccatgcccagctaatttttgtatttttagtagagacggggtttcaccatgttggccagggtggtctcgatctcttgacctcgtgatccgcccgcctcggccctccaaagtgctggaattacaggcgtgagccaccacgccaggccaaaaacagatatttaaaatgtgctttctgggagaaccactgccttggattgagacgcttttcattttagtgcaaggaattatggaatctgagaatgaataaatagcaaggaagaaaacctttaacttatatttcccaattctttggcctgtgagtttaggtttgctgatctcttttatctaagacacaattctaagtgttattccaaaagtgaaggaagaaatatatgtgaactatactttacgaaagactgtgaaaattatctaaattattacataaatatagggtagatatatctccattaaaatgtttcagaagagtttcaaatacaatgatatatatacattacacaacaaggaaaaacatagctacattatgacttggtatttgtatgatttcacgtaagtaaagtacatttaaatagcattgagggaaatacgccagaatcttcacagtggttaattctagattttaggattatggtaattatgtttctttctacattcccccttcttattgatgatttccaaaatattacaataaatgatttaaacacacacacacacacacacacacgaagaagacattagataaagccagagaattgacaagggttgttgttcatcaattatttactttttattttttaaatcttccctgccacctgttttttcttctcctgaatgcatttactgtgttacttctgtgattattcttccttctcccatcagttaaatttggatattcttcagtgttcttccctcagtttccctcttctttccttttttaaattctttctcactggtattattcacacatgtgtcctctcttctaagctccaaaacaactgtagtctcaagatgaagttactgattcctaggcactaacttgattacgtcctttggtatcaggtggcacttcagacgcattacacctaccattaagctcatcttgtttatacattagcatattccttcttatgatcactccaactctcaggcttaaaatgccagtgatcactgcaaatcttacttcctaattagtgtataatattgattctttcttcatgacaaccttctctaatactggctctagaagtgttctttttttaaagaaaaaaaaagtataacttttatgtgggtatatccagaatttgtatcagaggaactcaagggtggcaattttgtagcaagagggaaagttgtaatttcaaaatatacaacatttttagtggagaaaacattagttgtttatgttaaaattagaggaggtgaatgaattgtggggaagtgagtgtttaaacttccaccccataagtcactcatcttgattcccattcctgcagtgagcaccgcaccaggcccttgaggcctcatcactgtattctgcaaatggccctctctctagggttgagagcccttaatgtagatttctggcatcgcatccctagaatattttatctttattaagagtttatcacattacttaactgacattattccttgttcaaaaaaatgtgtataattgctctattttaccaataaaatggagatcttcagttattatttgagtgcttgaaacccttactgaagtattgcctttatcttctccccaccaactacgtatccacacgtgctacacttgagcataaataaactactgttccccatatatgcttgtgtcatttcctatcatacaatactgtgctctcttgttctatctgtagaacagtctccccaactcaagaacaacctctatggcagtaattctttgaatcttcaaacagtatagcagttggtttgtagtctttgtgacttttgtttctctgtgctctgcactttgattatttaagttcatgtattagaaatcctatttggccctaggcaacttaagggcaggtatctggatgattatttttaatgtttcccagagcataaatcattgccttgaacatactagaggttcactaaaaattccttgagtaaatccacaaataaatacagatgatgatatttgtgttgtccagtgtactgttaaatacttttaactttacatgttatgttttcagactgttgagttgttttttaattaaatttatccctgttttcttaacattttttgttaccttctacttctagatttccctttttctcaactgaatttacctttttcttcaactgtctcagacaatttttctgattttctagtgagctggtaatattgtgctaataatatgatatcagttttaaagtgtgggaaaaaaagtgctctaagttttaggaagcattgcattgaaaagcctcataactttataagatctttcttttttgttttatttctcactgatttgccaaaatattttcaaattttctctcaaacaattaagtatccaaattttgatcacggcagaacttcatgttttctaagatatggtttatctgattaatatatttttcagtaattaatcaaataggattataattgtggcaaagtttaattttcattttcacattatgttggtgaggaaagaagatttgttaagaaagttacatattcactagtaaccaatttttttttttttgaaatggagtctttctctgccacccaggctagagtgctgtggcataatctctgctcactgcaacctctgcctcctgggttgaagccattctcctgcttcagcctccccagtagctgggagtacaggcaggtacccccacgcccagctaatttttgtatttttagtagagacggggttttaccatgttggcccagggtggttctcgaactcctgaccttgtgatctgcctgcctcagcctcccaaagtgctgggattacaggtgtgagccaccgtgcccggcctagtaaccaaattgttttatatatggctattattaaagattaagattaatattactttgcagcttgagatcctgagtttttctaacatttttgaaattttggaattatcataataaaaagaattacttcatactttttggtgccttgtaagagtttttctaacatttttgaaattttggaattatcataataaaaagaattacttcatactttttggtgccttgtaagagtttttctaagagtctccaaagacacattagcttaatcagtgaagtaaaatatcagtagatttaatgataattttgttattttggaataccatttggatagtaagaaaattttataagcttatgtttaatatttatttttaaatatttgaattatttaatgtaaacacaataatgctgaataataacatttcagtcaaggatgggcctcatacatataggaaggtggtcccataaaattctagtggagttgaaaaattcccccctcctagtgacattttagctatcataacactgttgcacaatgtattaccttttctacgtttatgcatatttagatatataaatacttaccattgtgttctaatccctgcagtattcagaacagtaacacactgtaacagatttatagcctaggagcaataggcacacctcctaccaccatgcagtttaaaaccagataatcagtatgttgagcccattgagcactttagtactgcatcctgcattggtatgattatcttatactttgcacatttttattttataataatttgtattcattcattcgtctactttccaacccacttgttccaggtcaggatagtgggtcgctggagcctctcccagcagctcccaaatgcaaagtggaagccagccctgaacagggtgccattccatctcacacacacccacactcaatagactgtgatcttttagacaagccaattgtattaggccattcttgcgttgctgtcaaggaatacctggagctgggtaatttataaagaggtttaattggcttatggttctgcaggctatacaggaagcatggcgccagcatccacctctggtgaggtctcaggaagcttttactcattgcagaaggtgaagtggggggccagtgagagcaggatcaagagagtgagggggacaggtcccagacttgtaaacaatcagatcgtgcgtgagctaactgaaagagaactcacttatcagcatgattcactgggcagggattgatttgttttctcatcaacattataatgaaatggtattgaataaaatgatgtaactccaggacctgctgtactttaaccaagaatataaacatgcatgaactagtgtagttattggtatggaatcaaaggaatatatatgagatctgttttgatggaagcaacaatcaaggtggagtctaatatgaatttgatgttctgatactggtccagctaaataatggggttacagtaattatattaataatttcaaaggctctataaaatgtttaccatatgccagatatagcttcccactcttttacatatataaatgaatataatctttataacagtatcgtggtggtagcattacttttgtccctatttcatagatgaagaaaatggagggttggagaagttcagtaaactgaccattatcacccagtaagtggtaaagcttgattttgagtccactgaatctggctgtgggttttttgttctttccttactgtactagggaaacagaagatcagagagaaatttagtcctgtgaagaattttgaattgaggttatgccaagcacatagatttagaatacattatctctaaatctcacagcaattctcacattgattaactcttatgctcttaaagaacagagaggatacctgagttatctaagcagaaaataaatgggagtcagagctgcaattcaacctcaggtagcacatggttcaaaagtccctgctttccctactttatctggtataaatttaaagagtcataatttttatatggttcttccttgggccatttatttactcataaaataaaaatattggaagttgcttatataccagatacaatgtgaggtactgagatttttgtgataaacagtaattgaggactcttagatgacaaacaagcacagaaacaattgcaatgttgcaggaggaagtggaagggacataatactcatagttcttttacagcatttaccaccgtcatacatttaatccaggtggttgtgcacaatcatctccctagtacttcttgatatccgttaggacccagagtatacctttgtcttttctaataataaatgtggtaccctgtacaaagtaactacttcataaatattagcagaagtgaattcaattcattgcaaactttgtatttcaaaatgtattacagttaggtctgttacccaaggctaaagaataacaagacattttttagttgaaatgagaaagtaaataaattttattttccctaagacacagtcttcttcctgcagattcaatttcacgggcatgcaacctatgtggccacagagtcccatggtcagaagggccaaatgcttagcctaatgctatgctgtcactgtcttgaaattcttaataatttttgcactattatccctaaattttatcttgcactaggctccacaaaatatatgtggctaatgtaaatagcctttttggaggagaggtgctgagaacagatgttaagggaatattaaaccttgggttcaggtacaactatttcacctcttctagcaaccttccacaagaaaaccctcacacacatatacttcacatggaggtcagtgtcttttttctatgttctcctagtgcactcatcactcactttgcatgcaccaaaggttgatgtgttcttatctgtgccctgatagtgctgataatggggtcttttggcaagcaatcattgcaattacagagactggtaaatatgcttatatgattttggaggaatactggtaaggtcgaagtatatgacctgttaagaattttttccttcggccttgagatcaaggccgtgatctttaagaccaagtgaaatcttggcacattccttacctgccagatgaccaaaaaattaaaagtaaaaataaggtataaatcttgagagggaaattctgattttgtcaggaggatgcaccttgtagtaacgattcaccaaaggctaatgaaacgtagaaggtgtgggaaaagcaacagcagcagcagccacagaaacatgagaaaaggttgcctcccaataaagagtggcaaacgcatatgttatgtaagacctgtacattatagcaactcggagcaatctaggcactgagtagccaaatgctgaagactagtgggaaaaaagaaatcactgcatgtcaaggtagaagaggatgagaaattaataggatggagaccttgaatttaaccacatatccttgcaagatgtttactgtcatttttaaatttttgcttaagtaaggaaatcaatgtttatcaattctctactcaattttgctttcagagcttatttatgttatacacaaaagaaatatatgatacagttattagtctcttcattgggcatcagtgaaaataaatcaacacaaaaacacaacttctgtaaaatatttggttgagagaataattagttaataaccgattaaaaaaattgaattggacattagccttaaactgataatattagtgtataaataccagttcacataatattagtaaattcatgagagaacattgaagttatactgtattcaacatagcaggccttttgtgtctaatcttaattccaatgacagcaacataaaactaattgtaatttctatatctagtatacaaatattttataaacaattatatttatagcagaaagcataccagctattatgagccactgtaaaatcttgtaaatagcatttatatagtatttattatgtcttggcaaacactttatacagataatcatatataactataagcactttatatagatcaactattttattctcatttaacgctttaatcctataagataagcacaatcattatactcattgtttagacaaggacatggacgaatagtgttttcacgacttgcctagtgtttcttagcaagtaaatgacagagtcaaaattcagtctcagtcccagacaccagggatccagattttgtgcttttagccactttactgtatatcgttgctgaagaaagtcatttcgcattaaacaagcattaaataagctaccagttagcaacttgtgttaccatgttatcattagaaatacattggtaattttaaagtatctaagtgtatttttaattaaagtttagatagcgagtaaaactctaaacaatacgggacaaatatccataccataaatatttcacatgtaactttactttttatattaaatgagtgttaacatttaaaaattgtcatctgggctagccttgtcatttggcatactctgtttacttgcaaggtagtctttataggtgcaggtctatgataattattaaatatcagtttttcaatggttttcctagccatttattcagggaacagatagacatttactatggtgaatctggaacgtacctaaggtaatataccactttttagaaaaattctgtttctctttttggagtctaataccttggggtataataagtgcttaataaatacttttaaccatgatgattgtttttaatagataaatgtaaaagttcataagaacccacttcctcaaatattttgttcattcatatgtcactaattctgaatattatgtaaaaagagacaacggggatattcattgacatcaagaaccacttatgttttttaatgcgaatttttttcttttaaatgggatgtcttattacaaagtaagtagatcagcagccccttgaagttattatgggcctgttgtggcttataaaacagaaaggcagtaaaaggcacagaagcagaaattggggatgcaaaagatttactaaattttacagttttctcagcattaactctgttcatagctgtaagtgacataataacttattgattattaatcaatttcagccagtgaaatacattgtgaagttttaaaattatttgcttatcagatcatgtgataaagacagctaaatacaataacagaacaaaatccacaaatcccttatacctgtgcaagttgttgtgaaatgtttctgtattaaggatcttagttataagggaaaagaaaaagttatagcctgaaaaaaaaagaaatgtgtcaaaggacaaagtacttcatactgtcaggaaggtaatttctgatgtattgtgctcaccagaaaaaaaaaaaaaaaaaacggccgggcgcggtggctcacgcctgtaatcccagcactttgggagaccgaggcgggcggatcacgaggtcaggagatggagaccatcctggctaacacggtgaaaccccgtctctactaaaaatacaaaaaattagcccgtcgcggtggcaggcgcctgtggtcccagctattcaggaggctgaggcaggagaatggcgtgaaccccggaggcggagcttgcagtgagccgagatcgtgccactgcactccagcctgggcgacagagcgagactccgtctcaaaaaaaaaaaaaaaaaaaaaaagccttatgtctatgaaagattcctgactttgcaggaaatgcaggaaatgaaatcgagacctaaatcaaacacagtgataaagatgtgccatttgtgtatatctgcctttctaaactgaagaatttatagactgaacaaacaattcctaccacttgcggtcctgttactataactttggtcattttcccctttgctctaggattagcaattacattgaaattcctacatgaaaaactggaacaactgcacaccttgaatccaggtagacctggatttgattactggggctaatcaggaaaacagaacaaatgtgaaatagtttggtggtctctggtgctagttttgctttggaaccaaatgataaagttgttgaaaggtctgtaaggcacaaggaaccaagacgaacccagaaattcacagagtagaaagctgttacctcccttaagactggcaagtcagagagttgaggagtgttacagagctccagagtagagaccaccacttgggaggagctggaatcatagtgaggctgctttgtgagagctgagcccaccaagggagaggttgtctatcaggagctgaaatcacagaagaggcacttcatctgcggggatgctgcttagagcagaggaagggaacttactttggcttctttttgtcaccctccagtttcctgctaggtgtctcattagctaaaggctggttggcaacagaacttgagcaacctagtttttatgtgttggccatttatgatatagaatagagcagaggaatgacaaacaatggatacgaggagaaaaagccaaagcaaaatggagaaaaacaaaactaactcaatgatcttggtcaaatagtttacatacctaaatctccatttcattttcttcaagattggaggaatgctatccaaattacagcatttttattaagattaaatgaaatcagattaataaagtatgatatccctggaatatattaagtggtgtattaataatgatttttcttccccaattttgcaaacaggagccaatacatgagaaagaaagaaaatgtgttttttgttgtttagtttattgttttactaatagttccttagtgcagacctatcataattgtatgacttcttcagtattttaggtgcaatttttaaaagtagtatcaatataacctttctaacaatttatcttagaaaagttaatcggtagtccaatccatctcagattacaatccatagctaatataagtatacctcatttattgtattttgctttattgtgcaaagatatacagagtacttgggtattctgtgtatctcctaaatatctgagcttatatatgacaacagtagttacatcatttttatggaacaaagacttacttagtttatcacacttaagagtacatgttacattatttttgcattaaaaattgtcaaaatgttgatcaattgcacttataaaaaactacctaaaaactggccaatttgaaagaatgtatgtaaaagaaagctcaatgaataaaaatgtacaatatttgaaaaattggaatcaattttaatatccattaacttagaaaccaactaaatatgatttaagtatagaatactatgaagtcattaaaattatgatacttatgtacatctacaaatggtaaaagttgtgtatgttatattactgaataaagtaagcatattacaaaacatcatggagccatttttgttatagatgtgtgtttgtattcaggtgcagaaaatatatacaaaaatctaatgataattgtagctatatctgggtggtgttattatggtttatgtttgttgtaccctttctgtgtttcagtactttctggtactttataataatttttttgagattgttacattaactgtttaagaaactaaatgccaaaaatggcaacttttactttaagaaatgggttctccaattttcattgcttatttattttattatttcttgaattttaagataaattatttgtatagaatttctattctaggacatgtagtacatagctgttagttgaatgagagagcacatataggagggaccctagaaattttattaattgacttgtgacttatagatgactagaaacaactttcctctaatttaaacttaccaagttacacatacaggagtgaaaagcagggttagttctcttaaagcatagttattgtttaatttagttgtaatagatattaattaaatacagaaattatttttaaactttaacaagggcatttctctatgatctctgttgccagacactaggaagtaatctctgaaggataggaagcaaagcataaatcaaataagatagtctctgttgtacgctggacaacacaacagaagattgaaaatgtgttgctattgtttttctgtttttttttttatttcttattttgttttttggttgttaatatatggctattcagttaatatatgactaactgttgttttcttttgacattaaatgtgacccatgttgggaaggctaaaaaccagctaaatttacaatgcagagggtaagaaaagttaaccagagtccacaaagttgatgaatgtaggagcagaaaggcaatgtcaaatgaatgcttttgtgaaattagcagtgacaaacttagggacagtttgtaataaccacccctgagtttatagccctttacatttcgtctggcataatatatcattctatttttattttaaatcaccaaatgaggcgagttagggaaatgcaggtcagggcaagtacagttatctttatgaggaaccccaggctcagagaatttaataacttgtctaaatctctgactttcaaattagtgccctttcccctgtgcctcatggccatactcgatcacttcaaataagtacttaaaactctgtgaggcatttggaaataacatattgatatataacatataagataatataatatagtagaaatatttctgaacattaatgatttctacccaattagatactgttagtacacctatttatctttaaagaattggcttcaaatcccttatcactaccaccattaagactgggtcttttgtcactatctatcaaatatcctatgggcataagtaatttttgttcattaatatctatcattctcacaaaagtaaccataataattataaaatgctgttttcaatataatgcattattgattaatctcattaatatgtcattattgttagtagtactacccatgtataatttaaattaatgtgtgtctaaaacattgattcagtctgagggaacttggatttctgattataagcaattatgaaaccttaacacccagagttaagcctgttgaaatatatttagaaatacttaaactctgaaataaatgtaatagccccttgtggcataagagaagcagtttctgaccatctgaccatttttaggtagaaacaaaatctcagtgattaaagtgctgctctattgagaaggatggaaacgtctcgtaatatcttaaaagataagacagcgctaacatgtggcatacagaagacagccatgtcaggaaaaaagaaaaatttacacaagaggaagaacaatagtgacagtgttattaatggccacggaaggagtagctgtttgtgtcaaataggcataccctgaatagtaaggaagaaagtccggggtaggtggtaaattacaagtattttttaccaaccccgtctcctgtggatactaaagagccccccagtattagcacttaaagttgtgtgtgatcaagagatacagcagtcattagtgtgagaaaggagattaatggtaagtaaaagtatattgttcttaatataattcatttattcatggtaagtaaaagtaccttttccacctttcattccatataggccccacaaccatgcatattattattattattaggtttctatctttttttaaaattatactttaacttctgggatacatgtgcagaacatgcaggtttgttacataggtatacacgtgccatggtggcttgctgtacccatcaacttgtcatcgacattaggtatttcttctaatccatgcatattattaaactaaatatactgtatactaatttaagaggtcacacctaaaaaatattatcagatatgattgatgcaaaacaaataaaagccttacctttctgatgtatgtatgatttggaaatgttctacctaatgcatagttgtcatgtaggatcatccactattacctctactcctcccccaagaaatgtatttcaattttactattcttgcccctgtaaattagagattatgtactctgttattgaaaatacaaaatggtgagagtgatagatgtatccaataggctgtaatataatgagagtacaaatcattataaatatatacttatatggaagttacttcttttacctggggcatgtatgaaatactagcatttacggtagctcttgagtgatgagtggaatgccagctaagaaagagtaagggcagaaaatcaccactaagataaacgtaggagaagagacataaaagtacattaatatcaggcttgttgagtagagtgagggaaactaagagatgtaggtgcctgtgtatagtggtagaagcttatatgcatatttggattgtataagcatggaaagagagggtgaattaacaaatgaaattgggactgtagtttggataaagatttagcaggcaagctgagtattttggacattattttgtgagcagtcaggagccacgaactttatgttcagggcaatgacaagaacaagataacttacattgagagacatgatgtgatttttcaaaaaattaagtattcatagtccttcaatatataaattggttttatttctttttcatctattctgtttaagtgcattggttttaaatatgatataatgtgatattcattcaattttattcaaacagcatcaatatttaaattgtctgtaatttacatgaatggttcaacatagatgttttagttgaattaatatcttgcaataacttcagtggaaatgcttttgttcctttgaaaaatatctactagttaagtaaatgtatccaactgtgaaaataatgtgataaaaatatcttaatatacattaaagttcattggttttgaaaaataattggttttagatacaaagctattaaaattagtaaaaatgcctaatttaggataaaatttgttcatttctgtgcaattacttttggctatgatagaaagtatttgtgatgaaaacaatattatgactttggtgacagtaagtagtacttctgtttcaggaaaaataaaatagatgagattcataaatttaatggaccagtaatttaaaataagcatccaagatgagaagaacagtcgcctaattgtttccttttaactagaaacatgcagaatataatattgccacagagttgtctatgattgcatagatttcaaagtgttttcataggttttattttatttgatccccagggtaattctttaagataggaaaaacaagtggtaaaatatgttaatattttaatgacttttccaaggtttcaagtctgacagtaggacccagttgtgtttttattttattttttatatcttctttactgggagtaggctattattagactttcttttgcacaaaagcattccaattttttttcagtcaaggcattcaaaaactagtctactaaatacgtatgaagggtgtatctgatttttctcgctgtcatactgcttgcatttggatgcattaagacttaagtttattatatgacaggctttagtttccttgctgatatactttgcagataatgatttcaagactcttgcaaaagcattgtagttctcaatttataaatttaattaggaggaatgtcctgttataagaatttaaaatcacaatcatatctgttgtgtatgtgtatacagtgctacactttattagctatcactatgttctgtgcatatttgcaagtaatgtgtctgtgttaaaaaacattattcaatctacactgagttcacttttcttataatccaaataattggagttagataaatatcataaagaaaaccactggtgtatccttttatccaaatgtcaccttgtgtcttttaatccaatgtcccttgcacatacagtccaacaatttttttagtgttagggaggcatacaaatatgtcaaagtcatcaaccattagacaatatgagtacaaactgagatggggttggagattatatacgttccactggaaaagagaagaacaagcaaagcaaaaatatgatgtattaccactaattcaaaacctgaaaattttctctagggcagaatatatttcacttacctatacattattacaatgatttaattttgaccaagaccataaggatttttttctgtgatatttacataattttgaaatcaaatccataatagcataccatacataatacaattttgtaacatccgtgcatttacagagataataaatttcttcatattttgagttataaaaattactttaactatattactatattctaggtgaattaatattagaatgcttcaccaaaacctttatatctatttttgaaaacttaagccattattgatacaattaatttgagaaaatttattttcaagaaccatatttgctttattttggtaatagaaagcaccttagttttaaatgctaatgtctttcctacataggtaaaacaatttatactttaagttaggtgatgtctttctcttaggattgaaacctgtataaattgaaggtaaaaggccagtttacatagtaagaaaagtggtgagataaggaagtaaataagattttaaaaatcaatataacattaaactaaaaacaattaggtgggaattatactccttatataatttctgagcgaaaaaaaactaaattttaagcctcaataaatttgctgtatctaggttctgttagaaaatgtggaattctatatatctcatttgccctgtagttaactgagagggggaatagaggtttccttctctaaataaataattaagcagcatttaccaaatcagagacaacacatttctcattcatggcttcaataatctcaaagagttggactttttggtcataaaaagatatttgttgacttacttactgatgaatgtttaggtctgtaaactggattgaaacagatgaatttccatcaggcatatggtattattcctgaagaagcaggtattaaccttgagaagcgacatagttgacaaagtaggccatgcaagacagtgtaatcagagcagtacaggttggaagtctgctttttatttcctcgaggtacccagactaattttccacttacatagaccacaacactagtggctgaaaaagcagaagactttatgataaggtcacctacaccacaggggacaactgcatgaaaagagaaaaatcagctctctgctacgaggttttcatcgtctgacttttggcaaataaaaactgctagtaactgctgtttgtctctgagggaagaaaacgatagtcttcgattgtttaatataaaatattaattatctgattcctgaattcttcttaaagacaataatgagtcactttcctttaatctcttatgtacatttttctttcaattactttagtctatactcgtattcatagcatgcttaagtttcccataaatcttaatagaaagtatttttcagagactaaaaggtttccacaagagatactaatggtttcacactagtcaccaacttgattttttctgcttctcagctgtctttagtttcacagtccagagaccatctgtctagacaggtgttatcgcactggtatctaaaagtagaaactgaacatcattatttttgaaatctatttagaaactgcaactctagtgataaagcagtactggtctaagttgtgcactgttacaaatcacttccttagaacagatggactacaaaatggcttattttgcatgggccagctgtgaacttaagtagagaataggaattgtggatgtcaattacattgcacagaaattttcagtcaagaaatttaccagataaatcaaaaggagtttgttatgagtaggcatttatctcatggatttattttttaaataatgtccactgttaatacagggaaagacaaatatgaattaatcttaaagatattagtataaaagtaaattctgctaaaaaatacttcaaggcatataaatgtatgggccttgactatactccacaaattttagcttgaaaggcaccattctcttcattccaaatttaaaatacctgggtattgatatctgagtcttttctactgtgtaatattggagaacttaccgttatgaacaaatttatagataatgttgcaaaagaatagttaattccattacatagtcacactgtgtcaccccaggaacgtctttacagcataaaaatataatgtgtatacacacacacacacacacacacacacacacagcataggcacttagcacagtgctgcacacatattatacaatctggtattgtgttcattgcccagactcccacttcctagttaagttgccttgagacccttacttgaaattgtggtgtcccagtatttgctgtttttctatgtaaaatagggataataagcctttcctaaatcataaggttgctgtgatgataaatgacacaatacgtataaatcacttcgaaaaaactgacatttaataagaaggcaataaacattagctgttatcattgctgctattatttctgtattcaaagtgggttggcatgttatgttacaaatcacctgaactcaaagtaccttttcctgaaagaaaaatagatatcaaatttggacagatttggttgaaatcatattctattatttcatagttaatgttggtgtcttggtacattaaatcgtaatttaaaacatactttttatggcaaagtatggatctgagttaaaatcattaaacatttgggaaaaaaattttataaagtaatgacccaaaaaacaatcaacgcttctttaggacctgcaaacaatatttttaaagagagaggaaaccacttatctttctaaataaatattttttctacatgtggtttaaaatattttttctctctctctctttctttctctttctctttctttgccagccctgctcccaaggaaaacaatagataagaaataatataaagcaaattccagagaggtagggggaacctaaggtaaagaatcaaatcatgtaagaacaatattcttcaacttcttgatctaacataaaacttaaataaatgttagcttattttgaccttggtgtttatgcatactataaatcctaaatatattgttttttggctttcatttgttttttactctatattaaatattgtaattttcaattagaaatgatatcatagcataattgaatgtattttaggatgacattattacttgtaattagtaatctattaagctttaacaaggtcttaggggctgaagcaaataaaggagaaaataaaatcaactttttgggatccaatataatttagatgagcaggaaatataaaatatgttgaacaaaggctatttctccataatacgtttttaaactactataaaaatatattcaaataaaatttaaaccaaagtgtacaataaaatattacctacttataaatgttgcacaaataaaaatataaatagcatactaaagaaaattaaataaaatgcacttggagatatagaaacatagaactatctctgatgaaaattgagtcattctaaaatgtgctgaaatatatttcttacatgacttttgtaaaagcaataagaattaatatgattgtattagtccattttcacactgctgataaaggcagacctgagcctgggtaatttataaagaaaaagaggtttaatggactcacagctccacatggctggggaggactcacaatgatagtggaaggcgaaaggcacatgttacatggtggcaggcaagagagagaaggagaaccaagtgaaaggagtttccccttataaaactatcagatcttgtgagacttattcactaccatgagaacagtattggggaaaccacccccatgattcagttatctctcaccagtttcctgccacaacacatggaaattatgggaaccacagttcaagatgagatttgggtgggaacacatgataaaccatatcattctgtccctggcctctcccaaatctcatgtcctcatatttcaaaaccaatcttgcattcccaacagtcccccaaagtcgtaactcatttcagcattaactcaaaagtctacagtccaaagtctcatctgaggcaaggcaagtcccttccacctatgagcctgtaaaatcaaaagcaagttagttacttcctagaaacaatgggtacagacattgggtaaatacagctgtcccaaatgagagaaattaaccaaaacaaaggggctacaggccctatgccagtttaaaatccagtggggcagtcaaatctatgaactacaaaatgatctcctctgactccgtgtcttatatccaggtcacactcatggaagagatgggctcccatgaccttgggcagcaccacttctgtggctttgcaggatagagcctgcctcccaacccctttcacaaatcggcattgtctgtgacttttccaggcacatggtgtgaggtgttggtggatctacctttctgggtgctggaggacggtggcccttttctcacagctccatgaggcagtgccccagtagggactctgtgtgggggcatcaatcccacatttgccttctgcacttccccagcagaggttctccatgagggcctcacccctgcctctaacttctgccaggacatccaggcatttctatacatcctctgaaatctaggaggttcccaaacctcaattcttgattttgtgtgcctacagtctcaataccatgtggaagctgccaaggcttggggcttgcaccctctgaagacacaatctgagctgtatcttggcccctttttgccatggctagagtggctgggacacaaggcaccaagtacctagactgcagacagcagggggttctgggcctggaccacaaaaccatatttttttctcataggcctcttggtcagtgatgggaggggctgctgcaaaggtctctgacatgccctggagacattttccccattgtcttggcaattaacatttggcacctcattacttatgcaaatttctgcagccagcttgaatttctcttataaaatgggtttttcttttttaccacatcatcaggctacaaatttttcaaacttgctgtgtttcccttttaaaactgaatgttattaacagcacctaagtaacctcctgaatgctttgctgcttagaaatttcttctgccagataccctaaataatctccctcaggctcaaagttccacagatctctagggcaggggcaaaatgccaccaatctccttgctaaaacatagcaagagtcaccgttactccagttcccaacaagttcctcatttctgtttgagacgaactcagcctggatttcattgtctatatcgttatcagcattttggtcaaagccattcaacaagtctctgggaagttacaaattttatcacatttttctgtcttctgtgccctccaaactgttccaacctctgcctgttacccagttccaaagttgcttctacattttcaggtatcttttgagcagcaccccactctactggtaccaatttactgtattagtccattttcacggtgctaatgatgacagactgaagactgggtaatttatgaagaaaaagaggtttaatggactcacaattccacatagatagggaggcctcacagtcatggcagaaggcaaaaggcaaaaggcatatctcacatgccagcaggcaagagagaggagaaccaagcgaaaggggtttctccttataaaaccatcagatctcgtaaggcttattcactaccatgagaccagtatggggaaaaccaccccagtggtttatctcccattatctcccacaggttatctcccacaatacatgggaattatgggagctgcaattcaagatgagatttgggtggggacacagccaaaccatatcaatgctgtgtttctgtgtcattgcttgaataaaactttttgattatgttttctttgtataatgtatgtatacactagcacagcaccaaggtggtagtgggcattcaataaatatccattctcttctcacccctatgccatgctgttgcctttcctttacatctttttcttcaggtcaaatatctttattattttcatcctttaaaatgtttctttgcatcatcatcttatttattctcccatgtggaccttaacaattttttatttcaatttagaatgagatttatagcatggattcatataaattgaaggaaattttcacaaatatgaatatcccagtgtagtgagttgaattgtgcccttcaaaggatttgtccaaatcttaaccctggaacttgtgattgtgaccctatttggaaaaaagggtctttgcatgtttaagtaagtgaaatatcttcatatcagatctttcttgtttaaccaggtgaaccataaatctaatgataggtgtccttcaaaaaaaaaaaaaagatgtagatagagaaagagacacataggggacaaggtcatgtaaagatggaggcagagatctgtaaaatgtatacctaagccaaaaaatgcatgaagccaccagaaggtggaagagtcaaggaaaattctcctctatcatcttcaaaacactgtggcttggctgaatccttcattttggtcttctggcccctagagctatgagaaaatacagttcttttgctttaaacctccaattttgtggaattcttttatggcagacctaggaagctgatatatgtagtttgatcagtaaatgcatagaaacaaacattcataatgaacatcatagcaaatgttaagagaagaaacatggaggtagacgtgggattaaatgtattttaaacgtcatctgacataatggttgaaagtagttgaatcagataaattaatgagtattaaagacttttgtagttcatgaagagctcactcaccctggatgtctcaactgtagcactgttgacatgttggactggataactattggaggctgtcctgtgcatttttggatgtttagcagtattcccgtcatctaccaagtagaaggcagtagcatcctgagttatgacgaccaaagcgggtgtagcattggggcaaggaaagatgttggtcaaagagtacaaagttccagttagatagaaggaatacattttagagatgtattgcacagtatgatggccgtagttaataatttattgtatatttcaaaactgattttacatgttctcactacaaaaaaaataagtagttaagtgatggatgtgttaattcacctgatttaatctacctacaatgtgtgtgtatatatatatatacacacacacacgtgtatatatatatatcaaaacatcagattgccttccataaaaatatacaattgttatttgtcaattataatttgtaaaaatgcaagaaagaaaaaaatatttttagaagatcaggactggggtgaggtgaatgaggcatttgccatgggcacaaatttaaagaaggtacccaaaagctgattgatcaggaacaatattttaatgcaatattttttaaaaattaaaaattatactaaaattaatgattaacaaaatagcaacttttaaaataaagacaagattagtaccattactaaatgttccctgttggtgaggaagtggtaaaattgccctctgttaatcaatgcaccgatgtaatataagtgatattgctgctgtgaaatcacttgatctgctctattctcattagtctcctcatcactaaaagaagtttagcattcttgtgatgaaggcaaccagatctcagtttgaattgtgactctgcacctacttgctatgtatccttagacgtgagtgtagttgtcagcaaattagattaataagtacacttatgtcgtgggatttgtgtagataactgagataattctagtaaggtaggtaacacagtgcttaaaaagtaatcacgctatagtaaccaaaagcataaaaaaattacagatgacataagggaactatcttctgtagtaatcaaggctttatttaaaattttaaatctacttgtgcaaagaatatgttatgtcctggacatgataagtgagctaaactgtactaactaccataaatgttgttaatattactgtgttttatgttaccttaataaatatcacagaatcttgaattcatagccagtcctacagcatcatattcctacaacatacttagcatctagtcatgcagcaactcttaagagatcttttaacagagcttgtgagttcttttattttttaaccccactttctaaatttcaaacatgacaaagacaagagcatcattttgctgtcgttttctgataaaatgtctgcaatatatgggcagtcaagagcccacttccaggataatagaagtagtaggaaaacctaaaccttagattgagtctggggtaatgcgattcagaagctgctttgaacaaaattagaaagaaaacagaattaataaggaaaccctagcatcccatgagacaagacagtaatctgaggatacactcagaatttcaagttaacttggagtgtgctaatattttctaggtttgtctatagacctgtagagaaaaataaaataatttctatttaaggacttagaacaattttcattttcagttagaaatgacaatgttattcccttataatcacacatgaaaaatctaagttaaacaacgtaaggggagtatctgcaaacttcatggtctaagaaaatctgtgttaattattttttaaaaatagtctgaaagaggaaaacatttgtcatctgagtgagatttgaaagagacatagtttaaagttttaatagaaaacacgaaggatttgcccaaagtctaagattttactcatgatgtcacacttaaaattgatcaaaaagtaaatacccatacaacaaatgggaaatatgcagaaaaatattttgtataataataggtatagagaaaataaagtgcagataacaaaatttcattagtgtaatatactcaaacatatgcttaagtacttatagagtaagagaacatgttaatggtttggccattgggaactgtgtgcagtattataaaaattatgaatatgtgaacaaattttgttacagactacattaattaatatattacatatgtacaattttggagaatattaaatggaatgtagttcctataattattttcttaagagtgatattcagatactacagtaatacatttggttgtcatttatatcaaatattaaatatttgctttatgatatagacctatacacagacatatatgtgtatatgtcacattcttatctggatgaattaacatatcttaaacagttagattaagcctgtaattttcttatctttaagtcatttcactgtaatgtcttatattgttgaaagcaactaatatcagtattactagagaaatgggttattttgcactttttcttcataacttaaagaacacagtagcactgagattgtaacatgatcgttcctctaaagagcactccacagatgtccgctaaaaggtattattaggtgtataaaattgtttaataaggaaagaaaaccacaatatcatatacatcttttgtaacattaacagtacaagactaatcctacgagaccaaaagtcactgagatgaaatataaaccaaaaattcataaaactcaactgaagaacaaaaatgtcacctttgaaggtacctatccaaaatgctatctgttatcaaacaagtgatagctgtaaatgttctcatttttattaccctgcccttcttataactcataaaactatatagatttttcattatatgtgctaggaaaactggaaaatgatgcccctagcatattgaagaataatagaagagaaatatgttacaaccttgtttaacagaactgacattggcacagaaaaatagtggaacatacatacatacatacgtaagtggccgtctatgaaagtatatctataacatgaacaaatttatgcaaaattaagattaaaatcatttgttggtttttttaaaatagatttttaaaacattttactttttcactgaaaaatgtatggagtatctctatgttcttggtactgccttttaagattttacattacatattttagtttagtctttatgtagttaataaataattatgcttagttatttctctatagctattaggctctaagaaacttaattcttgagtcatcataggatatattatattaactaacaaacattaatatttgcaatgagcttaaagtttacattgcagaaaaaaaaatctgggacaaaatggatcttaaactagtgtcggctgggcgcagtggctcacacctgtaatctcagcactctgggaggctgaggcgggcagatcatgaggtcaggagattgagaccatcctagctaacatggtgaaaccccgtctctactaaaaatacaaaaaattagccgggcatggtggcacgcacctgtagctccagctactcgggaggctgaggcaggagaatcacttgaatttgggaggcagaggttgcagtgagccaagatcgcaccactgcactccagcctgggcaacagagcgagactcagtctcaaaaaagtaaaaaaaaaaaaaaaaaaaaaaggaaactagtgtcatgatttttatttggagaggaaggaatgtggttatatttagcagaactggactatgaatcgtttgatgtgtgtattcctttttagtaagcttaattgtcttataatttaaaaatataaggtaattcctcagttgtgatggttgattgtagattacttggaagggaggatagctgcaaaggagattacagtggattagaatttgtatataacaaaggctttttgtaaaagtttgcccttcaccaaaaagcaaactacttctaaagacactttaatgctaaagacaaattttgaaattataagttgattttgatctaatttagatcctagaaagctgcccctaagataaaatatgatgcctacacaacaatgtgctggctcctctccttggttattttattagacacagccataggaacgttgacaataggtgtggattcaggcatttaggagaaaagataagtcttcttaaggttaggtctttatttctgtaacataagagagagttattgggggcgttactggaagtgtagtaaatcccatttttatatttttttaactatacactccacgacatggtttagttttataaacatcatagaatttctaattgtataagcataatatctaaaatgcccaaatacaaaattttacatagtatccaaataccaatattctatctttcatggatttataaaagtggcttgacttaagtaaagctttctgttgaagtcttgatttctctctttaattttttaacattgacaacttttatatagaaaaggaaaaaatcagaaatatagattttgtgttgaattaatgggaaatggaagttgtgataagaaaattcactaattaaatatctgtattactctttaggctttctcagcacttaaaaatggttatacatatgttttgatagcagcacaatgatccccaagattatatcaactaagtaaatacttaattagtatttaacttggaatatttattaagcatatatatacaaaaaaggctcatatgtaagtaaatgtagatacacatatacacatagtatatgtacatatgtatatgtatatacacatatacacatagtgtatgtacatatctatatgtatatacacatatacacatagtatatgtacatgtctatatgtatatatacatatttatcttttagtatgttttctcatatatgactatctgatgttgttacatgtgtatatatctagtcatatatatattaatccaatataatatattttatactcctagagacaaagaaatacattttttcaatcaataatgtaatttttggtagtttggtatattctaaacaaaaattgttgatttttaaaaattatatgtgtagaactcctcgcagtttatacactatgcccatgtacattttttcatatggtgcttacagtatatttgttagatagatatttttatacttttttttgcacaaaaggaaactaggaatgaagatacgtaagggactttccaaggtcacacacccacacagattcaaaagttgcaactgcctctttaaaccagataagccattatactcttgtatcccattccatcactcttgttttttaaaataagcaaagtgtgtctgaagaaaaccaagtgattacagacagttgtagatcacgttagaagcagaggtaatagaaccatcggcatttgaattatcagtttacttccaagccgctgctggatattgcttccctaggcacaatggcttccagtaaaacatagtctgcattgcttatatgtaaaagatataaaagtgaccataaacaattcctttttcttttcagtcatagcaaaacctctatattaatgtgaacatatagattaatgaaaaaaatgaacattagattcaacttataaatgaacatttcattctgtttttcctagaatctttactaagctcatctatcaagtttactctaaataatgtttatcatgataagtgctgaatttttactggtgaacaaaataatcagacccctgtcatctcagaattcatagactaatgaagaacatgagaaggtaaagaaatattcgaatagatgagaaagcatatctcttgagaaagaagggaacctcgctcggagtgcacagagcttgccatgacttcctcaaagagtagcattttagttgaagactaaagaatgcattatccacaccagatgaatggggttgtcaaggagaaagaaggaatactcaaatataaagacagagagaaaagcatatgtgaaggaaagaaagtgcatgataattctgcagaattaaaaactgtgccaagtgtttggattatggactggggagtggtgaaaagaagtaatcagcagttgtgtcagattgctgatttagtatggaatatctcgctttttcaaagcatattatatgacgtatgaatgtcctttaaaagcatgctatatgaacattaagtaatggtttgcattgtaagtattgtaagcaatgttggccttgggatgctaatagctgtgaggacaccacataccaccagcaaaggtggtacttctactattactgaatcacactatttcaaacatcatctgtaatttaggatttgagattatttttcagcagcacatgttcacacgggaaaatatcccctttggtttttcattcactcgtcagcagataattactctagaagcttttataaaagataagttggtgtttctcattactgaagaagttacattattgggaagaagttctgatcaccataaatgttaatatctctatgttccacatcttattttaaaaatgtttaaaagtattttagaaatggaaattaggaataacagaatgatatgatgtgaaacagagtacccagaagaactgtgatagaaatagatccatcattatagcatgaccaatatataaaactttgtttttattttttcttaagccactgagattatagtttgtcattgcaacataatttagcccattctggcaaatgtggatgttttcattgttttattcattaggaaacagttctcatttgtttagatttttcatagatagtatgaatgaaatttaaaattgtgtctacccatgactagatacatatttttagggcccaattcaacatgagaatttaagatgctattaaaatattatcaataatttcaatatggtgaaagcagaatattaaaacaagcgtgggatctaagcaggtgactctgtacaactgcacatgttgcacgcccatcagttccatcttgtgtctatgagatgtcagctctttgtctataagtggtgtgtgtttgtgtgtgtgtgtaggtgtgtgtgtttgtgtatatccttgggagtaataggagtgtaggagttggttggccaaaaaacttagaaaaggtacaaattctgtcctgattttacttcttttttacaagaaaagaaggacatttgaaggatgtttccccacttctccacaacctaaggtgatacatgttgaactttctttgaggtgctaatggaatttaggaattaaggaatacagaaaattacggagtcagtggggtatacaaaagtgaccttatactgaaaattcagtaattcagtcaagatcttcttattagaaatctattttacaaattgaatcttgggatatatttaaacatcagattataattatatatatatttaataaaatgtttgcactggagtttataaaattcacatggaaataaaatttatacagtttgggataaaataggaaaagtgtactagcctgctgatctcttaaatactgcgaacctatttaatacatctttaaaaaatgtgtgaattctatatttgtcctaattaataagacttttactcctgttgctgacagcacttgaattagcatgaccctagtcctctactagacaatcatgttcaaaaaagattaccagcaaaaatattcacctatgcagttcactaagcatattattttgcatgctacttgtattttctacatgaaaattgcataactcaacttctcccacaaataagtcatcaaaattattttaataaaatagattagtacagtacctgataattacattcaagaaagtatcaaatattttaataaaaactatattcatcaaagcctacaacaaatgttgaacaaagtagaaaagacatatgttacaccgaagatttcaataccacactgaattttattgtttatttgggtcattgcagtttataaattaacttatttcgataaaaatgtaataaacgtctattatacacacagggtctccaatagaaacttcataaattttaatggaaaaataaataagggattcttaatctcaagaaggttatgtcataatctgaaatacgctttttcctaggaaatcagcttatttgccataaatagaaaaggcaggacattaatcttataaatgattactctaattgaaagtataaaaacaaagatttattaaaacaaaaataattttaatacgagttttctattacagaatgaattaacaaggctagattgtgaatgcacacgtttcttttgttggcaccattattgactaaggtatttatagagataatgcatttgccactcgcctgaaagccttaaaatccatgaatgatattaagttttgaaggagatagttaaccaaattacatttaagtgcccttcagggatctaaacctagagttaatttcaatattgtaaaagcaatattgaagctacagcactgaatgctggcttattctatttttacactaagtaaaaaataaaagtaacttactaatgtttagcagatggtaatcactgaaattttgtctaacattgatttacatgtcaggtatgagaaacatcttctgactatgcattctttttactatccccctttttttaaaaaaaattatctccctttttaatttgaataggattgtactaaacgttacagtgaggtgagatttacaaatggcattatttcttcttttgtaaatgccaaagttcatgtcaaatctaaactttgcctcaatagtcatacgaaaggcaaccgtattaatggatagtttcccattcaggcaaaaacatgaattaactaaaatataatctacggtacttttaaaaatacatacacacaggatatagaagcatcatgccatcaaaattgtatctttttcagagtaacagttacaccttcaatgtgctcatactggtgatctgttacattatattccctctttgatgatggatacaggagttaacatctccacgcacttatcaccccttaatttatctaaattcttctcaaacctattttctatattataacttccattatttatatgagttgtcttgaaagcaggacctaagttaacatcttgagtgtgggaagtttattttacaggtaatgatggaacgcagtagtgaggaaagggggagaataaggcagaaaaaaaggaaaaggaataaagtactgtatgtgactaacttggttactactgttggcaactaagactcaatcctgataggaaccttctgaggaattatataaaatgcacctcagaattgcctatttgaaatctgtcagctgaagcatttctccattaactccggataccttggttggaggctgttatcagggatgtttacttacctgtaattccagtcatatttatgtccttgaaatgaaattttgccagtgaagttgagaattttctaccataactctagctgaaaccatgagtgagtcaaaggtatgtagcatggcacacaaatagcctctgctacaccatttctttgggggaaagaaaaaacccttaaaataaattcctaacttattacataaagagataaagaggtatttccctgtgtttctctaaaactaagtatcctcttgtaacactcacctaagaatactaagttttagtttttactttaattatatcctgagactcctaatgaatcccacagcacttggtgcatccctctcataagttacgcttatctattagtataatcattcatgtatttttaatgtttatgttagatttcatagtccttgtcagtagtgatttattttacttattgtttatctgtacaagggatgatactaattgaccttttgcactattactgaattgaattacatagagtatcttcatgatacctctatgaattttgatcaaatccatttcagcctttgtctttctagctctgcagtactgatttattttaatattactgtatgtggaagtgctctgctaaaattggatttactggcctttcaaaagtccctttatatcattcgagagatgtagtgtcataatagtggagaaactctcgtagtaagaaattgttaaatcatgaacctgacaaccttttggaaatgctcagaggtcttcttcttctccttttccttccttctctttctccttctcctcctcctcccccatcccatcccccttcttctttccttcctccttctccttttcttcttcttccttcttttttctttccttccttcctttttactctttcttccttctttattcctcattcttaaaaccatgttatagaagtatcatttttattcctaaaacatttaatgaaaaaaatactcgaattaaaggcatatccattaattatcttcttttttaaaaagtaaaataggcttgcatatagtagtaatcaatacatagccattcttgcttgatcggtaattagaactcaagtttgttcctcgtaaacattcatctgtcaagcatcttctgtgtgtatatatgtgcaagaccctatatgagaggttgtcataagtagcaatacagcttagtgagtatcaaacaatccgtgttatagactaaacatttgtatctccctgaaacgtatatgttaagtcttaatgcctagtgtgatgctattcggaggtgagaccattggaaggtgattggaccataaacgcaaaactcttacgaaggggattagtgcccttatagaagaggctcaagagagctcccttcccccttcttccatgtgaggttacactggaaaaggggtctttttaaccagaaagcagtccttcaccacatacagaatctgctgacacctttagattggacttctcagcctcccaaactgtgagaaataaatttctgttgtctataagccactcagtttgtggtatttttgttatagcaccctgaatgaagtaagaaagaccggggctaggttctggcttttcctgcaattagtcaactacttcatttttgacaaaatactttaattgaatttccatttcttcatttgtgaatgggcacaaaaataactatcttgtacatcttttagaaggaaaaattaaatgaaatgtaataacataatgcttataatatcttacatatagtatacatttttaaaatttagaggtaaaatataaattagaaatcagtgttgacatcaaggggcatgccattcttagaaaagataaaatactggccgggtgcggtggctcatgcctgtaatcctagcactttgtgaggctgaggttaggcggatcacctcaggagaggagtttgagaccagcctggccaacatggcaaaaccccatctctactaaaaatacaagaattagctgggtgtggtggcaggtgcctgtaatcccagctactcgggaggctgaggcaggagaatcacttgaacctggaaggcggaggttgcagtgagctgagatcacgccattgcactccagcctgggcaacaagagcgaaactccgtctcaaagggaacaacaacaacaaaaaagataaaataccagcacatgaataacagacctgcaaggtaaagagtgagaagcaaagaaaggaaggagacacagctagcactttcagaaaaagaagtgagtaaatataattattgaaaattaagggaagattttagaatgaaatgtcatttaaataggctcatttgtgaaagaagaggtttggtgaaaaaatatgtttctgaaaatgatctattttgagaacaatcaccctatgctgtattgattttgctaactttttcagacacatgatcaactttccctccagcagcatttgataatttttaccctagaatgaggttgcattcatttcttcacaatatagagaaaataatattacaaatgcctacacattttatttctatttacctttcttatattgctagagaaattgaaatttcttgtgtgtgaattgatcacttgcatttctttttagtgaatttatttgttgtggcattttccacaataatattttatatcgatttcccccaaaatttatctgcacacttaacactgtgaatagtagattaacagtgggagaaaatatctgatgttctctttaagttcaattctattatgtcctagtagtaacttttcattttggagatatctgcacttaaattattacttaaatcgtcttttttatgtgcttcgtggtatagctgacattgttttattttaaggcgtttggatgttgatttcctattctcaggttgcacgttacataataggcatgcaattgaccaacaaaataaatattctctctatatcatggagatcatagtatagtgggagagatggatgttttgaaaaacacaaaaatataaaaagatattgaatgagtttatagagtagagggacatgattcaatttatgatttaagagtattatctcatcaatgtataaaaataatatctgacttgagaaagtgggtagatggcaatgccatttattgaaaaggaaaaaagtggttggcgagttaggaaacagatgaatacatttagatagaagaatcagaactctcatttggatctgttgaattttaattgctcatagggcatccaagtaaatagagtaagctgctggatacataaatatggaatgcagtactggtatttgttctgggatgtaatttgagagtcaatagcataaagatgttccttacattcatagaaatgtgatatactatatggcagtcaaggtgaggcttaatgaaggaagaggacccaacaaaagataaatagtaaaagaggtgagaggaaaaccagtaaagaatggtattccagaagtatggagaagattttcaagaaggaagaattggttctaggcaaattatttttgagagtttgagtaaggtttgctgttggaggaaaaaaatggtgatgtttgcttctctccccaccaaattcaaatttgaactatttataaggtataggcaaatgcatgaatcacaaatatgcagtatgatgaattttcaaaaactgaactcacccatataatcagcacacagattaagaaacagagtattgccatcatctgagtggcctgctttgtacctctttctggtgactgtcctacccaaggatgaccacaatcctgattctaacacgaccagtttgcctttcctgtttttgaactttatataattttaattatatactacgtatttttgagtacaccttcttttgtgcaatattataatgtgaaatttgtccatggtgttacataaatagaatttgttcattatcattgttaaatacattttcactccctgaatattattgactgaatgtttatttccctccaaaattcataggtagaagccctaacacccaatgtattggtatttggaagtgggatctttgggagacaattagctttagatgacattcatgagggtagggctcccatgatgggagtagtgtccttctagaaagtgtgagagaggccacagctttctcttcttctgccatgtgagggcacagtgagaagacagccatcttctccagacttcttcctggtgaggaagagcaccctcttcaggaatcaaatctgatagcatcatggacctcccagtctccagaactgtgggaaataaatgttgtttaagccatccagtccatgctatttgttatagcagcccgagcggactaatacagtgaatatatcacaattttaggtatgttttctgaagagtaatttccaatgaggtactattctgcatactgctattatgaataactttgcatatttattttaggaaatatatatatacacaaacactattctgttagtatatacataggaatggaattgtgggtcatagagtagatatatgtttagcattagcaaatatttagaaacaatctaaatctatttgtaccaatttatatgcccaagtcaatatgtgagagtaccacacgttcaaatactagccaacccttggctagtcttttccattttgacattatagtgggtgtgtattggtatataattttaattttattatacattttgatgattactaataatgttgagatatcttttatctacttagtatttggatatatatatgggttgctgttttggtttcaatgttgctgactttaatactgttaatcagtacacattggagagtgaatcagcaatgtagatgactatttcacatactcagtgggtctttctggagttgtgcttccattggtttattcattgtattctaaggattcccttgaatttgtgcatacagtgtcaacattcatccgagaagtatggaaaatatatagaatataattttattgaaaaaaatgtattaaaacaattaacgaaaacaagaacctgagttaaaactctttaattgaagcttttgaaataatattttcctaaatatcatctaattacatctaacacatagaagtaaattatatttaaaaagaagtttgaagagttaagccccaaaaatcattcttaaaagtttgaatcactggcatgtaacctaaatttccaaaatgtcagaaaaatagatacagaataatttaggtataattatggtatacctaaataagtatgaaatatctaaatatatttaggtataccataattataccttaattatgctgtatttattataattatgttagataatattttaattatggtagataatattttggattgagtgaatatgcaggttatcactttctatatatcaatggaaattttttaaattacaacctatgaaggcctcacaatgaaaattttctagattaaatccattagttcaagtttttctaattgtactgtaaatgaaatatcttctccattatcaatctcgctttatttatttttaacacttattttaggttcagtggtacatgtgcagagtgttatataggtaaacccaagccatggggttttgttgtacagattattttgtcatccaggtattaagcctaatatctattagttatttttcctgattctctccatccttccaccctccaccttcaagtaggccacagtgtctgttctctctatgtccatgtcttctcatcatttggctcccacttataaaatgagaacatacggtttttggttttctgttgctgtgttagtttgccaaggataatggcctccagctccatctatgttccttcaaaggacatgatctcattcttgtttgtagctgcatagtattccatgatgtatatgtagattttctttattcagtataccatttatgggcattcagtttgattccatgtctttgctattgtatctagtgctgcaatgaacatacgcatacatgtgtctttatgatagaacaatttatattcatttcggtataaacgcagttatgggattgctagatcaaatagtagttctgtttttagatctttgaggaatcgccaccctgctttccacaatgggtgaactaatttacactcccaccaacaacatattagcattatttttctccacaaccccaccagcacctgctattttttgactttcaataatagccacagtgagatggtatctcattgtgtttttgatttgcatttttctaatgatcagtgatactgagtttttctttcgtatgttttggtcacatgtatgtcttcttttgaaaagtattcatgtattttgcctatttttggatggggttgtttgtttttattcttgtagctttgtttaagttctgtgtagatgctggacattagacctttgtcagatgcatagtttgaaaaaattttcttccattctttaggttgtctgtttattctgttgatagttcttttactgtgcagcagctctttagtttaattagatccaatttgtcaatttttgcttttgttgcaattgcttttggtgtgtttctcatgaaatctgggtgtgacagctgtcaccccacagatcaccagttgaccccactgatcaccgttgattcggctcatctggctagatgggtgtctccttccttcctcaccactccatgtgtgtccctactgaacctgcgtgtttggttgaagagaacagccatccttgatagaggaggaccagtcttcaataaaggatatacgagtggctgtgcttgcctgctacaacctccaaacatgctattagtcttgtgaataaagggatgagccatataactagacgctgagaaagaccagaacagtgctggtttagaaacggaggaccactgcattcttagttcatgtttggaaagtgctttcaaaaaatttcaagtacttggatgatctttagatgccattgctttgaaataatctttattttatagcacaaataaaatataacacccccattgaatatctatgtcccgttatctctgatagatttccataggtataaacctttaatctgaaggtcacacaaggcttgggaaaataccatcatcaagggtcaggtgagtatattgtatatttttaattgcatagttcgagtcacagatgcagatgtacaaaatttggtcagataattttctgaagattttctaaatcttgaattttctcaagattggacaggactttgggttaattaataatttatcagaatagcacattgcacataatttacccaggcttatatattctctaaaatatataaaattaattcaaaataaaatgttttagtcaaatacaactttactttccaccataattttacaatgaaatgttattatattttaacttaagagcttgggctcagcttcagtaggcctgttatggcattgtttaactcccccacagccttaaatactacaggaataagtaggaattttcaagggttttaactgttctttctttctttctttttttttttttttttgagatcgagtctcactctgttgcccaggctggagtgcagtggcaccatctgggctcactgcaacctccaccttctgggttcaagtgattctcctgcttcagccttccaagtagctgggattacaggcactcaccaccatgcccagctaatttttgtatttttagtagagctagggtttcaacaagttggctagactggtcgaactcctgacctaaggggacctgcccacctcagcctcccaaagtgctgggcttacaggcatgagccaccacacccaaccggttttagctattctttcattccctgtacaaaacaacacaaagacacatcctgccactgacatattctggcctgggccaaatgtaggattattgggttgtctgaacagtctcagcctcccagggcagtaaagttttcttaaaaaagagagcttgtagaatgggtttgcccacaactcactgcaaaatctcaggcgatttggcaactttttaaaggtaaaatatgttctgatccattttgttacttgctcgggggcagcaatgaaacaccagaggtggtatcctgttatgacccttctgcctacagtattttcaatattaatatctaatggtgggtatcttatttcatttgagacaccaagggtcagattcctctatttacttatggacatattaagcaacaataatgcaggcaagcataattttaaaataaagagtgattttataaaagtaattttgaatttctttttttctttttttcctagatgaccatattttttattttaaaaaatagaaataatacttttaaaatggtgaacaattcttttacatatatatatatttttattatactttaagttctagggtatgtatgtacaacatgcaggtttgttacacatgtatacatgtgccatgttggtgtgctgcacccattaactagtcatttacagtaggtatatctcctaatgctatccctccaacctccccccaactccactttttatgttcttttttcttcttgctatagatctaatttattttctgagaaggtccatacagagatttactatcccttgctttaggaacagttgtcatagtttattaaacccatttattttctaccaaaaggaagatatgtctaatggcatataaaaccattcaatgagtacttcataatatgagtgaaaggtgagaattctttgtattaataaacaatacatcttaggaaagcttaaaaatattaaaatagatgaaaataagtgatgtatagaaacatattttaggtcaataacaatctaaatactatatttatttattaattatgtaccagtatacccagtttcagaatggttgtaaagttaatttttttatatagcagcagcagcaacattattatttttttaacttttaggtttaggggtacatgtacaggattgttatataagtaaactacctgtcactggggtttagtatacagattatttagtcacgtaggtaataagcatagtacctgataggtttattattatttttttgatcctctcactcctcacgccctccacctacaactaggctgcaatgtcttttgttcccctctttgtgttctcattgtttagctcccacctataaatgagaacatacagtatatggttttctgttcctgtgttggttttctcaggataatggtctccagcttcatccatgttgctgcaaaggacatggtctctttctttctaatggctgtgtagtattacatggtgtatatgcatcatattttttaatgcagtctaccgttcatgggcattcaggttgattttttgtctttgctgtcttgaatagtgctgtaataaacatacatgtgcatgtgtcttcatgacagaacaagttatattcttttgggtatataccccaaaatgggattactgggttgaataaaagttctgttttaagttctttgagaaattgccacactgctttctacaatggctgaaataacttactttcccaccaccagtgtataataagtgttcctttttctctgcaacctcattagcatgttttttttttcactttttaataacggtcattctgactggtatgatataatatgtcattgtggttttgatttgcatttctctgatgactagtgatgttgaacatttttcatatgcttgatggccacatgtatgtcttcttttgaaagatgtctgttcatgtcatttgcccacttattaatgggtttgtttgttttttgcttgtacatttatttattatagattctgaatattagacctttgtcagatgcatagtttgcaaatattttctgccattctgtaggttttctgtttgttgatagtttcttttgctgtgcagaagctctttagtttaattaggtaataattgccaatttttctttttgttgcagttgcttttgacatcttcatcatgaaatttttgccaagttctatgcccagaatgttttttcctaggttatcttccagggtttttttttttttttatagttttaggttttacatttaagtctttaatttctcttgagttgatttttgtatatgacgtaaggaaggggtccaatttcaatcttctgcctatggctagccagttatcctagcacagtttattgaatagggagttctttctctattactagtttttgtcagctttttcaaagttcaggtggttgtaggtgtgtagcattatttctggactctgttctgatccattggtttatgtgtctacttttctaccagtaccatgctgttttgattaccatagccttgtagtatagtttgtgattcctctaccttggtccttttttcttagatttgtgttgcctatttggactcttttttggatccatatgaattgtatttattgtcctaattctgtgaagaatgtcactggtagtttaataggaagagcattacatttataaatggctttatgcaatatggccattttgatgatattgattcttcctgtctatgagcatggaatgtttttccactatttgtgtcatctttgatttctctgagcagtgttttaaaattctcattgtggagagctttccttttcctggttagctatattcctaggcattttattctttttgtggcaattgtgaatgggattattttccagatttggctctaaacttagatgttcttggtttataggagtggaactgacttttgcacgtcgattttgtatcccaaaactttgctaaagttgttggtaatttcagggagcttttctgcagagactatggggtttctgtgtgtagaatcataacatctacaaacagggatgtatatagcactaaacgcccacattaaaaagttagaaaggtctccaattaacaatttaacatcacatctagaggtaatagagaaataagggcaaaccaactctaaagctagcagaagacaagaaataaccaaaatcagagctaaactgaaggaaattgagatgagaagagctatacaaataatcaacaaatctaggagtttgttaattgaaaacattaataagatagagtgctagctagagtaataagggaaaaaaaagaggcatgttccaaataaacacaatcagaaatgacaaaggggatattaccaccgaccccaaataaatacaaaaatttctcagagactactataaacaagtttttgaacacaaactagaaaagctagaaaaaaatgaataaattcctggacacatacaacctcctaaactgaaccagaaagcaatcgaatgtcttaaccaaccagtaatgagttccaaaattgaatcaataaaacagcctactcaccaaagaaagccagcactagaggaattcacagcttaattctacctagagatgtataaaaaaaagctggtaccaatcctactgaaactattacaaaaaattgaggaggaaggactcctccataactcattctgtgtggccaacattatcctgataccaaaacctggcagagatgcaacataaaagaaaatttaagaccagtattcttgatgaattaaaaatcatcaacaaggtactataaaaccgaatccagcagcacattagaaagctaatgcatcatgatcaagtagacttcattcctgggacataaggttggttcaacatttgccaatcaataaatgtcattcatcacatcaacagaactaaaaaaaaaaccagattatttcagtaggtgcaagaatggcttttgataaaattttacatccctgcatgttaaaaaccctcaatatactaggcaataaagaaacttacttctaaataataagagccatctatgacaaacccacaaccaggatcatactgaatgggtaaaagctggaagcatttccctgaaaactggaagaggacaaggatgctctctctctcaccactcctattcaacatagtgttgtaagtcctggctagagaaattaggcaagagaaagaaattacaggcatccagctaggaagaaagaaagccaaactacattattttaaatcctatcaatttcaattttgaaatttttgctacaaaaatgttatcactagaccgtcattaaaataaaaaatttaccacttgcataaaaaatacattattttcacttttaatagtcttctatgtttaatatattctcttaaatgcaatttttgacttttaacatcacaaactcaaatgatccaaggtacaatgaaaatggtaataccattatatcattaagtaatctacaaaatgagaaataaaaatgaggctctaattcgtacaattccacttacatgttcagaaattgtattctgcttcaaattttgcccttcttatacaggttagaagatgataaaggattctaaattcttattatttattggctatgatctgcactgataatagtaatttaaccagggctgcgattttggggagcaatgttctatagggatattaaatctgtttttaattattggctttttattaggcaattttattaacagattcagtaaaaaatgtccaccgcagctcaataaccgaatgatcttctaattaatctattagtgccttttaagtattcttactgttcaggcgtatgtcatgttgaacagtaaaatagaacttgaaatgttaatattagcaggactagttctatccccaaatctctgctgccttcaaacttctgttgaaggagctctattgaaattagcaagctcctctgtgtcatactttcagtattttattaggagtgtgactaaagttgagaggcaagagatactgcagaaaatttgtgaagctctctgttcagccttctcctgaataggtagaggaactggtatgtacaaggtgtaatgtgtggtgtttctctctctttggtccaagcagtgactgctgaatgtccaaccaggtaagagcgtaatgataaaaatgaagttggggttggggaaaaagtcctgggtctattttagggtggcaagttgctactacatatcaaggcaaactgtagcacccaggatgcataagcaatgaaaactacaagtgttcatctctcagccagttgtatgaaaattctacattcctgtcggttattatcactttaacctttcaaaattcaaatttttctctctaatagatatgtagatttataggctctgcttctattcctctttgctgtattatcttccactggatgtcagttaaactttcacaattttagagttatatgatctgtctcctttctatacatcactttacaaaatgtcagagcccaggaggaatttgagtctgagactcctggtaggaagtggcactctcagggagccatgccattttctttatggctaccattactatctatgtattgatgactttttctttccttttctttactcccaattccaacttacctctacagcttcagaactcaatagttcatggtctgtttcatatttttatatgaagcacccccatatacttcaaattcacatgccccaaacagaacccattatagcctacttgctcttatatttattacttcgctcatgcttcttcctcacttacatccttaccattgaaaaagtaaatttaaaaatgtattgcatgattttcttcttttttctttttgtgtctgtcttcaatgtcataaatgttcatctacaatgtagattcagccacaaacctggatgtcatctgttactccatactatatattttcaactacaactatcagtctaatattatcttctcatccggactgcttgagacatgtagtatgcttctagtcttgcccttttgttagccagagtgagcccactgatctaacaacagaaaccccttctcttgctccccactgccactagggtcagtgctaactccattgcataagacagtcctcttcaagatctcacttcaccagttctctgcagtttctctctggtcggtgttctagcgcactgcaatcctgataagctgtatccacatcagattcctattccttcggctctttgcacttgcaaccttctcaacttgaatcactgccccacccttcactcacctctgcactatattaattgtccttcaagatatccattatatgccattccccttacaaagcattccttgacctttagggctgtgtgaggtattttgtccagtggtatcctccattaacgtctttatcacatatgacaactatgtgacatggagtaagattcaataatttcattcttatttatctagcttgcttttttagggctaactttcttcagggctctctactgggcttagaaggtgttaatagtttttatttataagattgaattaatgatgagcaatataataaataaatatgttgtaatataaatggttgataatcactttacagatgatcaacctcattccaataacattaaaagaaatataaacaggagaactgtccactgtcatggaaaagggactgaagccagagagccaaacatcctcactcagagggtcccacgcccacagaaccccacaagctgagacccactgggttgaaatccctgctggccagcacagcagcctggagtctgcctaagactaccgagttcatggtgggaggggtgaccgccactactgtggctctagtaggcagttctctccagctagtgctacggagactgggatgtttggactgggtggtactccccacagcgtagcacagcagctgtggcagatcacggccagactgcttctttaggtgggacccagattcatcccttctcactgggcagggcctcacacatgaattccagcaattccagccaggcctttacagacagaattgtcctctgccagggacagagcacgtggcaggaggagcggccaaggtgtcaagttcagtgggcttaatctttcccgtctgctggccgatctagaggagggggactcccccagcacagcacaacggctctgctaaaagatatacaaactacttccttaagtgggtccctcatcctgtgcctcctgactgggtgagacctcccaacaggggtcaccagacacctcatacaggagagttatggctggcatcaggtcggtgcccctctgggatgaagcttccagaggtaggagcaggcagcaatctttgatgttctacagcctccactggtgatatccaggtgaacaggatctggagtagacccccagcacactgcagcagacctgcagaggaggaccgtgactgttagaagaaaaacaaacagaaagcaacaacagcagcagcatcaacaaaaaccccatacaaaccctatccgaagattgacagcctccaagattaaagatagataaatccatgaaaataaggaaaaaccaagcaaaaatgctgaaaatttcaaaagccagaaatgcctcttcttctccaaacacttctccagcaaggccacagaacggggatgaagttgagatgggtgaactgacagaagtaggcttcggaaagtggataataataaacttcgctgaactaaaggattatgttctaacccaatgcaaagaaactaagaaccatgataaaagattacaggaatctgttaactagaataaccagtttagagaggaacataaatgacctgatggagctgaagaacatagcacgagaactctgtgatgcaaacacaggtatcaatagctgaattgaccaggcagaagagagactatcacagcttgaaggccatcttgctgaaataaggcaggaagaaaagattatagaaaaaataaagaaaaggaataataatagaaaacaaacctctgagaactatgggactatgtaaaaagaccaaacctgcaactcactgaagtacctgaaagagacagggagaatggaagcaagttggaaaagacacttaaggatactatccaggagaatttatttaacctagcaagacaggccaacattaaaattcagaaaatccagagaaacccagtaagatattccacgagaagatctactgcaagacacataaccttcacattctccaaggtcaaaatacaggaaaaaatgttaagggcagtcagagagaaaggccaggtaacctaaaaagggaaacccatcagactaacagtggacttctgagtggaaagcctacaagtcagaagagattgggagccaatattcaatatccttgaagaaaatagctcccaatccagaatttcatatccagccaaactaagcttcgtaagtgaaggacaaataaaatccttttcaggcaagcaaatgctgagggacttcatcaccaccaggcctgccatgcaagagcttctgaagaaagcactaagcatgaaaaggagaaagtgttaccagccactacagaaacacactgaagtacacagaccaacaacactatgaagcaattacattaacaagtctgaaaattaaccagccaacattatgatgacaggatcaaattcaaaggtaacaatattaactttaaatgtaaatgggctaaatgccccaattaaaatacaaagaacggcaagctggataaaaaggcgagacccatcagcatgttgtattcaagagacacatctcatgtgcagagatacatataggctcaaaataaaaagatggagggagatttaccaaacaaatagaaagaagaaaaaaacaggagttgcaatcctagtttctgacaaaatagactttaaaccaacaaagatcaaaaaaagacaaagaaagacattacataatggcgtaaggtttaattcaacaagaaaagctaactatcctaaatatatatgcacccaatacaggagcactcagattcataaaacaaatccttgaagacctacaaaaagatttagacccccacacgataatagtgggagaatgtaatgccctactgtcagtatgagatcattgaaacagaaaattaacaaagataatcaggactcgaactcagctctggaccaagtggacctaatagatatctacagaactctccaccccaaaacaacagaatatatatttttatgaactccacatagcacttactgtgaaattgatcacataattggaagtaaaacactcctcaccaaatgcaaaacaactgaaatcataagaaacagtccatcagaccacagcacaatcaaattaaaactcaatattaagaaaccaactcaaaaccacacaactacatagaaattgaacaacctgctcctgaatgactaccaggtaaataatgaaattaaggcagaaatcaaggagttatttgagaccaatgagaacaaagagacatggaccagaatctctgggaagcagctaaagcagtgttaagagggaaatttatggctgggtgcggtggctcacccctgtaatcccagcactttgggaggctgaggcaggcggatcacaaggtcaggagatcgagaccatcctggctaacatggtgaaaccccatctctactaaaaatacaaaaaattacaggcacctgtaatcccagctactcaggaggctgaggcaggagaatggtgtgaacctgggaggcggagcttgcagtgagctgagattgcaccactgcactccagcctgggtgacagagtgagactccatctcagaaaaaaaaaaaaaaagaaaaatttatagcactaaatgaccacatcaaaaagcctgaaagatctcagatcaaccaccttaatatcacaactaaaataactagagaaccaagagcaaagaaatcccacagctaggagaagacaagaaataaccaagctcagagtggaactgaaggagacagagactcaaaaaacccttcaaaaattaacaaataccggaactggttttttgaaaaaatcaataaaatagaccacaagtgagagtaataaagaagaaaagagagaagattcaaatatacgatgagaaacgataagggagataccaccaatgaccccacagaaacacaatcagccatcagagaatactataaacacctttatgcaaataaactgggaaacatagaagaaatggataaatttctggacacatataccctcccaagactgaagcacaaagaagttgaatccccaaatagaccaataacaagttctgaaattcaggtgctaataaagagcttgccaatcaaaaaaagcccaggcccagatggatttacagctgaattttacgagaggtacaaagaggagctggtaccatttcttctgaaactatttcaaacaattgaacaggagagactactccctaactcattttatgaggccagcatcatcttgacatcaaaacctagcagagatgcaacaaaaaaagataacttcaggccgacatccctgatgaacatttatgcaaaaatcctcaataaaataggacaaactgaatccagtagcacatcaaaaagcttatttagcacaatcaagtcagtgtcatccccagaatgcaaggctggttcaacatacgcaaatcagtaagcataattcctcacataaacagaactaaagacgaaaaccatatgaatatctcaatagacgcaggaaaggccttggataaaatttaacatcctttcatgttaaaaaaaaaaaactctcaataaactaggtattgaaagaacatacctcaaaacaagagccatttatgacaaatccagatccaatatcataatgaaagggcaacagctggaagcattccctttgaaaactggcacaagacaaggatgccctctctcaccactgttattcaacatagtattggaagttctggccggggcaatcaggcaagagaaagaaataaaggatatttaaataggaagagaggaagttaaattgtctttgtttgcagatgacatgatcctatatctagaaaaccccattgactcagcccaaaagcttctttagctgataagcaacttcagtaaagtctcaggatacacaatcaatgtgcagaaatcacaagcattcctatacaccaacaacaggcaagcagagagccaaatcatgaatgaactcccattcataattgccacaaaaagaataaaatacctgggaatacaactaacaagggaaatgaaggacctcttcaaagagaactgcaaactgctactcaaggaaatcagagaggacacaagtagatggagaaacattacatactcattcataggaagaatcagtatcatgaaaattgtcatattgcccaaagcaattaatagattaaatgctattcccattaaactacaattgacattcttcacagtattagaaaaaaactatttaaaaatttttatggaaccaaaaaagagctcataaagccaggacagtcctaagcaaaaagaacaaagctggaggcaccatgttacccgacttcaaaccgtactacaaggctgcagtaaccagaacagcatggtattggtacaaaaacagacacatagaccagtagaatggaatcgagaacccagaaataaggccacacacctacaacgatctgatctttgaaaaacctgacagaaacaaacagtgaggagaggattccctattcaataaatggtgctgggagaactgacaagccacatgcagaaaattgaaactgggtttcttccttataccttatacaaaaattaactcaacatggattaaagacttaaatgtaaaaccaaagccattaaaaccctagaagaaattttgggcaataccatttaagacataggcatgggcaaagattttatgatgaaattgccaaaagcaattgcaaaaaaaaggaaaaattggcaaatgggatctaattaaatgaaagagtttttgcatagcaaaagaaactatcatcagggcaaacagacaacctacagattgggagaaaattttttcaatctatctatctgacaaggtctaatatccagaatctacaaggaacttaagcaaatttacaagaaaaaaacaaataacattattaaaatgtgggcaaaggataggaacagacacttctcaagaaaaaaaaaagaccatacatgcagctaacatgaaaagaagctcaatatcactgatcattagagaaatgcaaatcaaaactacaatgagatatcatctcacaccagtcagaatggcgattattaaaaagtcaagaaacaacagatgctggtgaggtcgtggagaaataggaatgcttttccactgctggtggcaatgtaaaatagttcgaccattgtggaagacaatgtggtgattcctcaaatatttagaactggaaataccatttgacccagcaatcccattagtgggtatatacgcaaaggaatataaatcattctattacaaagatacatgcacatgtatgttcattgcagcactatttacaatagcaaagacatggaatcaaatgcctatcaatgatagactggataaagaaaatgtggtacatatacgtcatggaatactacgcagctatgaaaaggaatgaaatcatatcttttgcagggacatgaatgaagcttgaagccattatcctcagcaaactaactcagggacagaaaaccacacacctcatgttctcacttctaagtgggagctgaacaatgagaacaaatggacacaggcaggagaactacatacactggaacctgctgagggagggcaaggcagggagggcattagggaaaagagctaatgcatgctgggcataacacttaggtgatgggttgacaggtgcagcaaaccaccatggcacacgtttacctgtataaaaaacctgcacattctgcacttgcaccctggaacataaaaaaataagtataaacttgcaaattctttgataccattttgagatatcatttacaattagaatatattataaataaggctatttcagatgtcagtgaccatgagaaaatcaacatttttatgtcactggtataaacataggttgctttaattttctgggaggaaatttggcactgtggatcaagtacctaagcatcatcatgataagctcatgctagaattaactatgtatttctactactagaaattgattgtaataatttgatgagttataggtaaattatgtgtcaagatgccagtaaaattttattaaaatgaaaattatagcaaccatcaaacaaaacaaaataaattatgtatgaaaacgctatattgtggaacaatgcacagccaacataataataattaggatcagatttctaatgacatgtgaatgattatgcaatgtactaggtaacaaataaaatattcaactgtaactatgtgaagctgtgtgtccagcaaaaggaagtaaatgcagaaactctaaaagataataatctcctatcagtagtataatgaatgacttttgtcatctcttttttatgtcttctaaaatttctatgatgaacatttattccacttccacgtagaacactataatataagccttgcaatgttctgcgaatttctaagcttaaaaacctcttgtatgtcagttcatttattcattcattgatttatgcatcaaatgttggctaatcagcaagaagtaagacaaggtacatagtctcttcattctacagcagaaagacagaatatgaggaagtaagcaagtaaatacatataaaaataaagtcaagcaaacatataaataaataattgataattgtaatacatcctctgcagtaaatgagtaggccataaatagagggatatgatagaaagtaactcatggagaaaaatgataggtgataattgataattaaaagaagtcaaccatgtaaaaggctgagaaagggcattccagtcagaagaaatagcaagtacaaagacattacggtgaacataggcacagtatgctccagaaacagaaagaaagccagggcgactgaaatccagggggcagaggaagtgtggaaaggtaggatgtggaaaatcatctatgccatggtaaggaatttggattctaagtgcaatagaaagccctttaagatctaccttgcataatgccttctttgattgtcataaagtttcttttttcccaacatacaatttcatgtatttctcatacttctgctcaatgaaagtaattgcatttattgctgacattgtattttatcttctactaaatacttacatgtttatagtaaccattctaccaattatatgttgcatatttatataaatttaaattagtaccaagatctgtgtccgtgattaccaattattatttatttgctgcccatctctcctttctaaaacattagttctagaaaaatagattccttctgtttagcaccattatactcccagtgatttcactgtgcatttcacagaagatacaataaatatttgtttaatgcatgaatgtaattatgtttttcattagattgtaaaaagtttacagcatactgacagctgtatgtcactaaaataaacactttaagttcctattctaaccttccttttgccttcttcttgtcatttctcctttcttataatgtaaggccaggtattctaattatactcttacctggccattcttcttacttttcttttctctaaattaccatttgtgtccttctctctcacttgacaatcttgtgtatttccacaagtccaactgcgaaaaccctcctcaccctcacctctcattagggtagagacaagaatcccagattgtatttctatctagcatagatcaatcgacagaaacatagccagggtactactttgcttgagaaatctctacatgaatgttctcttcattgctcctaaagtatatatcccaaacctaattattttttgtcccttgatttggtatttctattaatagcaccaattccattaatcactaaaattcaaaactacaaatttacctttaatatgtctttgcttcttccctatgatcctatttcctctactcctgccatcttacccactcattgctcatgcacaaagcctcacctcacatgaaccaacatccattcttttaccaatcaaacatattttcatgtctgaaatatgcttttatgtacacacatctccttctcctgaagctgcagcttatcagctatcaaataagagataggaagaggaaatggccatatataatatagctgcaattgtcgcagactacacagatggacggaagaaggcataaaaggacatgggttgttttaatggatgggtgatatctgtgtttcatcccactgttgatgaattttggcagacaccaagatcatgtaacatattaaatttaatatttgttcagcattatatcatgactgaattagactcccatatggaaaacataatttatgtttaattttaatgagatacattactaagatgctgaaaaaatattcaaattttttatcacatattgaacaagcaatatatctacttatgaagaacacagctgacttacattcttgctgatgtttgtcaagaataaaaatgattatgctatataaccattgtatagaagccttctgttgccataaattcacttgacatttcactttactgagtgatgtgggaatgacccttagcaaggctatgcatactttgtgtgtttaaacttcatgcatacagaatatttgcagatacactaataatttaacatctcagtcggacattctactgtttaaatttaagcaaaggaaatagtctagttttaaacaaagcatcttctgaagcagttgcaaagggtatttctagaattacaaaattgtcagatccattagaactgtttctggtctctcaaatttgcgttggcccatgtacttaatactttctttcttgattgctctctctttcatttatgctcattatacgaggtagtttccatgtcacgaaggtaagaaaatatgtggagaattgttaaaattaggccagagtaaaagaatcaacctatgaagacccaacagcaatattgtaaaaggttatcatattttattaaagtgaatttttttgcctgttttaaaaattatctaaaggtataagtattcatagttgtaaggaaatacattgtattactccttagctttcacacatcatttccagaaatagtttcaccttaagacaccctcacctgacatttaaaagctcaaagtgctctggtgtctgccagattctataacactaattttgtctgtggtctttttttccccctagaaacttcataagtatacatcaatctgccagaaatggtgattatgtgagcagattaaagtaagggtatttctcccctgcaagtttaacattaacattctcactatagacatcctcttggcattgaaagagaaatgaaaaaggtgtgtgtgtaacattatctttgttctgtaacataaaactagcatttgtattttccattaatttaaaacacttgttcatacaatacattagagttaacaatttttcacttttgagctagcaaaagtttttagctgatttcttttgaaatataatttatttaggtcagatattttatttttacattttgtattatataaacacattctttcctttttattacctcaatatatctcaccaaaatattttaatcaatacttatacacataccacaatccaacatgataggtgttaggtgtttctatttattattagcatttttaaaatttaacagctttagatttttttccttttcttattgtacattctattgcaggtataaatcgtcctatatggatgaaatgttaagcagaggtaaaacactaaaaaatcctatttggcaactttgatgtacaagcatttggcagttatgttaagtgggagtgagtgatttttaaaaatggtatgtataaacccaggtgcattttttacatagacacaaattgtcactcccttatagttcttaaaccaagataattttatgctttatttttaaacaatgttgcgatgcattataggatgttatgacatttaaagaaatggttgcatcagctactgaatatttatcttaattaatcgattatgcatcagaagtaaaacttttgtataatgagattttgaaacttgttcaaagaaactatatctcttttacctacctcattagtttggttaaaataacgaattcccaaaacccacaaataacatgagaagtcagtgctaagacataaaaataaagcatctatttgctgaatacttatatatttcattagtatgaagatactgaaatgtaaacaaatatgggcctcagaaaacataaatgaagctagctctcagtcaaactttttatctcgagaagattttctttactttttctttctctgttctcagcaaaaatagatatggtagcaaagaaagtagcaaataaaactgcagctagctgggtgcagtagctcactcctgtaatcctagcacttttgtaggcaaaagcgggtagattgcttgagctcaggagttcaagaccaacctgggcaacatcttgggtagagatgggcgaaactccatctctaccccctccccaccccccccccccaaaaattagccaggcatagtgtccattcctgcggtcccagctactcaggaggctgaggtgggaggattgcttgagcctgggaggtggagattgcagtgagcttagagtgtaccactgcacttcacttcaccctgcatgacagaatgtgaccccatatcaaacgcaaaacaaaacaacaacaaaactgtagctttgctaaagaacagatgtggctttggcagagaaacttgcaaacacaggatgtgaatatgtggatagatctataaaagaggaaaaagcaggaatcattatatttgataaatttagtacagaaacattgcttgggatgtgtggtgacctaaataaaaaatgctaattgaagagaaaataatactttctaagcattttaaaaaatcagttagtagagacccgagccgttcattaaacattagttaaagagcatgttaatagcacttacagggttaaatggaactgttttgagacttctccaattataaaacatcttttcttatttcaatatgtatttaatgttactttcatttttaatttgtcttattaaatattccctcaagtaccttggagaagtttatgttcaaaataaaacaataaaaattcttatttggcagctttgatgtacaaatatttgacaattatgctaacagaatgaatgatcttttaaaattatgaaattgattttaaaaactttctgtcctttacagtttggacatttatatgttaaatatgcatccttctattaaatatgagaattgtgaaattgataatatttgtactattttgtttgtttttaaagccaaaaacctcagatcgatattaagtgtcttatgaaattataatagctctcatgatctccaagcttattctccgtttttgtcactttacttttctattttaatagttttcttaaacaacattaattttgaatataaaggcctaattaagtaaataaaacataatgatttcaaaattacattagtgatttgcacaaaattagcaaaaatacatatagaatttaatatgaaaaacttagaactgcacaagttcataataaaacattatttttagtgtaatatctttttaaaaaattccaaaattttaggtttggggttacacatggaggttagtaacatgggtaaattttgtatcttgggggtttggtgtacagattcatcactcaggtagtgagcatagtacatactaggtagattcaatcttcaccctcctcctaccctccatcctttggacagagactgtgtggttctctaggtacagaatcatatcatctgggaagagagatagtttgacctcctttcttcctatttggatgccttttattttattttattttatttttattttttcttacccgatagctcagactaggcctttcagtattatgttgaatgaatctggtacgaataggcatccttgcttgttccagttctcaaggggaatgcttccaggatgtgtccattcagtatgatattagctatggatttgtcatagatggcccttattattttgatgtaggttccttcaattcctagtttgtggagggtttttaacatgaagaaatgttaaattttatcaaaagcattttctatgtctgttgagatgattattttgtttttgtttttagttttgtttatgggatgaatcacatttattcatttacatatatcaaaccaaccttgaatcacagggctcaagcctacttgatcgtggtggattagctttttgatgtgctgcttgattctattttctagtattttttttttgaggatgtttgcagctatcttctttagggatattagcctgaagttttgtttttctgttgtgtctctgacagtgttggcatcagaatgatgctggcctcatagaatgaattagggaggagtccatccttctcaattttttggaataatttacttaggattagtactagctctttcttatacaactggtagattttggctgtgaatgtctggtccaggatgtttactggttggtagttttttttatgattaattcagttttggatcttgttatttgtccattcaaggtttcagtttttttattggttcaaccttgggaagttatgtattttcaggaatttacccatttcttcttggatttctagtttgtgtgcattgaaatgtttgtaatagtctgtgaggtttgatttttttttcatttatttctttgaggtcaatggtaatgtagtaatgataatctcttctttgtcatttctcattttgtttatttggatcttctttgtatttttattagtttagctagtggtctatcaatcttattcattcaaagaacgaactttggatttcattgatcttttgtatgttttcttatttcaccattttattcactcaagctctcattttggctatttcttgacttctgtctttggtggtttttttctctagttcctcttgggatgatgttagggtgttaatttgagatctttataaatttttaatgtgggtatttagcactatatacttctaacactgctttcctgtgtcgcagagtttctagtatgttgtatcttttttctcattagttttaaataatgtcttgatttcttccttaattggattgtttacccaatagtcatccaggagcagtttgtttatcttccatgtaattgaatggttttgagaaacccgcttggcattgatttccatttttattgtgctgtggtccaaatgtgtagttggtatgatttcgatttctttgaatttgttgagaattgctttacgtggccaattttagagtatttgccatgtacctatgagaagaatgtatattctttcgttgtttggtgcagtgttctatagatgtcctttatattcttcaatttcctggagtgtctgactgtgctataattgggttccgttgactggctttgcttctcgatgatttcaaggggtgaaggctcagttcagcactcctgggcagcacatgctaaccctggcaggctgggaccaggcccacacctttgttctctggcttcttgagggtaagcacctgttgcactaggggggcctaggtgttctcagtcccctggcaacaatactttgatggtgtgtgccagaaaagcacatcatcagggttgtggcagtggggttcatgatagcatgcagtggagttgagcttgtggtggcgaggtctgtgtgtgcttatgtgccagtaaaactgtcggtgcaggctgcaggtgagtgcatgccggcaaagcagcagggggaatctgcaggcaggtgcgcaccaatggagggaggcctgaccacataagctctctgatggtgaggaggggtctgctggtgtaggagctatggtagtagctgctggggagtgacccagttgggcatctgaggctgcattccaagtgagtgtgaccagaaagagcccctgggaaagactggcagaccagactggatggtgctcagaacacactgcccccatcccatggacaagacagccctgttctgtccaggtctatcagtcaacaaaggcaaaagcccctaaaggagcatgttgagccttgggggataagcatccctgggcatactctactgcagccattctgacaccaaacctctggcttctacacaggctagagtcctgtccctgctgactctccttgcagctctccctgacagcacaagtgttcgtgggactcgtagggcttcctgcagcttcgatttctgaggcacctaatgagactgagccattcatgtctatttaactcacctcttacttaggagcacctcagggccagggactagtcctggtgctcagcagccccatgttcccagcttctctatccttcaatcccttcagggtctgtgtccccactctgtccactctcaacgcctttcttcctaagatctgctggtaatgtgtcagtctactttatcttctgatctctcagtgagagttccttctggttgtgtctacttggccatattggctatttctgtaatcatatcttatccgatgacattaaggcagaaatctttaacaagcaaacaaaaaaacaaagaaacagagctatacagctgtaaaacactctacatagaaaacaatttaattcacttatgtatcttagaaatgtaatttaaaaatatataaatatattttaaaatatacatgtaaaatatatatattttaaaatatgtaatatatatgtatgtgtgtatatatgtaaatatattttataaaattacatatataaaatatactgtaaatattaaatatatcatatataaacataaatcattgaaataaaatggcagatcaacaaattgactgaaccaaaaatctttgcaatatagaagatattttttgtatatgacaatgggatcctagagacaaatgtttctttctctcctggctcccttccttctttcctttctccgtccattcctttgttccttaaaatatattgagcacttctgcatgtcaagaggcaagctgtacatggctatattaagttatgtgcactactgattttacctttttggtgaaaaccttaaatataacattttggggatttagtaaaacacctctaaaaatgtaggaaagttaatcccaaatgccattccaggcccttccattcagaacacattaccaatttgtttttcaaacataacacattttttttgtattgatagtttacaggataagacttttgaaaagacctgttttagagctaagaggagggtgggaattacaagcagtgttctttgaaagtgatatcctacaaactgttgttccatcttcaagtcaataaaagataataccttagagatgacattatagtgaccacatattttcttattcttattttttcccaaaccatcatatttcatgaaattatgaaatcataatgaatatacattttatacagctttatgtaacactaatttctggagatttaaattttacatatgaaatacattatttttgcagaattatgattggctaaattacaatttgtgtctgatctttttcatttcagggacttttaaaaactggccatcatttattcattgttttgcctaaccaaattgagaatttgaattaagaataaattctagtctcatctatagtctagggaaaaatagatatttggaatcattcaaggaaataacataagaagtgggactgttttactaaatatcttcaaatagtaattattctaaagcaaaggaaattcttggtgccatatttcataagagaagttatttgtccagaaaaaggatatttcaagaatgcagcatctcagatccatatcacataaggaaaattattggaactaagtaagacataaggaggttttccactactgtttcatcaaacaggttttctgtgccctttgccgtctcctctcctcctggaactcccagaattttcgtatttgttcagttggtggtgtcctatatgtcacataggctttcttaattcctttgattatttttttaatctgactacgttatttcaaaacacctgtcttcaagttcagaaattgtttcttctgattaatatactttattgttgaagcttattatattttctatttcattcattgaatttttaatttccagtatgtctttttttaatgatatctctttgttgaatttctcattcagatcatgattgtttaaaatttctttttatcgcctgtctgtattctcttgtatctttcttagtttctgtgaaatcgctattttgaattcctttccaggcattttatatattttattttccttggattttggcactggagaccttttattccttcagaggtgtcatgttttcttgcttttccatgtctcttttgtatttatgttggtatctgcacatccagcataacagttatttctttcaattttatggagtaaatttcataggaaataatttttattttttattgtttgagacagaggcttgctctttcacccaggctggagtgcagtggtgtgatctcagctcgctacaacctcagcctcctggattcaagcaattctcgtgcctcagcctcccaagtagctgagattacaagcatgagcaaccatgcctggctaatttttgtatttttaatagagatcaggtatcactatgttggccaggctggtctcgaactcctggactcaaatgattcacccacctcggcctcccaatgtgctgggattacaggtgtgagctaccacgcccaaccagaaacacttttttttttctgtagatgtgtctatagtgttagttagatagggtactttggtttcggttgtgggtgggtggtgtcatgtagtctacatataatttcttgtttattctatatttttgaagacgatttttcttcttataatcctatttgtcttcattaaaattaagattaaatgtcaatatcctccagtcaattctcagtaacaattcttcttactgtgagttgcatctagttttaaatatttagagtatcttattttattctatttatctctccaaaatagatcttgagctcctttttagtaggtaaaagacatgtcagctcaaacggcaagtattacttactcttccacaaatgatggtaataatattttatagaccatagagatagttcttcctcctcaactgattatctatgtgactttgagaaagttacttaaactttctgtttcagtctattcaacctacaagaaggacagtaatgtattatgtagctcaagaagtgtcatatagctcacatgaaataataaatgtgaaaaccctttacaaaacaagtgtaagtatgttgattttttttttagtggtggtagatttaggtaggccatttcttttctattctcacatatagtatttaaacagtttaggtacacagtgtaagtttattttacatataaacttaatagatccatgtgcatattaaatcttaactcatcattaccctgctcttatcaaccaagctaattaaaccagcaattattgtcaaaatgataaatggatttatgtaatctatatactatttgtattatatttagccagtattcccttctccaaaagaggattggagaagtatcacaaggaattctgggaaacgcaaaagtgggtaatattaaaattgtataaaggaaatatataggtatataattcgtttatccatttgcaaaatgctgtgaaaataaatggggataaattatgtattacacatatttggcctttgttcatattttcatttaaattattctgaatacaaaaattatgcataatccttaaaagtttgatctccaaattttaacctaccttgcaataaacaaaataccatatatatattaagtcaagcaagactaatttgctaaggaggagaaaataaaggctataatcacaataatattttatagcaattcagaagttagggttctaaacacaaatagtattaaatcaacacccaatccttgttgatgaacattttcaggggaaaaatgatctataaatactttattattttctgtattgcttaatctccatgaaatgtccatatttatttacaatgagagaactttaaagagaaagaatacactttttattttttttaagctggggtctcattctgtcacccagactagggtgcagtggcatgatcaagactcactgcagctttgacctcctggactcaattgatcctcccacctcagcctcccaagcagctgagactacaggcacgtgccaccacatctagctaatttttgtactttttgtagggatgggttttcaccatgtttcccatgctggtcctgaactcctgggctcaagcaatccatgtactttggacttccaagtgctgggattaaaggcatgagtcgatgcattaagcactatattgaggacaaaataaaaagaagcatgatattttgtcatatgtgagatactatgtaaatataatattttaaatataaattgacattgtgcttgctttccaaccctaagacttaaactgttttgttattaatgcatctttcagtatctttgaataggtcaggacacaattaaaaccaaaacagaaagtttctttttactttcatgtaagtatgatgattaaggtgacatataattagtgggctctttactgaaagagagattgtttataaaagcaaagacagctgaagcaacctttttctgctatatttacaattctaatgttaattataatggaatatccaaatataaaaagtggtgtcattaagagaaaagaaagatttcagaaaattagtctgaaaagaattccagaggcaaagctccatatattttagttttataattttatttctgaaatgtgcagctaaatttacttgttttctaaaagaaagaagctttcaggagcaatggcatgattttgtaatgaaggacagaccacatctatcacaagaaattatgaataatatgtttttgagagagcagcttacaacagattagaacttctgctgtccttttccctaccaggacaacaattttccatgctgagctgctgattgtgattatttattaaagggacattataatattttatttctcctctgatatttcctaacatagaaatatttgtggactaacactataatttacagaataaactgtattgattaaaaactacagagacctattgtgtcatttatttaatcacagaaagccatgttttcatccttaaataacatcatggtgaagcacttcattttatatattgtagaaattcaatgacagatgctaacgtatttatatgttaatttttaggaggaaatattttatggaatgatttatacaagataacacagaatggaataactttccagccattcatgccaataaaaacaatagtagggatttaatagtattaaacatcatgcttcatatttttgattgggtaatataaatatttttatattacatttaaaaagtatgtagtcttttatgcgccctttaaggattgtaaatatattcatatttgagcatgttctcttgtatcaaatacgtactaaaaagggccttttaaaataaatggttcatcagtgagataagtgactttattataaactgacttttgctaattttaaaggttttcatgttgtttttctttcatctttttggcaactgctttctcctcagtttttttacagctttgatattgataaaataaaaactttagttagcacagtttatttgagcaaaaaaaaaattcatgaattgggcagccctcagaaccagaagagactgagacaactctatctaatcagccaaggtgggcaggcaatatttatagacagaaaaagtaagtgaggtacagaaacagcttgattggttacagctcagtgtttgccttatttgggcatggtatggtaatgaatatgccttatgtgaaaatgatgtgatctgttggcagctaagcattgtctgaaactcagctgctatgattgactgaaactcagctatttgttacaagattatactcttaagttagcttgcagttttcataattaattatgttgtgggttgctatgtagggattcaaagtacagaagcagctttaagccaaatgtaatttaatataattatatctttatttgctatgtagccatctttttttatttctactcttctctccattcattctggaaaatgaatggagcacaagattattaaaataatgtaatgctatgtatatatgaccaaatttaatataaaattatgtttttttaaatattcacaactttctacttctcaaacccttctatcctcaattttaaagaacagtaaaatcatttgtatgagagagttttagaactagtaagttacacttgacttttgagactcagttcataatgagtaataaggaaaatggcagagaaatgctgatcagttagtttctcaataatcattagaggtattgtcaggattttatctatggtctaaatttccaaatgtttaacaaataaggatgaacattttagctactcttgagaccaacgaatgcattaactttagcctcattagatcccaagttcataccactgcagtgtgtggggttacaaatcttgtgtgtcatcaacaaggcctgaggatgtccacatgggcaggacaggaagagcagaaaaagacttctgaaaaaagaaggaaagaaggcaaatgagaaaaggggaagatgagagacttaaaaaatgcaaggggttccaaattttattgaataatatgaaagaaatgttttcaaagaaaagaatctttataaaaattgctagtttttagttgattgcatttcttttgtgaagaatagaggcttattattttagaatactagatgtataaaatcataattatgaaggttcacatataccacaactgtcatacgttacaacacaggaagattattttaaagaagcaaatcaacaaaactgttggcaacagcttagcaacttctaacaaagtgaattgctaattgtgacttcttgatctccttaaatttggttataattaaaagtatattcttattatttacaaaatcccacactgcttctatctatggatgtccctcctatagggtcacacatttctacaactggtcataaagtctcaatttttttttaagtaaatatttgatcacacacacaaaaaaatgtatgagaaagtgaggttgtcttttacataagtaatagtaaatattacctggtgtcttgcagaataaattaagataatttgggatacacaacctatatatctatctccctcaccttaataaaggaggccaggagtattgtatattgctattcacttagatctttagagcttattatgatacctggtaaataattagtgttcaataaaaatttaatgaacaaataaaaaaaagataatgactcacaggttaagtgaataattttgaatgtccatgttttaaatgtaaccttattaaaaactttgtttgaaatgtagttcttttcctttggtgacaatttacatgttaaattttaggaagtacaacaaagtttatacactaaatattattttaaatcacaaatgactgtaatttttattatatttatttgccagtgtttgggctaggttcacagctcatttgaaatcatatatttacattatttggtatgtcagtcttataaaatgcctgcttaggctttttaacatatcaaataacatatcatgtattttttatctaaggaacatgcaaatctttgttgaagattctcatagaagtaaaatatatcacaaatgttgacaactatatttttgcttagtagagcaataatagtaatccaagacttatgaactacaaataaatatattacatataaataattgtagttcattttgccttttccttaaaattgtgattgaagaaaataataattaattgcattattcaagaatttgtatcacatctttattttgaagaatggtgtaataaggtgaaatttcagaaagttgtaataaattctcatgttttattaatctaaaatatgaaaaagataaagatttagtaagaatatttttgttgtgaaaaaaatagcagtcgtattcaattctattttaaagttaaggatagtgctttaccttaaatttaagatgttagagaccaatttccttgtggtttgggattaacttttcttctcctatatccctaagcctagtcatgtagaagaaacattaaattcaggatacctcataagtagattgaaaggatattattgaaaaattggttttgaaaggtcttaagtaagaaattaatgttttctttcttactgaagtatgaaacaaagtaagtgtgagagagaaacagaaataaaaaatgaagcttatattacaagtattaaaaggatggatatttttccctcagaaaacgggatcagggttcaatgacaaaaatatttatacttatttagaagcaaaaatcattgctcttgaatttttatcaattaggtatttgataatggaaattccagaaggtgcctttagttgaatgttttatgaaaggattaaagcgcctgctttgtcaactttttttttaaggtctccttttttaagtatcctagaaagatagataggttaggcatgtcatgtgtgtgtacatgcatttgtgtgtgcatgcactcttgtgtgtgtgatagggatggagagaaaatgagaaagagttgagaggattattctttaaatcatgttatactcagacagctgtcttcatagaaatatgatactttaattaaaattagcattcccttcttgtcttcagtataccttgataacaaaaatccttttagatttttggttgagaaagatagacaatagtgtgaaatttgtagccatgagtatattttgaatattttccggtaatacagtgtatcttactgggcagaaatgactataaaaggaagaaaatgtatatcaagaaaaggaaatgacaaggtgttattattttgaattatagtgtgaaatatttgggaaccaacccaaatgcccatcaatgttagactggataaagaaaatgtggcacatatacaccatggaatactatgcagccataaaaaagaatgagttcatgtcctttgcagggacatggatgaagccggaaaccatcattctcagcaaactaacacagaaacagaaaaccaaacactgcatgttctcactcataagtgggagggggacatcacacaccggggcctgtcaggggatgggggcaaggggagggatagcattaggagaagacctaatgtagatgacgggttgatgggtgcagcaaacccccatggtacgtgtatacctatgtaacaaacctgcatgttctgtacttgtatcccagaacttaaagtataataataatacaaagtaatgaaaaagtagtaggaatattgatattggagaaataatgacagctcaactttaatgttcagttgattctaacactacctcttgtaattaaatgtatttcctttttctatttaatggtaaaaatctacagtcattatgataataaacttgcgcccacatcaacttttcattttacactttctataatatttgaacaatatgattcaccaattttctgtttatagtatagcaacttaagaacttttaaaaaatattcatgagacattttcaataagattcatttatagcttcatttagacctgtgtctcatcatatctttgttgtctccatttaaatttataatattccattaccattatataacacccttctttgtcttttttgaccattgttgatttcaagcctgttttgtctgaaattggaatagcaacttctgcttttttctgttttccatttgcttgacagatttttctccatccctttactttgagcctatgggtgtcattgcatgtgagatggatctcttgaagacagcataccactgagttttactattttattcaacttgctattctgtgccttttaattgaagcgcttagcccgtttaccttcaaggtcaatagtgatatgtgcagatttgatcctgtcatcatattgtttagcttgttatcatgccagacttcattgtgtggttgctttataatgtcaatggtccatgtacttaaatgtgtttctgtggtgattggtaatggtctttttttccaaatttaggaccttttaagaacttcttttaaggcaggtctggtgctaatgaattcctttagcatttccttgtctgaaaaggtcatatttattttttgcttatgaagcttagtatggctggatatgaaattattggttgaaatctcttttctttataaatgctgaatctaggcctccagtctcttctggctagtagtgtttctgctgaaagttctgctgttagcctggtggggttccctttggaggtgacctgccccttctctctagctgcctttaacatttcttcttttgttttgacattggagaatctgatgactatgtgtcttggggatgggcttcttgtatagtatctcatagggattctctgcatttcctgagtttgaatattggcctctctagcaaggttggggaaattttcatgaatgatatcccgaaacatagtttccaagttggttgctttctttcttctttcagtgaattgtagatttggtctttatacattatcccatatttcttaaagggtttgttcattccttttattcattttttaaattttttgtcagatggagttattttagataactggtctttgaactctgagattctttcctcaacttagttgattctgctgttagtatttggtgattgtactataatatccttgaagtgagttttcagctctatcagatcaggtttttttttttttttcttaaaataaccattttgtctttcagctcctgtattgttttattgtattccatagattccttggattcggtttctactttctcctgaatcttgataatcttcatttctatctatatcacaaattgtatttctgtcatttcagccacttcaggcaagttaagaaccattgctatttctggggtatgagtgcagttgtttggaggtgagaagacactcaggatttttgagttgctagagttcttgcattggttcttactcctctatgtggcctgatgttcctccaatatttgaagttactcccctttgaatggctttttttttttttttttttgcttttctctcctttgatgctcttatttggtataaggtgatttcagctgactggctttatttctaggacatttaaggggataaggcttagctcagtactcctgggctgcatcctctaactctggggagttggtaatgtgctcttggctttgttttctggcccctagaggttaggaatctgttgcattggagggtctgaggtgttccccatctgctgacgaaaacactccgatggattgtgccagccaaagccttcaccagggtgctggcaggatgatctgtgcttgcttgcatgtgccagcaattgtgacactgtagtggggtacaagcacatttcctgtggtggggaagcagcaggagcagggtacagtgttcctgcacatgctcactccagcggcatggtatgggtgggttatggttgccagtgtccatgcttgcacttgcaccagtggcagccatggcacggttgagacacaggttatcacttgagacaccagttgttgcggggctgctggcctccatgcatgcatgcacattggcagcagtggcagcatggagagacagggctgatggcatctgtgtgcctgtttttgccagcagtggcagcctggctaggttcccgtgtttgagcatctgaggtgatgggtggcaaggagcactcacacatccatgctggcgggggagggaaggcaaggacgacctgtgcatgtgtgctgacaaagtggtgtggaggtggccatgaccaagtgcctaccaacaaagctgtgcaggggaggctgtggtagaaggaaggtgtgagtagacacacattggttggggccagtctgctggagctctctgatagccaggtgctgtctgctgtaataggtgctccgccgaggacctccaggaagcacccaggttggacatctgaggctacaagtgggcatggccaaggtggggccttgggagaggatagcagacagggatcactcagatcagactggctccatcacatgtgcagaaccaccctactctgtccaggcctggtggtcaccctcaggctaaagtctcctaaagaagcatgaaaacccttgggagactggagtccctggctgtgctccactacagacggtcctgctccacgtccagacagtagcagaatcaggctggagttctgattctgctacctatctaagcagctccctctgccaacccaagtgtctgtaggggttgtggggtctcctgctaccaggatccatgaggttcattgtgagagcatgccactcctcagctgttcagctctccgcttcccctggagttgcaggaggccaggaagagttcctggtgcttggtagccttgtgcaggatacccagctatttcccccttccgcccagcatctgtgtcctcgctccatttactttcaatgccttctctttgaagatttgctcaaagtgtgcatttaaaacatttttaaaaatctagtttcactttcagtcttatcacttttaatttctttgctgcacttttgctgctttactctcttgattaactattttgtaaagtgtcatatgagtgtattactggggaataaacagataacacaactacacgctttgctgtttgtatgtgaactaacagatgtgcagtgaccaaacactggcagattctgaaagaagtgatgcgattggtcattgatcatgatgttcctattatttgcattataatttgtggaatggagtgttagcagcaaagtttatgctttgttcaattttttatagttgatatactgtggtaactgaaatttaaattttattgttgctaggctggcatcatttaacttaaaaaaaaaaactagtaagtgaagcccatccatattggtagcaggcaataaaaagactacttgccctacaaagtcacaatgatgacaataacattcaagaataaagaaatatgtcaactgaacagagtcaagacagtgacacatatgtatataaatcaaaattaagctacaaatgaagtgacactttaaatcagtgggcagacataacctggtcatcaaataatattaggaaatctgtaccaaagaggaagaacgactatattatactcttctagggaataatttacacaataattaataatacaagcgaggataaaacctagaataatttgaaagaaaatgtagacaaatatttttatgatctttgcaataaaaagttctcaataaccaaaaaacaaccccaaaacaatgcctagatacctgatcatgaaggaaagacagatttaactatataaaatgaatcatttctttattatatcagataagtgacagactatattacagaaaaagaaatgtcattaataataaaaagattgtataaaatacagtaagaaaaatcttataagttgattaagaatgtgcaagagaaacaaataagaaatttgcagaaaaagaaatatggatggctaatctttgaatagatttttaaactcattagtaaatcagaaaacatcaattaaaacaataattaaaacaataattggatttttttatcatcgaagtagccaaagtaaaagattaattatcactcattttaaagaaggtgcacagataactggcattcttatgctctgctagtgagagtattagtttataaataaagcctttttagaacattcatgacatcattaaaatttttagcttatatatattttgcctagaaattccacctttaggactttctctacaaaattaattgtgcttatacctaagacaaaagtatactgcagactacaaatacgaaaattagcatttcatcctataattttttttatatatctgttaacctttttctcaaactaggctttttcatcatcctggcctatctgaggataatatatgctttgtcaatattgttcttttcagtcaaacatcttctaattatatgtctacacatatagtttattcaagaaaaccatcaaaagtgatgtggatagtattacaatgtgcacagtgctcaaatataatgcaatattttttaaacaaatctcaggtgtataatactgtgtttcaataacagcatttaatggaactgtatacagagtataactgagagtgtttggaagggataattgttgccactaattaacaacggtaatggtgaaaagttattcttcactacttttattttctcatttctaaaacaaaaataataaaaccttgcatgcatgattttttaaagattgaataatatttataaagtggtaagttttggtgatgataagtagcaattgctattttttatcttaaaagtcattgggttacagtatatataaacagactttgcctatgtaaatgatcgtttctattataaattggtgcaccttcaagatagagaagtatttttaagggaaatgtaagaaaatatgtattttgatttttaatagccttgacaaaaatctcctcataaatcatttttattctagtaatttcttttaagaaactatcctgttatatagacttctgtgaaaaatcagtatatgcatttcctcatttatattttccagtaattgaattgcttttaaaaccctcacagcaatttttattagtgtaaatcactgcatttaactatttttatctttttgagctcatttttggtatacacatgtgcagcagagcaaaaaaattgatatcaagttgtatataaataccatatattagaacaagtgcaaatatatatcctagtagatttttaaaaacaatgttttggtaaaaatatacctatactggaaattgggataagaggacattaaggtttgacactcctttaaaataattaaagcaaaaacttccatgtctctatgttaactttatatatcttaagctacatttctcagtatgattagcttgagaaatatttcatttcagcttgacagactactactcactacctattacctgttctaaacatagaagataaaaaagaaaacaaaagaaaaacaaattcctggtttcagaattcttgcagtagcaaggcagatggataaataaataattaagaaactgagtggcatatgctgaaactgaggtttgtacagggcacagtgttgggaaaagggagtggtaatcaactatacatggagaagttagggaaagctttctatgtatttaattcactacctttgtgttatgctaaataatcatctcacactccttgattaaagtcaaatagacataatgtatctagacagtgactaggcacggaattgaaccaatattaaagaaaattaatttgtgggcatgaattttagagtcatgtactcacctgtccacctcacctctctctccaattttgtgtcttgtttggtatgtaaatttcacatgttcaaaaccgagctcttgacattccgctcctgaacttactgctttgtattcctctgacttccaaaatgatctttctgtatgtcaggcaaagaaccatagggtctttgcaagtatgcttcatgtgcatgaaatgttcgtgtcttggatattcacagctctctccctctctcgtatagttattcttgttttgcttacctctgttttctgggctacgttttatttttatgttgttatcatttattttattccttattatttctactttagaaaatgcctttgagatatctgttttattaattggcatacattttgcttttcctgaattttttgactgtttaatttttttgcatataacaaaggaaaccccagtattaaaaacacgattaaaattcccaaatgaaatgaacgcgaggtacctaagaaaacattgttctaatgaacacatcattgggcaataggagaacaaatttcctaggaatatgattttataaaataaaataaagtttacagacaacgtaattctctttagaactattagaagtgttatcaaatacatctgtaacagtatatcttgtgtaattctgttttctattaataattatatcaaagaagcaacatatttggataatcaacttatataaaaataataaaagtaaatacaaggcttcagggttatataaaccttcagtaaattataaacatattgaatattaaaacattaaaaactaaatattactttcaataattcattcttattacaccaatttcacttggataattatagatgtagaattaatggaatttaagaatctgttatgcaagattactgcctgtccacttactgaaactgaaaagttatgtgacttaggtctcagatttctcacataaagcatggaaataataacataatgactttatgaggactacattggataatgcttgtaagattctctgtttctttagtgctgggttaagttttaacaaatgtatatttcctgaagagcttagattcaagttagacatatttttaaaaatatatatctaatttttggtagagttacattatagtttattacacattttatcaatttcaaaaggggcaggcaacatatctaatacaatatttaaagtatagtaatctgccgggtgcagtggctcacgcctgtagtcccagcactttgggaggctgaggcggaaggatcacgaggtcaggagatcgagaccatcctggctaacgcggtgaagccccgcctctactaaaaatacaaaaaagtagccgggcatagtggcgggcgcctgtagtcccagctactcaggaggctgaggcaggagaatggcgtgaacccgggaggtggaggttgcagtgagccgagattgcaccactgcactccagcctgggcaacagagcgagactctgtctcaaaagataaataaataaacaaataaagtatagtaatctaaaaaactcaagggaagcaatatcttgaaagacaattcttaaaaagattgttccattaatttttaaaaattcaatggcataagggataataaattcagctctactggtaaattatcacattaataactagaggaaaatataggagaagtacgtattttacctcataaattttggttgctagttatttgaagttgtttaatgattaatgtcctgttctgtaatataataatctcaacacaagaattgctttaattgtcagaaaatctcattttaaaggcacttgatatttaatatttatcaacctcccactgtacacctggttatgtcttagacacagggagcacaggtgaacaaaacaagagtagtctctgtgttcatgagatttaaactatattaaaagaatttacacaattaaatataatattaaaactgtaatataggaacgtctcttggttattctgacgttgagactaaaatatttccagccactgtttcatagaggactttgtagtacttgggctagcttaagaaataaaaatgatataagccagtagtgttactttcaaacaccagtcttagactgttgataatttgggaaatatatagttagctcattgcttatgttatgacaacatttggggaaagatttcctgaagtatgtgcaatattttgttttgtttagtttagcatatacattgatggcaagtattctgcaaaggacataagctatatgtggggtgaaatcataaaagtacctctttccatcatcctaataagtctgtgaattgctttctacttggccatgtttgcactagtctccaatttttacactgtacctcacctaaacatatcactaggattgtcttaaatgatatatattttactttttgctgtaccgaactactaatcaccatttataccaactaattacaccccaaggcacaaaggggagtaaacttaattagtctgaaaccccaacagtgcagacttgccatctagtgatgacagaaggtaactatagattacaaaaactgtctacacatatttatggaacacttactttgaagcactggcaaagatacaaagatgagtaagacacagaatttgacccaaggagttcaaaatacagtgagagggagaagacacaagcagttacgtttaaggcaaaaacattgttaaatggcagaaagagatacatattacatgccaagagaagggcagaaagatgatgaatgaactctgattgaatagatcacgtaatttcctataatacacatatggtattaatgactaggatactgggaaacaagtttaccaggtacaaatctatatattgcaattaaaaacttgtgaatttggggaaagtttgtgacagaaactgagtgtagaaaaagtggaccacggagggaacaccattagagaagaaaccacatcatattcctctcatttcactagaatctagaatagtccctgattgatatctacattaatttagttaatatttgtttgcatgttaattactgcaaatgtgagtaggaagcatgattataaaaaatcttgaaatatatagataggaatacttaaaaactgtttgtatacagtattgaatattaatatttttgagactctatgacagatacttctaactgcatacccaatactttttatttccttaataacagaatcttatgtattttcagagcagcacatttaaggaaataaacttctccactttttttttaattctaggatagtaaaatgacacagttctggccaaggagataaaagcagaagtcactgaggggtgtttataggaggccctttaaaagtctcggatggggatgtctttgagctcccaaaaccaattgcgagcatggagagttgcattgctctttaagaatggtagagcagaaagctgaaatgagaccagcttcctgatgacattatggaaccatcatagcagccttggactgccagattccaaaattcttatttaagtgagaaaaatataaccttaatttttctaaagccattttccccaggcttctatcattggcagccaaacagaattctgaaattatacagacactgactaaaaagtcagaaaccattgtaggtagcaaagcatagattgaattctgaggatgtttagaacaagaaacttgctaatatcatattgccactgagactatatttaatcacacttttaccactgttgggactgctattctcctcatcactcttcaagtaaaacactatgcaaaatccatgtcaagcaccattgtttctatgatgccttacctaacatccatttagaattaatccctctttgtgcttatcttgctcagattactactataatacttataaaagtatagcaggcagtgtgtattgcttctacaaccctagactaccctggttaatagaacctcctttttttttcctagaaagaaaatgtatgtctgccctgggagcgtggcatggttgatctaaactaaaaagagctatcttgtcctgttttgatgatatttgttttctctggcttctgtgcataagacccagttctccccagtaaaacaccaggaagagaaagttggcttgagggttcctagacatgttttttttttcttttcattgataaaagaagagagcctttgtagaaaatgcactttgttctttcactgtcttgcttcgcttttagatgaactcctggtgcttgaagctacatcatcttgagaccatgaggcaataaacctaagcatgaaattaagcatgtcactgacgggaaaattctgggtcatgcttggtgaatcaaagactgaaaccatctatctctggatttcaatccttgcattaaaatatacctcttattgactaaaattactgaccaatacagaaagaaaatatttatgaaattttctcagtacaatattttcttcctataatacattatctgatattaacagacactattttacatacaaagaaagagaagctaagaacatcaaagtagcttgtctgaagttgcacagctatgaggtagatattacttgacttaggtatgactagtttcttccatttgattgaagatggctgtgaatactctctagccccactcatcaaataaatggattacaatttttaccttgatactgtataaataaatgatcagtgaatgtgaagacaggtaactcctttaatcatgattctacaagaaagattcaaggcaaccatttgtcaatttaaacgggtaagttttaccttttgtttttagaaacacagtgaatttggtcaggtgatagacttcttttaagtgttcttaatttgatatgcgacactctgcttttagtttctcttttcacaaccgaagttgccttttcagaagaaattacggaaataggagagtgaaaataggatttgctgcttttgacaaatcacctattgacctcgcaggttgttcaacagtttttatggctcttgggtaattggaaattcataaataactcaaaattattcatattaaaatgttttctgattattgattaggtcacattcctttaattttactgagatatgacttcttagaaggaaaataaatttacgttgttttctagagtacattttattttatttattttaaacaaaacaaaacaaaaagttttctaaggccttaacaaagctactccttttggttgaattagatactagtaaataagatttgttgttcactagaataatattatttgagttatgtatgctagttttctccaattattttaataagaaatatttaatatttaacaatttctcaattttctgtttttcaattaacactcaatgaaattagttaccaatattatcagatcattagattctccattttaacaaatttttaaataatgtcatactttgtttatatatttcttagtatacttctttacctaaagtttatttatttctaatttgatgaataaactgaaacttattttccctgttatgttataaagtttgtcataatatttagagaatcatggcagtttcagattttaataatccatataagaattactagacatgctatacattaaaactgtgtacagttcattagccggtttgaatgtcacatttaacctcagcctacctttgttcccatgcagagattttgagtgtaccactactatttgtgtaagcaagtaatttattgttatgacatctcttatttggaggtgaaaacaatgcagtgtggaactagttgtaagtggtttgtcttgttgcaaatttattgtatttttaggtcatacattaacatgactttaaaaagctcagctgacttatctgattaatatgattgatataaaattatgtcaaaaaaatgtgttgcaattgggcagggcgcagtggctcatgcctgtaatcccagcaatttgggtggccaaggcgggtggatcacgaggttaggagttcaagaccagcctggccaacatggtgaaaccctgtctctactaaaaatacaaaaattaacagggcatggtggcacctgtctgtaatcctagctaatcaggaagctgaggcagaattgtctgaacccaggaggcagaggttgtagtgagccgagatcgcgccactatactccagcctgggcaagagagcaacactccatctcaaaaaaaaaaaaaaaaaaaagagttgcaattgaaaaatggtcaggtgagaagtatctatatacttacctaaagagcaatacaatactttaaaaaactctataatagctaggttagaacaaaccaaaaattaaaaatttagaataaactgtaatatttatgaacattcaattaattggtgcttcatttttagaactccttcatgtatcatatagttacgtagtacaattctgctctgcagagtaacatacttactcttaatgtgcttaaattcagagtaaaattattttgagaaatgaaaattctagtataaatattaacatatacaaatatctataagctgtaagtacatgctattttccctgataattttataaataagaatgtaaaataatacatgaaaattggataattgtcattttttcagacactgattatttcattatgcagcacaagttgagtatgattatgtgtgtgcatgtgtgtgtgaaacatgcatatattgtatgtttggtacacatgttgtgtattcatatgtttataagttaacataagatgagaaagagctctcgctgtctctctacatagcgagatgtttgtgtgcatatgtgtgtgtatatatctaaacagaaatatgccatctttttacctttgaaaaactaatatgggcaatacaaccttgtccagttaatttcttcaatttttttttagttgttgggtaacactagcaaacattctttaaataatctggtttataccagtggtttaatgaatgcatttttggtactagaatgaaatttattgcaaatgagcgtttatctaccaatcagtagttaatgaggttgtaaatctgatagttgttgtgattgtttcacatgttgttaaaccattaataaggattcataaaacacagttgaaagttaagttttgtttatagaggctatcattctgaaaacgataaaagagtcattcactaaatttactaagtaagcaatatttcagacacaaattaggggagtctaattattaggtacaaccaagtaatattattatttaggaagatcaaatttggcatgtcaggccttttggtagcatactaattggcatagttacacttggttactaattaattggttttacactagccgtctgtaaatacagtgtttcccagaggggagaggagaggaaggacaccaactttatttttaaatgaacatttatttttgtgctaatgagggtgttcaggggtacaaatgacaagacccaactcaaagggtacattaattgcctcacatagtaatgcagagagaggacagatttgagagatgcttgacttctttgctcaattattttatagaatgcagggtttttgcattttcccactttgtttcagtgctttccatggttaatgttggtttccttctcaggtcaaaataagagatcgcatctagaaatgataatcctcctccagttgaggcagattttcttagaagcttcctagtataccaaccttcatatcacactgaccagctatcattagaaagaaataagcaatttccaagattgacttagacccgtcatctgaggtgggatgatggttgagaagtcaacattaatattcagcataatccacctttaaattttgtattatattagtactatatgatgaatgtttaatctttgggcagccagttctttcatctggatatttacaattttatttctgaatcaatctgaaaaatgaccgcctgaactatatttggttccctactagaagcacagtgtaaaaatgagtaattatgactgggcacgatggctcacgcctgtaatcccagcactttgggaggccaaagcgggtggatcacaaatcaggagatcgagactatcctggctaacacagtgaaattccatgtctactaaatatacaaaaaattagccgggcatggtggcacgcacctgtagtcccagctactctggaggctgaggcagaagaacctcttgaaccaggaggcggaggttgcagtgagccaagattgcgccattgcacccagcctgggccacagagcaagactctgtcaaaaaaaaaaaaaaaaaaaagagtagttatgttaagactccaaagggtttgagcatagtgtaaaaatgggtaattttccttaagcctctcaggaaaggagttccagtactaagccaaaacaaaaaaattgtgtactaaatgtatactagagggagtaaaagacaacctgaatgacatagaataatgcatgcaaggcatttatagactttctttgattttatatcctccattaattttgaaaatcatcaacttacactgtcataacatattaaaacttgaacaatagttatacagctgacacagtaatgttttgatatgcttgtcatatttacagtggtcacaatttcaatttttcctttttctttttttttttggtttttgttttttcatttcactgtggtcatggtgacccgtaagccccagatctgtttgaagaacatatttcgttgaattacatttgatttaatttcatgttttcattgaaaaaatccacacgaaacagccttaatgattttaaaatgttgcataatgttatttaaaacattatccactacatttttgtaaagcgcaagtgaatacttacctttagagttaattgcttgaaaagctttgctacttctgaggctgctgtgtactttttctgtattaattaagaagtatgtgacaggaatatggttctttttgttttggttgtctgaagttttacagccaaatttaagaatgaaccataatttttataaataaaattaaagcttgtaaaacattttatgttatttttatctcaatcttaacattcggatttgggttctctgtggttctgctgtttctaaaaatattttgttagacttgataaaattcctacaaactgactcataatttagtgttaaaagggaagaggtagatagacatagataagcagatatattttgcattatgtaaattatatagttaaattgatttttcctaggctggtatgtaaaaaagtaggaattatacaaatatttgctattattatcagtggctaatttgaccaacacttatactgaactagcctatgattatttttatttgtactgtaaatgcagctacagaatatatcattttattaaaattaaattttagttgctatgatacttgagagttaattacatttgtgatatgctctattgggaatgcaaaatctcatatgaggcaaaaccaaaattagaatttctgttactctcttcatagtgatccattatctaactaacactatcaaggatggggttttgtgagtgacaatggggtgtgaaagaacttatgaatttattcattctataattaatataaggtaaatgaacacatctttaatatatcaagatctaatatggctccagtataacttttaactaagtttcatcataatgtatcataatctattttgatataactataatgagatgaggcttgaatatcaacagctatatgtaatattcacaacataaaatttaaaaaattagatctgaccccaaagcctatttttaaaaatttattcttataatgattttttttttttggagatagcatgtcaatctgttccccaggctggagtgcagtgatgtgatctgggttcactgcctcttccacctcctgtactcaaaggattccccccactgcctgccaagcctcccaagtagctaggactacaagcacacaccaccatgcccggctattttttaatattttttgtagcgacagacttccaccatgttgcccaggcaggtttcgaactcctgggctcaagtgatctgcctgcctttgccttccaaagtgctggaattacaggagtgagtcaccacacctgaccatatgaatgtatttttgtacaggaaatgtacaagttgaggctgggtgtgatggctcacgcctgtaatgccagcactttgggaggccgaggccgggggggtggggggacggcaggtcacaaggtcaggagttcgagaccagcctggccaacatagtgaaaccccgtctgtactaaaaatacaaaaatattagccaggtatggaggcatgcacctgtagtcccagctacttgggaggttgaggcaggataatcgcttgaacccaggaggcagaggttgcagtaagctgagaccacaccattgcactccagcctgggtgacagactgagactccatctcaaaacaaaacaaaacaaaacaaaaggataggaaatgtacaagttatggctagaaattctgaatatatcgtaactacctttgataagacaaacagaaatggtgtattttttcactgaattatcacagacaacacagaacaatactggtaatcaaacaaacattaaggcaaaattgaataaaatatattaaaatgtggcaactattaatgcttacagaaaagcaagcacatatggaagaagaagaaatagaggatatctttgaaagatttttcttgggaacatagcactgaattctaaatgagcagatctgactttgatttgaacatttgtgcttatcagcttttaacctttgtggaagtagcagaggctctctgagcatgatgctcacctggaacatggtgttagtttctattctttcttcgcacaactgacatgaagaacaaatattaaagagctttatgaactgtacatgtaggacttagtcttttgttctttttgggttaattaaggagtgaaataaagactgggagtagcatctcaggcctcataaacaaaacatggccgttgatactagaacacagatacatgtactttgcccttattttagaaaactttttctgtttgagaaaaattactcatgacttaatagttatggcaggcttccagagtgatccctgaatattcatatactagtagttgtaaataatctagaggtcctggaattcctgtgctattttatagtcatgacttggagagatgatataaataagcatgtagatatgcaataagctatatgtgtgtgtgtgtgtgtgtgtatttagtatagataattttccacatatgcccataatacgtacatatgtgtgtatatatgattttgtgagataacactttaagaaatatgaagaagaaatgaaagaggaaaagaaagaaagtaggttgatgaaacctatgagccattaataagaagaataatgatccttacaagtatttgatccactgaggaaagagaagaagctgttggattaccactgtcttttgcatcggctccttaatagaagtgatggcccaagacgagacagtagtaaggggtaaagagaaagaaaatttcaaaaagaggaagataaagggtttacatgcaaatgattaaactcatagttttatataaatcactttagtcggtgaaaaacattatctccctaatgttatacataatcctcacctcagagataacataatgtataaaactagggataaaataacatgcaaagactgaaagtttatctaggtatagaaatcatacagataactgagtaaacatcctgtaaatatttcagttaaataattacataatttttcaataaagaaaagctgtataatgtataacgaaaattaatagtcaatgggaatttggggaaagacaaagattacttcttgttttccagatggtaatcactaatattgtgtatcagtttttttgtgctacatgttatgaatattttatattttatttgtttattttgcatgttatttaatttatcaatatattataggttactaatattttgtgtatatatggcttacgtttatatagcagataatatatatggaaccaagcactgctctaagtgtttcagtaactcacttcattctgtcagcaatcctatgaggtagattcagatcaagaaaatgaggctcagagagcttaagtatctttcccaaggacgcacaggttaatatacacaaaggtcgcagtcagatgtgtaccaaggaaggttgaaaaccagcagcaggctcttatgacaggtgggtctaatcttggctttgtaatttgcaagatgtctaacctaggacaaatcactttatctctaaggggcttatttttctaaggtctaaataagtaaattgcattaaatgatctgtaagattgcttctagttctgttacgcctatgtcttggaatcaacggattcccaatagtaaaaaggatataatgaatatcttaattgagatagggtgagccagagagggaaaaataacatttaaaacagcatatgtttctaggttgcaaagtagaacagaagcatttttttgttttctattacaagtgatttgtaagtgattaagtaaggctgaggaaatgcatattcaattttattttacttcttaatccaaagcagactgcaggctccaggcagctgccacattagcattttgcaggcacacatataagttcaattccttataatcctgttttctcagtgctaaatagtcagtgatcatgaagtcatggtgttaccacaaagctaagaaagtaatgtcatgtcaatttacaacctttagaaacacatttctaaattaaatggaaagaatatgctaatgcaatattaaggctgcaactttaaaaatagaaagtcaagacctacagaagttatggttttcattatcatcattaacatgactgcatcacatacactgaatatattagtttttttttcttacctaacttgtaatccaaagtattgcacgtatctaacttaatattatttgggagaattcttgcctgcatttcatgagttttgtactttatacttgaatgcttaactttatttaaaaatgtatttcatagatacatatgccatcaattattaatgtactaataaaaaacaagcaacattatatactactagaccacacacaaaatttgcatagagagtgatgtcaaaatttgtatgtacacaaggatgtttttctccaatacaaaagttttaactgcctaattttgcttcgcagattgcttatattcttctaaatcttttctgtctttcgtactgtctcatctgatcattcagttcctcctccttattccttggttacccagccaattcctcattgtcatgtaacacgtactccagtttttttgctttttaaccactgttccccataaaaatttacctgctctatgtcctgtttccttgtagtttgttagatgatgaatttctgagtcagctgaagtagaaacaagacaatcaagtcacctgaagtgcttcgaaagaattactaatgcctactgaatcagaacttttaaaaatgattttcagaatatgcatttaagaaaaaaactcttcgtgttatgccagtgttttctcttgttaagaaccattttgctcagtgtttccatgacacttttattattactctttctgttattatcattaaagtattaataatcaataattacaatatattggcacttttcagttacagtagcattttcagaatactttgaggattttagtcccagagaatgaataatacgcgaatttcattcaggagcaacggaaagttacttccgagcacagggactcaaattgatgttcatgtggccaagtactaatgaaattcctcaaagtgagcaatttcattttgaagccagaaacataaccattatataaattcatgtcagcaaatacaaaaggacatttagaaacagatctttacatgctttatatgcagaaggcagatatagtgagaagcagcgtgtcagaaactttggataaccgttgcagttctgcctctgtggcatagtgatattgcttaaatcatttaaaatcactaagacccagtttctttttatacaaaaataagataattacactaatctctgagtaactgcaaaaatgactgatggatactgtgtgaaaatgtttggtaaacataaatgcaatttatttataagaatatcattggtatacatttaaatgtaaagaattgcgtatccaagatttccattttgtttaataagttcgtttaattaaattaatcttttcctcttcatcaaaaaaatgtattgcaccttttgatgagaaaattgtgcctaatattttttattgagacatctgtggaataatgaaatgagcaccaaacttgagtcagaaaattttcattgatacattaacatctctgaagctcagtttttgtatcttaaaaatgttgcaatattttctcacctaagttaattgcaagatttgaaataggtaagttttgtgaagtaaccaagtagagaataaaatattaattaaataagcacaacaatgaatctatagttatgaacaggcaaatattccgaatgaaagaagttgacttctagaaggacacttaacagagaaatctgtcctagttggggaattagaagtgacacttgagccaagatctgaaaaactgtacaccagtgagaatttgtttccatcatgagccaaggagatttccaaaatagtaacttatttgagatttaagtataattcttgtattagtctgttttcacactgcttataaagatatacccgagattgggaaatttacaaaagaaagagatttattggacttacagttccacgtggcagaaggcaaggaggcgcaagtcacatcttatgtggatggcagcaggcaaagagagagcttatgcagggcaactcccatttttaaaaccatcagatcttgtgagacccactcactgtcatgagaacagcatgggaaagagccatccctataatttaatcgtctcacacctgggttcctcccacaatatgtgggaattatgggagtcacaagatgagatttgggtggggacacacagccaaaccatatcaattttccctcaaataagaggactttttaagtggatagtctatggctcatttggtagtaatgctaaggtattctgggacttctaaaagcctcaggttgaggctgtcacccacatggtccaaaatgctagctagaaccaagccatcccaagtacattcagccagtaatggaaaaagagaaagaagacataatgttttactttaaggagacttctctatatgttccacaatatttcttactagatattattggtcagattttattgttagaaggacagctgataaatatcaaattcatactgagaaacgtaatggttataaggcaggtttctgttcattggggcagactgggactaaatacatagttatctgtcatatttgtcaaaatgatcacagaacaattttctgaacaattatgtggattattacatagaaaaggtgagaagaaggattgagagcaggctagagaagacattagggtatgtcataagtgactgttttagactcaacaatcggaatcagagggaacatagtcaaattcctactttaaaaagactacttcgctatttgaataaaatatttaatggagccatcaaagcctgaatatcagttattaggctattatggcagcccagacaagagagatggtagcctaagcaaggatggtggctctataattttttgatacacttaagagctatttaggaggttaaatctatagaactcagtattttaactatattaaatataaggaaagaagaagcgtcaaaaatgccttttgtgtgtgtgtgtgtgatggagcctcattctgtcacgcaggctggagtgcagtggccgtgttcttggctcactgcaatcaccgcctcccaggttcaaatgatcttcctgcctcagcctcccgagtagcttggattgcaggtgcctgccaccacgcctgactaattcttgtattttctgtagagacggggtttcaccatgttggccaggctggtcccaaacttctgacctcaagtgatctgcttgccttggcctcccaaagtgctgggattacaggcatgaggactacgcccagcgagaatgacttctaagacactgtttcctctgtctctgtctctctctctttctctccaattagacttggttatatcattagcaagataaagactattataagataatgcatttttaacttagtgagctcaacatggtacccgtgatttccaaatgaggataattcatttcttcctagcctttcagagtaattcattaactggtcaagctatccgaatttcaaattctgtctagtgttaaaaactctttatcataccccatagactacatggaggacagtacaaagtccattttttctcatattggcaacagtgtagaagtccagaatcaggctctactaattgaaagtccatttgatatagtgaagccatttcataattgctatgtcactatgcaaatgttaggcactattatgcccataatttattatttaaatactatccattctagttattaaattggtaatttaaattatatattatacataaaatatatttttcattaattaacttattaatgcggtaatcacagaattttccaactattatacttgttatgtgataaaattgtatctgtggctatgtaaaaattataatttctatctttaaattcatatatagttattagctctaatgtattcaaaatcttagggtttaaggccaggcatggtggctcatgcctgtaattccagtgctttgtgaagctgaagttgaagattgcttgagggcaagagtttgaaaccagccttggcaacaaagtaagactctagtctctgcaagatatgaaaaaagaagccaggtatggtggcatgcacctgtagtcctagttacttgggaagctgaggcagaaggattgcttgagcccaggagctcaaggctgtagtaagccgagatcatgccactgcactccagcctgggcaacagaatgagactctgtcctcccaaaacagaaaataaaaaaataaaaaataaatagggtttattactcatgaatgttcatggtcttgtaccaaactgtcatgtggaagaaaggacaacatagctctgtgaaaatgaagagagaagaaaagaggaagacagagaaaaggtcagataatcacaattgaaggcacagtgggagcaggaaaaatccagactgttctagcaacctttagagcttactagaaggaaaggaaacaggagtttgttttagaagtgatgaagagatagttttgtttgattaaaaatggaatcctattcaggaaaactcacatgagaagagacaagatatgatgtgggaccagaccccagataatgaagcaggagttcatatcccaactcattaggaacactaaatgaaaaatgtcttcttctttctgccagagatcttggaaaccccagaaaaactttccctattgatggacctcgcatctaccattagataaactgcaaaaattatagaggggtcagatgtaattttggcatgattatttaagggctctttctcaacaattttaaatcttctaagttaaagagataacctaggagaactgcagctactagatggttggaaattatgaatttggatgaataaacatgatgggtatattacatacaaaattggtatgaattatttgaagatttaaaagtttcagctggtttggtttcagtgatactacaccacaactcaagacactattatctcaagtccatggttctagcaattattttctttcttctccacaaaacaatgcttaccttgtttctggacggtttatttgctcttgcaaggttcccacttaattacatctgctaaacccaatggcaaatacttagtcctcatgttcttagaagaatgatttgtgatactgttttccattcattttttgttgttttaggaaatcactttgtcgtgtttcttttttcctacaacatgagccattctttttttttcttcctttagatggctctgtcccagaccgagaggttaagagacattgaagactttcagtgcttagtcattagattattcctgttctctgtgctacctcacttccttgacatagaataccatcatggatgacttctacatttattgctccagacctttccttaaactccagatttgtgtattcaattgtctgcataacctcactacttgaatgtataatagacatctcaaaatggatacttccaaaatcaaactcaaaatcaaagtcaaataattttccttccagatttttatctcctcctgttagacttccccatttctgtaaatggcaactccacatgtccagttgagagttgtgcaagccaaaagccttggagtcattattagcttctctttttcttacacatcatttccagtgtgtcagcaaattgttatgattctacattcaaaatattttagattctaatcatttcccaccacctccaccactacaacccttggttagatgccatcacttctctgtatctttgcaataaaattctaattggtccctgagcttccacctttgacctgcctgccaccactcagtatgtttccatcacagtaatcccaaatcagattctgtcactcctctgcttaaattcttcagtgacttccattttttttcagagtctaaactctcacaatttacagaatttgacctgatcttggcccttgtttttaccttgaccacatcttatacttttattctactatctagctatgtttggtcaactctgaccttcccactgtaaatcaatccaggtcttgaacaggtcaaggaccaggtttgtttcccaccttagggcatttgcaactcccagtcccactgtctggaacatcttaccatggattcttcatggaaataaaccttattccaagctttttttctggtgccaccttctcagtgagagcttaagatcctgtttaaaagcggtatcttcactactcaatacttctggtcccttccttgcttaattttccttaacacatcaccacctgactctctaaatatgctatttatttatttgtttatttttgtccctctccactatataatgtctatatagtgtcagaagatggaatagtgtctcgcacatggttgacacccagtaaatatttgttgaatgagtgaataaatgaatgagttaaccaatgagacatttaacgaaatagggctattgctatcacatctgaagcagataaggtggaaaagccagaaagcaggatctgtttgttttcatgaaaatcacttttatgtgtttctcttcaagtaagggttttgttctcacacaaaatcttggtgttatgcatgtctatggttcatcgaaagatttggaacaggctgtgtgggattagtcagtcaatcagactgaagaggagctctggtaagtacatagttacgtgtctggaatgtgtagcctatacagagagaaggaaaaaaatgtatatatgaaaagtgaaggaactttctacagtggccaagttgtcacagtccagaggcctgggggctgtttttcatgaaaagaccaaaacaaagtgcaggatgctacacaaataaagaaaatgaattcagcaaagtcatataatacatgtacatgaaacaaaagcacaaagtcaaagaaattctatagagttcagagactaagattaacatcaaaagcagcagcagcagtcaactttgtagagaactatatgaaaacaggacaagatcttaaactggaatggctgatcttggggagaaaaatcagagaatcttgaagtccctgctatgttgtaatatattaaaacactatcgattatgtaaccgtacatgaagtgaacaggaaaggaaagtaaaaagacagaaacaagacctacaactaagaaatggtatagactcaactagcaactaaaacaaacaaacaaacaaacaaacaaaaaactagcaactctaggctgggcaccatagctcatacctgtgatcctagcacatttggaggccaaggcaggaggatcacttcagcccaggatttcaagaccagtctcagtaacagagtgagacctcatctccacacacacacacacacacacacacacacacacacacacacacacacacacacaaaattagccaggtgtggggctgtgcacctgtagtcctagctattcaggagcctaatgtgggaggattgcttgaacccaggaaattatagctgcagtgagctgtcatcacaccactgtactccagcctgggtgacagagtgagaccttgtcttaaaaaaaagagaacgaaacctagcatctttagagacaggagaaataagtgtcattaatgcaaatggtgtttatatctataattaattggaaaaatgtatacagatttactttacagtaaattttagttagaataatgtcttcacaaccaaataatttaaatcatattaaaaataagtactgtgtgacatttagcaaatttacctttttgtgactaatttcattcatctataaaatgggtattatgagctttaataatcttttcaattctaatattatataattatttaatgtaaataaagattattagctgtctgaaatatgtactttggagtagaaaataatccattaatatgcatttaaatacccaaattgtgccagaaactgaaagtataagttgaagtaaaatatgatgttatttaaatagaaacaactatggggacagggttataaacataaatacacacagagatatacacacataatatatacaaatgtatttacattcctgtaaaacatggaaatgcatatatctgtgcctttatatattaagcattatataccttcatataataaacagtaattgtattcattacacttactgaaatataaattgaaatttaatggctgggctgctggttggccaggtgcagtgactcacgcctgtaatcccaacacttcggggggccaagggaggtagatcacttgaggtcaggactttcagaccagcctggccaacatggtgaaaccccatctctactaaaaatacaaaaattagccgggcaaaggggtgcacacctgcaatctcagctacttgagagtttgaggcaggagaattgctcgaacctgggaggcagaggttacagtgagccaagatcgtgccactgcactccagcctgagcgataaagcgagactccctctcaaaagtaaaaaataaataaataaaaaataaacaaaaacaaacataaaaaacaacaaaaaaagaaatttaactagttttacctagttcatatagatatttctaaagagttaatgtaattttatggttacatttaccccactcctacaactcaggatgatgccatatgatccatatgcccaaaggctgtatcaaaggataaaataggattatttctaatttaatttagacagtcacatcacaataatttccacacttgcctcagtttgggtgctgttcatattgtgtttaatttcatgttgctacattctctttgagacataagtgttacagatatcttctgtagtaatgtagccaaataagattttgtggtgatggtagtttgtgtgtgttcctgtgtatgtgtgtgttgggtgtaagtgactttagatagaactcatatccttcaaacattgaaaagtcaaccactatttttattcagtttgcgtttttgtattatgttttagttactgtattcaaaatattatattctctctatatctccctgaacagcatattttattataggtatccttacctttaagtagtaataaatgttttcgacctagtaagttcctgttctgtgtgggaaacacgggagggagaagaaaagacacacacacactaccttaaagggtaaaaaacctttatcccatgtaaatggcaatgcagatgtaatgagcaaatgatataataagcagattgatataataagcaaatgatataataataagcagatgatacagtaagcagattgatatgataagcaaattgcaatgggaaagggagaagggaaaagatatttacactcaccagactatggaggattcaccaccagactgggaagcaacagtctcggctccagagttggccactcatgtctgtgcacaggcgaggagaggtctcatgaagtttcggcgcagtctgggaccctaactctttttgtaatgagttgtttcgcataaggtccagtcaagagggctctttgtgactgggctcaaggaacacaaaaaggtcaacttgtttttgtgattgtctattgttttccgataactaacatataggaatagattgaaatagagatttctctgaaacagtgctggatgaatgcctcaaggagctcacacaacctgtttcgggacttggtgactgttgtttgtgtccatgttcaattgagttcaaatttaatatttaactttcccttcacagtcggcctccatctgatactcaattgtaggaaaatacccttacagatacatagggaaggcatagtcgatatagattacagatacggggtaagcacaggagaattagaagcacaattaataaaataccacacccaccatggctttgcaaggagagtcatattgtgagaattgccagtgatatacacataagattcaatatgcagtaaatcacaaacccctccttgggctgcggtacgcatatctaatgccattcgattttgcaacataacagtacgcagctgagcaaattcatcttataacaacgtaagtccagtgctactatcattaagagctttttgtacgtgtaagctcaatattttaatttgttgctgaagcaggattgtaccggtggcaggggagaatactgtgatggggtaccaccaccagggggtctggtgcattcataatcagtgatgtttgtaagcatctagattactggggaggggactattatcctggatgttgaatgtaattaatggccaccctgaagtgcatctccccgtccaagtgggggcaggtattgccacccgtaggatccacgtgcccagagggcgcccagggaacaggaagagttctactataattgtattgctgtcatgtgtaatttaagtaacaaaggtgctgtgtctcatttgggtttgggcaaaatagactgtttggttaaaagaagtccaggttggattacaagtgttattatcccacccccattggtattggcatatccatccagaaatgttagcagggatgattctccaaggtagcccattcctgggggcctcccgcggcaactccacacatagccagtaccgactgcagttggcttgcgttgcaacggtggctacccagttgatgaactcattctcagcctaagacatgatgacccaggtactgattactagcagacaggttattctctgtaataacaaaaatggaggggaggatgcattatttttcttcgttaggaaatagtactatgccttcattttctgcccctatagctacaaggtcacaagccttaggggcaggatctgatggacactgtacccatattttggctccaagatttaagttgccccctttggtggacctgaattctccggttctgtatgttatttctattggggcagaaatttccttgggggttaattgttgacaaggtaccactaacaattgagcaacccgcatctgaggttatatagcaaaagaatctggagtggtattatataaaatgacctttaactctccctggtaatcactatcaattatatcaccatacattatgatgcctctcattgcaagacttaaacttattgtaatccactcatccacattcaagtttgcagttatggtgggaattttgccctgttgatctgcccgctgattaaatagtctgtcaagagaaagccgaagatgcatgagcatcaacatggaaaacagtgacaatggcagtgtgaggatattgctttttcccattaatttttcatattttaatactattagtttgaaaatgagcatttgatatggcaaagtatacgtagagtgtcaaattgaagtaaatgctgctttcattattttatcacaaagctactcgacaataaagaggaatgaagcactattgaatgttgtacctcacagtcatgctctgtaggaatgctttgttcattaaagtaatagttccagtaaagattcctctggggattagctggcagagtggctttatacacaggcatttttttttcataacaattcactaataaattatggataaaaatacagctacccaaagtgggtaacatcttagaggagctctgcaatgctgtgacatggtgagtgtatcaagaacattctcttgtttttttctattgccagatgtctagagtccctccatcctctgggcatcatccaagaagtctgggccaaagaaaaagaaaaattagaaatcaaagataaaatgtttactctctaataagttccagtttttaacgtactcgggctcctttatttagtcgtcaagccagtatataccaataacattgtaacagtttgcttcagtaataaaaatctattacagcatacagtggtaacatgtgttctaacatgtaattcctgacgttgagcttcactgtgtaatgaaatattaacataatttaaaatataatatgcaatcaagaagatgctaaaaggatagtagatagcattaaaataaactaatcattaatagtttattagtagataatggggtagattatgtgatatatataaataaacatctgtcataggacctgtcacatagaagccactcaaatattttgttgaatcaatgactgcttagactcctagctgaccatttttcttatttagtcatggtgattacattcaattttggttactatattcaaaaggttttaatctcaccaatattatctactggaaactaacctttcactaaagatgtccttaggcttctagaagcaacaccataacattttctcatcttcctgcttatcaggcagtgatgaaatttcctctgatactgtctattgaagagaaattttaaaagaatacatgaaacttaattcagaatttcaaggactccaaaccattctgtagaaattatttcagaaaccagatagaagttattcctctaagtgacattccactgaagtgatttttgcagagatcattataactattgttgctgctgagtcagatgactcttttcagtctgtaggcaactcaaacccatggtacattggtcaccattaatcatccactcctctcctcttaaaattatctcctttcttagtttcatggtatttgtttctctggtgtttctcttatgtctgggtatttctttttaccttcctggcaaaattgtcttctcttaatgacccctaaagtgctggtattctccaaagctctatcctcggttttcttctcttccttgacataccatttgctcaggtaatctcatttactcctttggtttaatggcccaccaatatatagatagctctgaaactggctagtccaacctaactgcgtaaactccacacccatgtagctaacttcttactagatatttatttgctggtttcatttaaaattccatgtctaaagtttaactcaatatcttaaccttaaaatttgtttctgtattttaatagtttaattacccattctgttgcccgtgtcagttaaacaatgttatcctgttccttattcacatatctaatagatgaatgaagacttacaaattttacttatctgatatttcttgaacctgtccatgcagcattgtattcattctcattgcctccactctggctgtcattatggtttgcttggtctgttaaaatatacactgttttcctaatctcaattttttaacttctaattcattctacttccaccatagtgaagtttttaaaagtatttgtcacccccttagaaaaattcaagataaaattttacttcttcattatggatgtgaatactcttctttgcttatctgtgctcttggcatctcccccacataccttttgctcattatactatgtctctacttaactactgacagtacttgagtgtgccatgttctcttacaattttatgaactcacagctgctactccctctgctcagaaagcctcctgctctcaccacttaacttggcaaatttctcaatcctcttgaaaatttaagtcagatgtaactgctatgggaaatcttctccaatcctgccagctttcttcctccaggcagccatccttcatacccatataaaatcttttctcttattgcaacattttatatagtgagtgttttaacatatttgccctctagcttattatctagcacttgaaatagtcaatagccattatggaatcttacttaataagtgtcatatcatataattccatgattatcaagaagtgcaaagaaaatgatttaaaatggcacactgccatacagcttgaagtgtattactttgcttagaaacaatgaacatctgatttttttgtgtgtgtaatgatggaaaataaagtagctggttggaaaataatatcccagccctatacctaaaaatagcagtggctagaataaatgaaatttaacactgtaaattttaaaagtgatatttttagaaaactcattgataaaagactagtcattggttttgaaattcttcttgatcgtgtataacgtttaaataatcaaacctattaaataaatcaattccagatgataaagaaacttgaactgaagttagacataaattagatgcttaaatacatacacctaagaaaatacaaaagaagaaaaagaaaaaaataatatgaatggagaaaccaagttgccccatcttttattttggagaacacagaaaaaaagccaaaaattcaagaaagaaaatatcaacaagaacagaaaaaaaggaaaagactttctttttcaggtaatatttggaaggatattgtgtagagagggtgagcataggaagagatgaggtgccatgagacttatatgaataggctgattagggtgaatcgataactaaagattttttttattcattcacttaacaaatatttattgagtatctatagtgggagtggatcacaaaaacacctaaaattaaacttgtaaatgataggttaagaagtaatctcgattgggtgaatcaatgatagttaagaaaatgattactaaaatagactaattccttaaaaaataaaatatcttgatttctttgaactcagagttaatggcctattcttttttagaagataattgcctttaggtacaaaacaatatacagtgaaatcctcaaaagttttttttccctatgaccttaattaagatctgcattgaacttttttttaccctttgtctactatatttttaaggaaataaatgcactaaatctgaactaaaaagtttcaataactagacaatgtgagctaatgatttaaattttgtacttagttggagctgaaagtgtatatttttctctttggtgaaaaaaggaggggaaataaaataaagagaaatgttatcacaattttaaaataacccatcaaaataacccatcaaaataacggagaggaaataaaataaagagaaatgttatcacaatttaaaaataacccatcaaaattaaggagaggaaataaaataaagagaaatgttatcacaatttaaaaataacccatcaaaattaaggagaggaaataaaataaagagaaatgttatcacaatttaaaaataacccatcaaaataaaggtttatgaatatatcaaaaatagcttctgcagatggagaaccatgttacatattcttttaaagcaacagatgggagaaaatagaaatttttcttagagataattatataaaaataaaatctagtttgcaacataaatttctacctatgtgtcctatgaagcaaaatttattgtagatttttctctgattttattccattatgaaccacagaaggaggaagagttccattactcaaggtttctaaaaacacaatagagagaaatacttttctactttaaaccctcattcacattatagcactcataccttgtagagttagattgcagtaatgttcactgacattctaaagtttttatatcagctctgcttttattgggcacagtattttctgtttattggtaatttgtggttgcattttaaaaatactgttctgttgataagctttcatgatttcttaatgtaaaattgaactgggtttttgtatactttgcctgcagcatctagatttctctaagaaagttttttattttaattcaaattgagtttttgccaatctcatataccactgtaagagaatggttaatgtgactttttctactatgatggcattatcttcaagaacacaaagttaaagaaaaaaatgcttttcagtacccacattctctaaggagataacattgacaatgggacagattcttttcttagaaaagtgaccactttctcaatctgtaaaataagaccagagggaaggcaagagatcaagtgacagggatacctaaaagtattacttattaaaagaggggatggctgaaaggagaagcctggaatcttaattcctgcaagagtagctgattgcccttgttgatcttccttgaggctgagaatggaaaaagagaatagtagagagagggcaaagtagatagagaaatgagggttgagcagccagttctcaaacatttcctgtgagtcaaatggacaatgagagctatcttgcctgatctaagagggttgagtgttaatggaggaattcccagaggcaactgaacaggaagtacctggaggtactgagatgttcaggagcatctcaccaggctttctctccaaaattctacgtgtatccagtgataaatccagcattttgattcattctatagagaggcactggtcagtaagaaacaaagaagcagcagacaaccaggagagagaaaattacaatcaaagatggtgaagtaatgaaaaatgtaccttcttctcttataaccccaggcagcacttaacataaagagaagtctgcgaaataaaggaaagcagtggcaccctagatgtataaccctgcccatctactggggttttggagtcggatacatgttattttaatacaaattacaatttacaaattaatacaaattacaatttgttatattaatacaaattacaatttgtattaaaataacatgtctccttccatgtatcttaacatgaattaaaataacaaattgagatatgttattttaatacaaatttaatatcaatgttttaactacttcaattttatgtattcttatgatgaatatcttgagttttactttttaattttatgttctaccaaaaatggtttcaaatgaacttatccaatattactacaaactatatgtatgaagatctgattaaatacacaacttttgtcattatgaaaatactgtgctttcaatcacttaaagcaatttttgtgtgatatcactatgctaatatttaaattggtgagttgtttatagttttttgggactttttaccttaattttatttataattatgtaaaacattattaaatacaaaacatctgagagtcagaaaccacatagcattatacatttaagaaagtcttaatccatccttgaacacttcttttttgatcactttttgacttttccttccagtggttactattataaatataaacaaatgcatgagcaaatgaaaatatacatattcatattttcttctcttgtacaaaacttggcatatagtaacaccattctgcactttttattttcattttaacacatatatattctgaagatgactttatttttgtattaaaaattattctttttataggtgattagttatatatcatacaggcatatgacagtatgtccaactagtcctttgatggtataaggttgggttaattctttatttttattattgcaaataatggtggaataaataaacatgtatatatgtcacttcctattttggcagtctaactttcatatggattcctagaagtaacattgttgattcaaaggtgactgaatatgtaattttgctagtggtgtccaagtccctttccaatttcaatctcaccatctgtgtacgagaatgtccctttcatcacagtcttgccaacagaacatgttgtcagaacttttatgttttgccaatctgataggtgagaaatgagctctcagtgtatagaaacagagaaattctccaagagtgagattgagcaactttcatgtttacaatctgcaattattcaaaacatgattttaatgtttcttatatcccactatatgaaaggaacacgatttatttaatatttttatttctttttatttataaccattaagaattttaaaggagcatgtattatttggtctgatattaaatacgttctcatgcttatgctcgttagtatttttactaatttctttatgtttaattgacaaaaaaaatttattggataaaacatattgtcttgaaatatgtatacattgtggtatgtcttaattgagttaattagcatatgcattaacagacatacttctatttctacattcttagcagttttctactctcttaggaattttcaagaatataatacatttttattaactatcatcatcatgttgtacaatagatctcttgaaattattccccctttttaattgaaactttcgaactttgaacatttccccaaccacttccctccctcaacccttgattctactctctccttctgtgatttttgacttttgtaggttccacacataagtgaaatcaagtggtattcatctttctgtgcttagcttatttaacttaaaacaatgtcctcccagttcaaccatgttacacaaataacaggatttctttcttaggctttggagtggagtgaataatattccatagtgtgtgtgtgtatacataaatatacatttatacatatatatacacgtacatatatatttatactacatttctgtgtttatttatcgtttgatagattcttaggctctttccatatcttgactattgtgactaatgttgcaatgagcatgggagtgaagatatgtcttcaacataatgatttatctcttttaaaaatgagtgggattgcttggtcatatggcacttctatttttaatgtatttgaagaacctctgtgtagtattttatattgactgttctaatttaaattcctaccaacactatgcaaaggtttccatttctccatatccgtgtcaacacttattatctttcttctttttaataattgccattctgttgagtgttaagtgacgtggtggtgttgatttacatttcactgatgattagttacatttctatgatgattagttattagtttacatttctctgatgattgaacattttttcatatacaggttgaatgtcttcttttgaaaaatatgtattctagtccacattttaattaggctattcattttttgctgttgagttttttgagtttttaatatattttaggtgttaaccccttatcatatgtatggtttgcacatattttctctcattttataggttgtccctttactctattgattgttcctttggctgtgcaaaagatttttagtttgatgtaatcccatttttctatttttacttttgttgtctctgcttttttattcctatccaaaaaaatattgtctagaccaatgtcatgaaacttttccctgtatttttctagtagttttatagtttcaagtcttacatttgaattttaacttatttgagttgatttttgtatgtagtattagatactgatctaattgtattgttatgatatccagctgtcccaacatcatttattgaagagactgtcctgttccattttgcactgttggcacctttgtcaaaaatcaattgcccataaacacatggatttatttctggggtttctattctgttctattgttctatgattgtgtttatatggcagtaccaggctgttttggttactatagccttgtagtatattttgacatcaggaggtgtgatgcctctagcttatttatttatttatttttcaagattgctttgtctatttagggtcttttgtagttctatacaaactgtaagatttttttctatttctgcaaataatgttattagcattttgaaagagattacattgaatttgtagatatctttgggtagtatgaacattttcatattattaattattgcaattcatgaacacagaatgtatttccatttatttgtttcttcttctatttttgttcaccaatgttttgtagttttttttagtgtagaggtcttaaattcatgcctgagtatttgatttttttggttagtattgtaaatgggattgttttcttgatttctttttcagagagttcaatgttagtggatagaaatgatactgatttttatattttcgttttatatcctgcaactttactgaatttgttacttttatttttttggtttttggtggagtctttagggatttctatatattatatcatgtaatctgtattttttttctcttgcctaactcctcaagctagaacatctaggattatgttgaatagaagtagtgagaatgggcatccttgtcttgtttctggtcttagagggatagctttcaccttttcactgttcagaaggatgttagctgtgtttaccatatatattgtctttattgtgttgaggtacattccttctaaatctaatgtttaagggtgtttatcataaaaggatgttgattttgtcaaatgcctttccttcatctattgagataaacatatctttttgtttcttcattctgttgatgtgtgtaccatatttatagatttgcctgtgtttaacgatccttgcttaccggaaataaatttcacttgatcatggtgaataatcttttaaatgtactgttaaattcagtgagatagtattttgttgaggtttttttcacctgtgttcatcaggaatattggcctataatttttttgtagttttgtctggctttggaatcagggtaatgatgacctggtaaaatgagtttggaaatattatctttccttcaatttcttggaagagtttgagagagagtggtattaggagtaggaaagattaagtgaaaggaaacatctgacttaaactacactttagaccaagtggaattagcagacatacacagggcataccatacaacccctggagaatcttcttaagtgcgcacagaacattctccaagataaatagtattttaggccatgcaataaaatgttacaattttatgaagattgaaattatatcaagtatctttcctgatgacaatatgaaactagaaatcaataatagaaggaatttgagaaaattcacaaatacatcacaattaaacaacatgtttctgaaaaaccaatgagtcgataaagaattaagagataaatttaaaaatatcctgagacaataaaaaatggacacacaatataccacaacttaaagaatagagcaaaagcagctttaagagagaagtttatagcaataaatgtccacattaaaaaagaagatctcaaacaacttaacattttcctcaagtcactagaagcagcaagaataagttaagcccaaagttagatgaaggaaaaaataataaagattagagcagaaataaatgaaacagaaactataaaaataatacaaaagatcaactaacttgagttgtatttttttaaaaagataaaattgaaataccagaatgaagaataaaaaccacatgatcatctcaatagatgaagaaacgtcatttgtaaaagtcagcatgctttaatgttaatggatggactagttatgactaacaaaagaaagaagacaaataaaatctgaattgaaaaaaaaattacaatggaaaccacagaaatacaaataattgtaagagactactgtgaatagttatatgccaacaaattggataacctagaaaaactggataaaatgcctagacacaggcaacctaccaagacttaatcacattgaaatatttaatattcagattgtttaactataaggtaaacagccaatcatgtaggctacttttctttatttttttcttttttcctatgtttttcttcaagttgattaatggaaaagtcaattgcaaaattagaaaaacaatatataagtaagtagtagatagtagatatgtcaccatacttaaatgtataaaaatatatttgaataacattagatactagaattataatttgtaattatcttacaatttccttttgaaaatttcaaaaaattaaatatctgtcattcagacttaaagaattagtatctacaccatgaatttaatatactgaacatgctacaaacaaaaccaactttctgaagcttagctaaaacatgcttatttaaatctactgtatggaaatattatatttaaaaagaacattccctagttgtatgaacactgaaaacagaaatgacagatttttacttactgttatatttgtttttctcgggactttagttaaaagtaatattaagttgcatctgctgtcaacagatgcccatataacagcaccaaaatgctaactccaacataaatgaccatctccatatgttgctggcatttttttggcatttgtgtattgtacataatcacaggctatgagtaacacttgagaaaaacaaagtgataatctcattatgaaggttcaagatctattcaaagctaagtagagcttcttgtttctcttaaatgtatttattagtacataagcataaacttaaatcatgaaatgatcatttttcaaaatgtttgctacagatttactgtaaatggagatttttatcaaattcacgtttcttatcactatgacaggggataatatacaaagctctatcttcactataaaaatgaaattttggataatatacaattgttaatacatagcaaatttgaaaaataagaaagaaaaagccacagcaaccaaaaataaagtgagaatgtaaaacaagaatggagagtcgaagttgaaactgaatgacctacatgagcatgggaattgtgcactgtgtgctgtctaggactcatgatccaaaattatgtggggatagtaatcaaggaccctggccttatgtgcagcagataggcacagttgtcttgttgataaatccaagaattgagaaaggatgacccatctccatataggattagaaacattcttcttcctagattgggaatgcagtatggtaacatgtccttcacttgagctgttcacctgggctttcaatgataaaagagccataatttaaaagtggaaacccttatactatacacaggtattgggacttttcgcactcatttacaatgctcaaatcctgagatgaaaaaacaacccatgggcaacccaggagaccgtttcacaggcagatataaatacaaatttaaatgcaaagccatttcaggggaattacattagaatctatggcatcaaactaccctttggaaacaacttctgtagaaggtaagctcatcattcaaaaatttttgtaatcagacaccttgaggaaaagtcagaagacacaaacaaaagcattcatattcataagaggtaaagaaaacagatcattctcaagaaaatgttttaaatgactgtgttttaaaatgaatagagaacatggtaagaacagaatcaataacgtaataaaaagaaaatctggcaaaggaacaagctagtttttagaaaatgtaattttaaaataagatacttctttagcattggatagaaatgctgaatactagtctatttagagctgaatttacagagaattcataaatgaaaaatagatttgaggaaatcctccaaagcatagataaattttttcagaatataaaattaaaattaggaaacaagaacaattaaatgaaggtttataattaatgtttaataggagttctgaagaggtgatttcaaagagataaaagtagcacatttttaggaataaagagagacattagaccacaaagatgagataaaaaccttaaaactgtgagaatgaaaatgcaaattacctgtaataggttgcaataagatacacagcacatattttcatgtaacaaaaaagaaaacaatgaaatattatcccaaaaagctgaatgtaaatattatccccaaaagctgaagttctctaatataataatttgattatgagaacctagatctggaaagtaagctttggaaattgagcaaaaaagattacttagaagtcttcaacaatttttcatcaagtcctattgaattatttttttttcttttagagatgcagtcttgctctgttgcccaggctggagtgcagtggcccgatctcggctcactgcaacctccagctcctgggttcaagcagttctcctgcctcagcctccccagtagctgggactacaggtgcatgccgccatgcccagctaatatttgtattttagtagagatggggtttcatcgtgttgcccaggctggtcttgaactcctgagctcaggcaatccacccgccttgtcctcctaaaatgctaggattacaggtgtgagccaccaaggctggcccctgttgaattgttttagattagctaaatgtgcttcaacattgtgaaatacaacagtttcacgaacacgaagtcaagtgacagaatttacagcccccaatgattcaaagattgaatttactgaaaggtgcaatttgctgagaaagaaaacaaaaccttaaaaacaactggattaaaaggaaatggtaaataagtcctcaatgtattaaaaaaacttttaaaaagtaatctgaaggattatattttatttatttatttgcattttgattatttttaacttattccttatattttagcaggtaaaaatatatctcattcctcctgaatggtgactagtacatttacccatgcccctattactagacattcacttcattttcattttggagtaactaaacaaacaactaactttgtactaacatttacctattttttcttaatagtacagatgcccagaactgtgatttctgggtgaaatgctatacatggtttaaatgagaggatatggcgtcctctttatttttcaaaatttattaatatcagcaatcctaatcagcaatacattaaagcgctcctttatactgaattcctgacaagagtaagcacccttcattattttggggagagtgtattttataatcaattgtgttttcctgatatctagtaagggttgaaattctgtttttacacatatgccactggaatttccttttctaggaattacctattaatattatttgttttaatttgtttttggactttggtcatatatttttgtatttaaaacatttacaaattcataattaatttacaaatggactaaaatatggcgtacttatccaccagtttataagtggaccaaaatttgtgggtgtttgcagtattctatatttatatctagaagatatgttagtaagtatgtctatttttaaaactaattaagttttacaatttatttatattttactttaacttaaaaagcctcaaagaaatactttattctgtctacagaattccaaaggccacttaaatgccaacattaatggctttcactttttaagttagttatttaaagaaattctgcattactaatgcttgtggtgtcacagaggatgatattgtaaagaaaaccatgaataccagggaattcaattcaaaaaatgatccagaagagacaaatttttaaggtaaagaaaggttaaaagtgtctatacaatgcttttgcttatttataaacagtgagtgacttacagtaaaaaaaaaaatagtgtgttttagctaaaacaataattaaacaacaatctgttaactataaatttcaaataaagaaatatatatgaaccttatatttgccacatgcatggcacatatttttacaatttattttttgtcatttgattttgtttaatatatagtttgcattataaaaacaattgtaaatatttgtataactaaatccttttctttagagattttgggttttatatccaacattggtgtgtttacatgtgtctgtgcatgtatgcatttttctcctcacatttttgttttatgtttagatatttaatatatttgaaattttgtcaaaatcatttttctgtaggtaagctgtgagttatgtggtactttattttctttcagttgtacaagcaaaatttgctaacttctatttttccactacattgaagtaattgaagtataattttttgatatattacatttccatatatgcagtgtttttttcctgaactttcctttgtgcctcacatatctatgttttgatgtctgcatcaatattgtattgttaaaaagtgagtatattgtttattttaatatatcatgatgcaagttgtctcccaacatcctttaaaaagaaaaacaaaattttaaaacttgtttaacttaatatgaagattaaattataaacatagcctataaaagattaggaggagtatgtccttggaatatagtatggatggagggagtgaataaaatattaatacaatggaagtcaggaaaagagaaaataagaagcatagaaaagtcacagaacacagtaaatacacaaaccagatgctaaaacatcatgggaatcatgagggacattgacttagagaataaatctgacaaattgattatgcaagtaataagtttagcagagaaaaatgaccctgttttcagaaagtcaagaatacataatattcaaatttctaagcacatttggaatattttacaaattggacacatacaacaccacaaagttcttaacacatcccaaagaatgattaatatgttagatacaacatattctttgaccacaaaattatacaattaaaattataaattttataattccttctcaaaacttaagagtacataataataagatacttaaatagatgttgaagccatagatacctacctaaaaatgtatatatttttatgaattattaattacacacccaactcttaggatctgttttctattgaagtaacattgattcctttaagcttgtaattctccaaagtaagttaactgagaaagaaagtccacattatagaaattcaacttacatatatttttatgtatctactcaataatacatgaaataaagcaaatcaaaatctgatctattttcccactccttttcttcaggcaattttacatttccaacataaagagaccattaaaaaagatgcagatccctcaataacatcacagttttacagcttcacagcaagaatgtcaccctgacttccttgccttttcttatacatgcttgtgtttcctatacctttgcttgctcttgagcctgctattctcagtgcttagaatggaaagagcatcggattgaagtttatcccaattctaccatttaactattggataatattaggtacaaggattaacttgtttgatttattattttctaatagtagagataatttctaacagtagagataattataaaactgtgactgttttcagaaataaatgacataatttggtggtaaacattaggtacttaagaaattccagttgtgtccagacagacttctctgattggcaaattatttatttttaaaatccaaaatccatgttactgcttttgatgagaattcgctggtatcttctatagctctttctattcccagctcaatgtagaaatgaggatttcttcccatgtctatcccactgtctttgtgtattcatttgctctacaaaaaacaaatgctcaccctgttttttgcttaaatttcttttctgtcttcccctacaatggtgaaatctgcaagtataagctctatactctggccagtgtttgatataggattgcaagaaacaactgtcatatgggaagcttttacaaagaggggaagcaaccttgttgggttaagtactaaagaattttgagaaccacgatgaagttgatctcagcataatttttaaaaacagattacataatgtttgcagtactgtgaccctaagagtacaataaactaagagcgttgttgcaggcaagttagatggggccaaagttccaaatgagaagattagaattatgtatgctctgcttttagttatcatggttatgggtgctctaaccacgttcattgatatttaaagggaaaacaaataaagacattgaaaaagtcataactgtttaacaacaaaaaaagaaaagctataaatttcaacttttaatcacaaagcttataatgatttaaatgtttaagtggaatattttgtgtattatatataaaatattgcagttgtcccaacaaggtaaaaaataggttgggtactggcacttttgtaactaattttaccctagaaaataacaacactttctggttgagaagggagactttttgttttgtttgtttgttttttgtgttactaattttgttttttgagactgtcactaacagatttgatcccaacatgatagaaactttaagagtaatctgattgttaccttgaagacagcctcagtcatattctagcatgtatcttcaatgccatcgatagtatttgtgcgtaataaatgtttaatagatgcccatgaaagtataaattaatgcactaaagaaagggggaaggaggaataaagaaggaataaatattactgatgatgatgccattgatgttggtaatgattgtatggaaagacaggctacagaaaatagcatctaagggccaagttttctaatataacaatttgattaggagaacctaggtctagaaagtcagctttggagattgggcagaaaagattacatcaaagtcttcaaaaatttttcaagtcccattggtaaataaatgaagaaacaaaagacaaatgcgactcaggattccagtgtgggagctaggattaagttggtgtcactgattaaagcaagtaagaaaaaacatgaagtgaaccttgcagaccaagtggccatttagttttgaaattgtttcattcaaagatgaaataatgatagaaaaattatgagaaatagcttatatatcagttactgttgcaataacacaatatgacattctacaaatcaaagtgctttaaaacaacaacccgacattctcatgctcaccgtcctgtgggttagctggaacagagctgatacaggctgatctcatctgggcatggctccaagccatggactgtgttcagctctgcttcacacagtctcctattcctctaggaccagcagaccacctggggcagaatttctcatggatacgacaaaatccaaaaatggcaaaagaaacacacaatgtttgttaaggctcataactcacacagtatcctttcctccaatattgcattagccaaacaattggttagctgaattcaacacaatggggtggagaaatacactctaattagagaaactgcaaagtcacacagcaaaggatgtggattcggggagaggtgaagaattacagtcttccacattctactttaaataaatgactgaaattcagttaaaagtgaagcctaaactagcagggttattaatgcaagaaatactttgcgaacaccaatatatatccatcaacatcatcatcatcatcatcatcatcatcagtgatagataatataggtctttgttctgtttcctactgtattgcttcccaatactatacagattacctaaatttgtttagtctgctgtggttatactttcagattttccttgagagttgatcatttttttctataattccagctagctgtgggcaaagattttttctataaaagatctctcaccaccaccatattaccattagctatctgattttgagtattatggcagccaagccatgctctctaaaatggattggattttctatgaataataatactgttatgaattagttttccattaattcatatagctctcttagatattttctactattttctaatatgtaatatctctgcactttgtcattcacatgatcttttcgtataaatcagaccaagacaaccatcagtacccaaagtacgattcagaattttcagctttaattgcatctttcccaacacgttttgcttcatagaccagttcatttttgtacataactttggcaaataatgacaaggagatgtaggcccattttaattattactgtggctgcacgcatatgcagcctgttggcaacttgcccactgtatagctttctgctgcaatgtttctcttccaatatggaataaagtacttaaaggaacctgcttagccatcatgatataagtgcaaaagggaaagcacaagtggttagcaccctcaaggacaggagctggtgcataaggactgcactgtttcatcctttggacaaacacttctattatgcattctacacagtccaatcaaggatcccaaacagaattgaaccccagaggcccacagaggtgattagctagataatatacccttggattggcttgccttcctcacctgcctcatgtttctcaatccctaaatcaccttctttgggaacagttcccaaaatgactattcaaatgcaaaccctcgtgtttaacaacagcaacaaaaaagtctatttatagctttcttgcctgcccacctgccttccttccttccttccttcctttttttttttttttttttttttccagagtcttgacctgtcgcccaggctggagtgcagtggtagaatctcagctcagtgcaacctctgcctcccgggttccagcgattctcctgcgtcagcctcctgagtagctgggactacaggcctgcgccaccatgccaggctaactttttatatttttagtagagatggggtttcaccatattggccaggctggtctcaagctcctgaccccgtgatccacccgcctcagcctcccaaagtgctgggattacaggcgtgagccactgcgcctggccccttccttccttccttccttcctttcctttccttccttccttccttccttccttccttctttccttccttccttcccttctttcttcctttcttccttttttccttccttcctttcttcctttctctttcctttttttcttttctgttctttcttctattgtgataggcagaacccacatcttaatcctcagaacaagagaatatattaggttacctggaaaaaaagattgaaggttgtggatggatttggtgattgctaatcaggtgacattaagataaaaacaattatgctgaatcatttggatgggcacactggaattaggtgggtgcctaaaagtgaaaagaggatggcaaaagtttagtcagtcaaataaagatgtaactatggaggaaaggcacagaggattcaacactgctgactctgaagatggaagggggctatgaaataaggaatgttggtcacctctagaaggagcaaagggcaaggaaatggattctgcactagagcctttaaaagaaacatagccctgccaacacctggattttattctagtgagactttcaacctaaagaacagaaagatagtagacttgtcttgtttaagcttccaaattggtggtaaatttttacagcagcaacagggaactaatatatcaatgcatgcgtgttttgcacaaatatgtcattcgtatttagaaatgccacattaagatgaaatcagtttcatattgcattctaaatgatcctaatagaaaaattttacatgattttatgatcagttcattttttaattattttgaatccatagacttcttttgtatttcctttgacaaatagtttggggctttaaaaagttgctgagccaattactcatctaaaagtttttctgaagctcatggtttattcaagtcattcaattaacaatttaactcaattaacatttacttagtgcctagcatgctcatggcattacagaaaatggaaatggaaatgactttgaaacaatttattttgaccataaaaatatcaaagtcctttaacatgtaggtcatggattactgggcagtagtagctaagagttcacagataatggcaaacagataaaatactttcaaatatacagcagatttaactttcattttggattctttgctaccagaagtgcaggaaaaatactaaaagtaaaatcaaggacatcttaagatggctttaattaacattcttagtaatgtaacaaacagacctaagaaataacaaattagtgtcattaatttttttaattgtttaaactttggaattaaatatttcactactttagtttttgggttgtttttgttttttactatgcagtacttaagaaacaatatagaaacacagtccaaaaacaaaaacactgtatctcagtgactgtaaacattgtggtatgtttttaaatatatgtatataaataaatataaatatatattttaagtcataatttaatatagtaaatgccattgaatacttctaggtattaaaatatttgccttttctaactgcccatatgtttgaaaatattttcaatggttttaaattgttagctcagatgtaggacgcatccagaaaagagagacaataagtgagagagaaagaaaagaaagaagagagaaaagaatgaatgaaagaaagagagagaagaaaggaaggaaggaaagaaggcaggcagagagggagggaggaagagagggaggaagggagaaagggaagaaaggatcctaatgtctgtttaatcttgtgccagaaaatcttgctaggtagtttacctcttttaaatattcataataagaataactcttaccctaaatattatttttgcagtctttctggtaaggacactgaggctcacagagacccattggagagaccgtgcctgcttatgcaatcatgttggtatttatttggagcacttaaaagccattctacacagaatcatttgagcttcatggaagtttatattgctttatgtactatttaacagcaaatatcaaataactagtttcactttggggaagaaaatttaggtgtaatctactttatgaaggtgatacagttctgaaaatataaggatttttcacttgtattttacatttgtatcatataataagttataggcaaatttaccatctgaaaaacacttacagtaaatcctttgtatgtttaaagatctcattataaaggcaatattagctgtaattgcagattttcatgtaacatttcttttttttttgggtggggggtggtggtgggacagagtatcactctgtctccaaggttggagtgcaatggcgtgatctcggctcactgcaacctctgccttctggttcaagtgattctcctcctatcaagtgataggcctcccgagtagctgggattacaggcatgtgccagcacgtccggctaattttttgtatttttagtagagatgggttttgccatgttggccacactagtcttgaactcctgacctcaggtgatccacccgactcagcctcccaaaatgctgggattacaggcgtgagccaccaagcccggcctcatataacatttcttaaggcaagtgccattccatctatgtcatatctctactgttgcttttataaacttataaaatttctcatttgagccatgacttgaaaagattataaattaatccaaaataaatttgcttctgtagtactcttctatatagacatttttaattttaaaagttttatcacaacgctctatctcaatacaaatatacttcataacaatttattgacttaacattaaggaaaaatgtctgtgcaattgttcatgcaaaggtaatcgttaattctctcagattcttgaaagataaaacatcacaattcaaagatttcataaaatgctatttgttctcaatttctaaagcagtgtttttaaattcttgacagaatggagacagaaaaaccatacatatctaggtctgagaaataccccaaattaatatagtgtattgctctccacctgatactgttttttgcatacgtgtgactaaagaaaatgttaaggtttgagatcacttattcctttttttcccctctaacagttacaagtcttcatgttattgaacctaatattgacatacctcctccctattgcagaattattaaactagctctcaaaggaaatttaacattatagggaaaatgataactttcttttttcttttgccattttctcagaaaatcacgactagcttctggccatgacaaaagttatgtcagcatcattatgcaacacctgtgatcagtgtgcaatggaagagcttaagagccagaactgagtatataactgaaaagtttctatacaatgttaaatgtgctgctcaatcccctaaagttaagtaaatggccttcagtgaggtttgaagaaagctctgcaacagcatgaatatagtggcctgagagctggcgtggaggtattcagatatgaactctctttgcttctaaatattaagcctacagttccttgcacttttatttctgaggcattttaagcttattgtgctgaacagttgtgctttctaagcttgattgacattccagaaaatattgatccgagtgttgggtgagcttactttctattaaaaagtgctcatcacatggcattaggctcactcagtccaaaatgtcagagaattgcactttttaacaaaaatcttatatttattttaaaatcaaacttaccaataatttataatcagaatttgaagtgtagtatgaacactttgcttctttagaattgatttagaataaaaatctgacaaactcaataagcaaacaaacaaacaaaaaaaactccaagaaaccactgtaaagaaaaagtgttttcttggtcactgaatagtattaaaattccctggaaaaggagaatttcttttagcaaatcatatttctcatatgttcttttatacctgttctgatataggacagccatttccataaccctccccctctagatccatctctacctgctctagaagaggtttgctctcaagacccagagcttaccgagacttcccttagctccccaagattgtgtctgctgtagcaataccaggaagtaattcgtttcttcctcggttttctcttctgttttactggatcaccgtctcaaattacttccaaagaaaatgtttgttggacaaagggtacaaaggttcaaccatgcaggatgaataaattctggagatctaatgcacatcattatgactatagctattggcactgcattgtatacttgaaatttgcaaagaaattatacataaaatgttctcacacactctctttcccacgcaaaagggtaactatgtgaagtgattgatatgttaattagcttgactgtagtaaacatttgacaatgtatatctatatcaaaaaattatattgcatgccataaatatatacagtttttatttctcaattgtacatcaataaagctgaaaaaaaataaaaagaaaaggctcattggaggattacaggatttctgaatcttggcccttctgaaaacatctttagtctaccattttattgattgatagtttcgctggtgatagactatatgacttgaaattagtcttgatcctcacttctgacctgcttagtgctctgtgagggcaaagtggcttatttctttgctatgtgctcctctgtgaggtctcaaaactgtcatattctttacatgtcattaggaaattttacagccacctttggttttctcgagttttcctagaaatgtcctgtgttcctctccacttttaactaatatgaatatacctaatttgggtttcctttgggattgtgcaggtagatttatttccgaaagatttctttcttagtggaaagtgtgcctgggtaggaactttgtacaagtgggtggaatatgtactgtcaggctttgctttaggaggtataagaaaggaccctaaggataggctgtgaggcaacccccacaacttgagaattaggatgattcttcccataaaagaacttttcactttccccaggtcgtctcaatgtaaacaaacaaaaatcggctgctttattttgtgtgtcttttgtttttcactctggtgttaaaaactgggcagcctgtgctctacaagctgaagtgggagatcgaattcatcaataaatttacgttttttccaccatgatttttctcctactattagtgtgtttgtgtatgtgtatgtgactttttccgggttttgacaaaagttcttacccacttactactaccttagctggaactaagtataccttctgttgcaatttccagagctttggacttgtattctacctggtttgcatgttttctgtgacttgttgagtctctttcactgaaatatctttaagcaagttaagcaaggattttggataacaatttaaagtggttttgtcataatgtttttgtataattttagcaaaatagtagaattttatttaacttttcttttggccaaaagtttacttccgtatgtgacaaataaagtaaaccccaaaaagcaaacaaaaaccagcattctattctggtttattatttcatcaataatatcaaattactgccatctatgaaatggatgtagtaattgtaattctccatacctaaaataacattttattaaagtggataaaaataatttttatggctgctagtcttagtcacaagcagtattattacagctcttactgtattctaattatttttatttgctcttcgaaaatttataagtggtattaaaatataatgacttgtcaaaatctgaaatagggatacatgaaatcttttgatgaataaaattaatgtgaatttaataatgttaacaccaataaaactgtttgcaatactgtacaggacgcatctgaagcatgtaccacatacaataattatagtagcagctctctaaggactagagcactagaaactgtactgtgctaatctgaaatcaggtgaattaatcctcagaggagtcaggtaccacagtctcaagtaatcagtaataattgtatcatattgctgaagcacactccaagagctatgattttccctacctgctggattgcctgcaatgattgaaatttgttaagcagtggcagaaattcaggcccatgatcagtggaaatccaagagttccaaatacataggtaacatcactataacaaggtttttctattgtttttttcctttggttttaactttatgttttatagtagatggattttgccaataatacattgctatactttgataacgaatactctgaagtgtttaaagaattgaaaacatcaaaaaataattttgcttataacaaaatacaaacattaaatatttttgataagagaacttacttattagatttacactatttctctaactttaaaaagtagtctgcatttcaagtggtctaccatatggctgtctacatcttagcattttgcagaaagtatatataaaatgaaatgcatataaaagttgcctgcagtaagtaatactaaaggcctggattaatgaatttagctcggctttgagttatttcaaatatatctttgttaataattatgtacttcccaaagccatcgaataatgttaattaaatctcggcttagtttcacagttgtgtttaattagctcaatcactttttaaaatgtaacaggctattaaaagaaagatctattgacagaatgttgaatggcaaattgttagctgccagatttggtccctgaatggtcattgggtgcgtgaaaaagcaaaaagcatcaaaatcatagcatttataaacaggctttgtagcttaagagttaactgcatgcaattcaaatgattttcattctatattggaagggagtaatccaatgagtttaatggtgtatgtattatacagaagcttttcaataaaggcagaaattacatttacagtgccttttctgtggttatttgaaatatacttttatctaggcaaaccttaatttctggcaatataaaaagtgccctgaggtaaatatggactttactcctgcttatgagaaagttaaattaataccctaaggatatgtcctttgcaaagggtcatacttattaccaagccattataataatatacactttcttacaaatctgcaatcgatttacaagcaagatttcgattaaagttcacttcccaaaacattggaaagtaagctgtttgtattgcactgtttataaacacttacttgattcccaatttatctttattttaggaagagatagtaagtcagaattattttgtttattctaggaaactctcagttttcaaattttcaattaggaaatggtgagggaagtgggattcaaacacaaggacattataatgatgccaatcaaaaacaatttattaataactaagtaggcagcttttaaaatttttgactttcaaaataataaaaaaatgcaattccttattaaatgcaaggaggttactggaagaaatttggcataaaatgccttgtttattaaagattaagagaaacaactgtttatattatagaaattaaattactatttattgagcatatgcatctcaatttgcaagtcacagtgtagaatagaggcctatttaatatgtcattaaaatatattttaataatgttgcaaatataaaatctattttaataatgttgcaaatataaaatctattttaaaataatgatatttaaccttattttgctgtgaattgacgctacagtgtacattcagtgcacacaaaatatcaaaactttccatctaggatttaataagagagaaaaaaatctgtggaagaaactatgtacattgaagaaactcaaaggcaggagacatgtgttaggccattcttgccttgctctgaagtaatatctgtgaccgggtactttataaagaaaagaggtttaactgtctcacggttcttcaggctgtacaggaagcttgttgccagcatctgcttctggaggggcctcaggaagcttacgatcatggtggaaggcaaagggggagtagcttggggagtcacatggcgagaccaggagcaagagagagaggggaaaggtgccacactgttttaagcaagtagatcttgcatgaacagagaaagaactcactcatcatcaaggggatgacactaagtcattcatgagggatccgccgccatgatccagtaccttccactaggcctcacttccaacaatggggattacattgcaacaggagatttgaagagaacaaacatcaaaaccatatcaacatatttattcacttttcttggtattatctatattctacgattaatatcatgaatagacagtcatgaatgaatagtaatgaatagacagtaaatgaatagacagtaaattctagatcagaacgtaatttactaatttactgccaatgaacagacactaaattctagatcagaacctaacttcggacttagtgcttccaaagtacatctttgtcatagtaccatgcatctaaaaacccagaatttaaatattttacacgtagacagagaaatagactaaatcatagtgtgattttatgaaaacaacgaaaacaactacttctttagtaatgtaaaacctatcaaagttccatctgtgatttgtctaaaataagcctatagctccatagtcagaactccaaagctgacaacctcttcaatccttcagaaaagacaataatgtcttttagaaaggttttagatttgccatgttcaattatctatattattgagcctactaaccacctacttctaatgttgcaaccagatatcattctggaaataatctttctttaacaataaaattttccatattaatttatagcatgagaatccccattcccgtcttccattattctcatttgcactaccctaaccttccttctcaatttttgcaatgctttccctcatagtacatcatatcataacatttagaacatttatgtaatgtgagatatggaaactgattttagaggtcatttagttggggaaagaaaatgtatatcacttcatatgttccagtagcagctgcctcttggtctcggtagagaagaattcagagggagagctggctcagactcagcagaaaaaggtcctcatatgatggcttatctatgttagagattgggaagtaagaattgtttgtatgtttaggtatcttttagttcactttgtctccgatttcacatattatcttttgatttcccattccctggtccaaatacccttctcaaaaagactaaaaatataaaaatattttaacgtaatttttgtttaaatcaaatccagtgtataaattattatggctatgtaaatgttatgtttagctgttccacacccacatagtataatgtgattacatgttatttcttggacagcttttgttttgcttttttctggagttaataatagcctaacattttctccttgatcatatgctctagaagggcagatagcagtctttctttggttcactgatgtatcctaaagtgtctagtacaacatatgtttctagtagacacatattaaaaacccaataaatatttgtcaaattaaaatattaattttcaaagctctaatagaactataaaattcctgtctatataatcagtcatgccagctaattctttagtttcattttaattctttgagacaacatcactgtcacctaaagctctctaaagccctcctcccaattgggcaggttctttttcttaacccattaccaagatatgatcgtaaaatgtccctttttattatcttggtaatttttgtctcagttttctataaaatctctactttcctgattttcatggtattctctttctttgtttagtcacttgttttgttttggtgaaacatattctttgtaacctgctgtgaaaggacgcaaagatagattttttggggggtttgttttgctatactatgtgtctaaaactgtgtattaaaaagtggctagatattaaattctagtctagacaattttttaaatttttgacagttctcacttccagtagtactttttaaaactctgatgccatgtgagtcatatgtgacatattttgtgatatgaccttctgatctagagaacttgttatttgaaaatctctattgtacaattctaaaaattttttctcctcctttttttttctgaaatagcttttcttatttggaaatagtatcacttcatttaattatgcaagtttcttctctttttttaatctcttattttaggttcttattttttcatactttatcaaaaacttccttacccttttttccagcagatttgtttcatgtttttatgctatcgtattttcagttttgaagcttgaattctttaagtatctccttttaatgttttcatagcaccctgttcacttcatcatgaatactttatatgatcatattccaggaaagacacttatcctttttaaaaaagttatcttctgatctaagtctattcttttacttctttcatttgtttgggtttctttacttttgatttaaaagctttcagtgataatttgtttcatattttttaaatgatacatactttttaaatgtgttacaaaaaaatgctttttggaagtactgtgttttggaacaactttccggccagtgcagtttattactgtatgataagacaatgaaactttttgtttgatgggaaactcaaatttaataaggcatttgttttctcacagggtactttagtgtccagaaagaatcctccagttgcttgccagggctgggatataagttgggttgcacgtgttctgggaatcaagcgaggaagatagcagatcacatcaccattttacataaaaacttatacagagtgcctatgatttcaccgggatgcttcttctccatcctaagctataccaatctcccctgagtccagaatctttacagcttagtttttccttacactataaatctaatccccagcatgggttgtgggggaagttgcttaggatgatttctaaatatttcttataagtcttttgactatttccactatcgataatacctacactttccttgcacgtcgaaggtgcttctgagcatcatgcggttcttctgcttaaatgatttcacttcttattatattctacttcttttagcttcctgcccaacctttagaatttgttccatctttacaacttgtacataaacggacctcccatcttctaaattgtgctgacatcttatcactacccaccctttattgtatttattcttttctatataattttaaaaaatattttatgttatttaggggaattctgaaagatctgtgatcaatctatcataatttgctaaaagtcttaacacatttaaaaattttaaatatccatgagcagaatgatcatgctgcaaatgtgattagttaactaaaatattaaatattaacaatattcaaaaaccttataaatgaagccccaagtgttaactgatttatcagtaattacatataggctacataaaaatatatttcctgtctgggcgcaatggctcaggcctgtaatcccagcactttgggaggccgaggtgggtggatcacgaagtcaggagatggagaccatcctggctaacatggtgaaaccccatctctactaagaatacaaaaaattagctgggcgtggtggcacacacctgtagtctgagctacttgggaagttgaggcaggagaattgcttgaacccgggaggcggagcttgcagtgagctgagattgcaccactgcactccagccagggcgacagagtgagactccatctcaaaaaaaattatatatatatatgtgtgtgtatatatatatatttttttctatatgtatacatatatacatatatataaaatatatatacatataatatatataacatatataatatatacatatataaaatatataaatatatacatatataaaatattatatatgtgtatatatgtatatatgtatatacatatatacacgtgtatatatacacatatatgtatatacatatatacacgtgtatatatacacatatatgtatatacatatatacgtgtgtatatatacacacatatatatatatatacacatatatatttcctgagggttggctctttcctctgtagaattttgattttgttgagagtagacttgtagtcatggagaacttaaaaacaataaaaacagaatgtaataaattgctaaatttcattatttagtcaggaaagccatagtagtttaggaaagagcaaaattaaagtattacagaatgtctcaggtgacttcccttgccttggtgacatgtgtatctggtttgttacatacttctaagatagcctttggattatgctattgtctgcctaacagctggaatctattcaatcaaagattatttgctgaaatatgaggcagagatctatcttttacataatcctaaatattcttttgaatatttctaccatgctgagaataaacaagtacagtgttttattttgagaacaaatttgggaactcaagttgataaaaagatggataatgtatttaactaaaatttttgaatcatactatgtgtcattttctctacttgatattagcaattgcgagaataaaaaaatgcagttactgctattagagcagaggcatgggcaatgaaacaagctacacttacttaacagagtaagtatgacaacggataggagcacacctgaaagtgacaatgaaagaaaggcttcccaggggaagtacagatttatccaaactctaaaacttaactggaagtcagatgaagaaggggaaatggtagtttggacaaaggaaccagcttattcaaatgcacggagtcctgataaaacatggaattgagggaaaacacatttaagtgtgactagactttgggagttagatttaaaaaccagactagtctgtgcaaagcaatttcagaaaattaagataccaaaaaatatatatattatatatgtatataaataaatatatatatatataatgttctaaagcagtatagtataatggagtttttacctagactagttaccagaaaatgtaaccctattatctctgtgaactttgacaaatcctttaatatgtgtaataaatttattgtttaggaccttttattttcttcccagcttcaatttcattgttaagatgttaaccagaagaataaggcccaattgacagatctttttgaaatttcagacacttttgcacttccctagtaatttgatggctcttaaccaatctggtgaaaacttttttcctatccacactgtagaatgttttacacattactctcaatgtaaattcactcaatcttcagactgacaaaaaaatttaggtttcaataagtcatttaacaaggaattccagtgataccataaactttcatcatcatccaactcagctaccctcctgatgcttaaattctctccacaatatttctgccagtcatcatctttattatgcttgagtatttcaagtgatactcaagtagttattctcaagtaagtctatgattagactcctctgactgaaagattttcttgtatcattcttttggtcataggtctaattttcatatcatgaagtgcctttaaaaaagaaaaaaaaaatgaagataatgggtttctagtgcctaaccaagtatgtggctccttggcacccagaatataacagtgatcattgtcccatcaattacttgagaatggaaattaaactatacttccaattttaggcttatcttctcagtgtaaaacatctcacattcctgtgattatgtctcagctgagatggtttttaggtctactaaaattttagtttgttccagttagttttttaccactcttagaaggtggaaaagtcaccatagagcttcaaacatggaaacacagagagcaatgaggaggctgctgacataatccaggacaagatattagaggttttgcttggataacagctgaaatgatcaaagaaacaaatagatttcggagaatttgggtagtaaagttcataagacctcctaatggcttggagtatatttggaagaggctaaaaggactcgataaggactccatgatatttggtttgagcagctgaggggattgtggtgccatttattgagatgagaaagattctggggaataaattttgtttgggaattcagtttgaaatgtctcaaagatatccaacaggaaatcttaattaggatattcactgaagttggctaacagaaaacctatttccctttaaaatcatgatcagtacctcagaaaggcagctagtcatttggagaattgtactacattttctttatcagtttgctctactactctctcagactggtgcttttcaaaagtaatgtgaatggaaatcactgggagatcttgttcaaaggcaggttctgaaaatctggtgagatgcttaagcatctgcatttttttcacttttaattttgttattattaatcgtcagtgcataatggttgtatatattcatgcggtgcatgtgatgttctgatacaggaacacactgtgtaatgatcaaatcagtatccatcacctcaagcatttatcatgtatctgttacagaaacactgcaatatcattcttttagttattttaaaatgtacaataagttattgttaactatagtcactctatgatgctattgagttgtagatattcttcattctacctaactgttatttttgtaccccttcttccccactatccttcccagcccttagtaaccatcatcctactctctatcttcataagtccagtattttttagttcccacatataagtgagaacgtgtgatatttgtgtttctttgtctggcttattgtatttaacataaaggcctccaattctatctgtgttgttgcaaatgaccggatttcattcttttttagggtagaataacatttcattgtgttatacaggccatattttctttacccattcatccactgatggacacttaggttgattccatatcttgactattgtgaatagtgctacagtaagcctgggagtgccgatatctcttagatacattcgttgcttttcttttggatatatacccagctgtggaaatgctggatcatatgatctatcatatgctggataatataatccatcatacgctggataatatctttaactagctcctatttatttttgtctatgtataaaaattaatatggattaaatacttaaatctaagacctgagactatgaaactactggaagacaacattggggaaacactccaggacattggtctgggcaaatatttcctgaataagacttcaaaaaacacaagataccaaagcaaaaaaggacaaatgggatcagagaaagcttcagttcaggaaaggaaatagtcaacaaagtgaagaggcaacccacagagagggagaaaatatttacaaactacccatctgataggtgattaataattaaagtatacggccaggcgcggtgactcatgcctgtaatcccagcactttgggaggccgaggcaggcaaatcgtgaggtcaagaaatcgagaccatcctgaccaacatggtgaaactccgtctctactaaacatacaaaaattagccacgtgtggcatgtgcctgtagtcccagctactcgggaggctgaggcaggagaatcacttgaacctgggaggcagagtttccactgagccaagatcgcaccactgcactccagcctgggcaacaaagcaagactccatctcaaataaatacataaataatcaaagtatataaggaactcaatagctcaataggaaaaaaacaaataatatgagtaaaatatcggcaaaagatctgtcttaagacatttatcaaaagaagacacacagatggccaacagttatatgtaaaaactgtcaacattactaattatcagagaatgctgatcaaaacaataatgagatatcatctcacctcagttaagttgacttgtatccatatgataggcaagaatgaatacgagcaagggtgtggagaaagaggaatccttgtacactgttggtgaggatgtaaattggtatagccactatacagaacaatatggataatgcatttttctttatgctcgcaggtgacatcaatgctatagatcctcagatgcactttgagtagcaaggtctgagttagacaagtctttcccacttaaatttgcatgccctgatgttccttcctcactctcagctgagtgtgtcttactgtgacttatttcaggagaaaatagaagagaagaagagaattttcacatgcttgtaccattaaatctaccaacccactcatctagtaggttttctctcttttaaaaatgggcttttacataaggccaatccttctgcttatttgctagattgcatcccctctcactttctcaaaggcatcaatcccataattgctacctcctttccaagcatcatacatttttacattttactgaatcattctctttagcataattaacatgctaagataaacgttagcttaaaataaaaacaaagaagttttgatactccctatttctttgcttccttttagtgtaaaacttttcacaaaaagattacatttattttctccaattgctttttttctgttttatggtggtagttctagcagtagctactgttaagatcaatgatccttcctttgccaaatctaatggtggattatctgttctcatgtcacctcgtgtatgaaggttattttcgtagttctatttataatactatcttcccttggactctgtgacatcaacttccctttgattttcctttgacttaatgtgtttgtcttttctgcctttttgctggctcctcattctcttttgacctctaaattttaagttacttttgagccaagttccaggacctcttattttctacatctatataccaaccctctaggtcaactcatattatttcatgcctttaaatactacatgtgttcttgatttctagaaacacaccttcagccgaggtttttccactgacctaaagtcctgtatgttgactgggtaatttattgtccaaacgaggacactttagaatgtgaagatgggggattattattaattattctgagaaaacacatgtaaaccaggacaaccacttgtctaagcagttttatgcaatcaggggtatatccaattgcctactcaccattatgtatttgggttttgggataaagatagctagctgttcacaaatacctattttactcttctgtagtactagaaccctgaatttgcagctggttacaagacctgatagaataagaactgaatttccaaacctcttttgtattttatgtggcaatgtaactaattctggacaatacaatgtaaggttagttggtgtatggaacttctaggatttgccttaaatgtaggagatgtgcatttctttgaccgctttccctgttctgatgcttagattatgaaggtaggagccatttagaatctcttagtagaagccatacattgaggaaatcagtacaaaaagatagaagacgcttagattttgatactggtaagcccctggactgctttaatatgaaataaaaataacacccatcttattattgcctttgttaatttaccattcattgcaatgaaaccaaatcctcactaatagaggggcttaacatttatttatatattcaacaaatatttactaagtgactgatactattctaggcatttgggatacaataatgaacagataagtgggcccttcagagcttacagtttgcaaatattaacattctggaagtatattctaatgaaagatttacatactaaatattaaatagtatactatataaaggtaataaagccaaaagtaagagaaaaagtaaagattgctaaagaggcttagaaattctggccataggggtgatttcttaattgggatagacttctcaagcagataattgtgagcaaggaggtggataaggtgagtaattttgcctatgaatctatctggaggaaagccatcctaggcagagctgagaaccatacagaggccttaagttaggagtattcttattctacaaaacataaggaagctagtacagctggtattggtgtttatagaatgatatcagagatgaggtttagaggtgatggagagccacatacatctttcagcacttgtagaccatggcaaagacttttttgtcttactttgagtaagattaaaaaaaaaaaaaactattgcaggattttgagcagaaaactgacatggtctgtcttagattttaaagaatttcactagccataatgtgagaatgtactatgagggtagagggtatggggaaaggatagaagcaaggagaccagtttgtagattacggcaggaatcgagatgagagatgattataaaatcaaaaagtcttaaatatcatgcttaatttctcatctctgccttattgaaatagcttcttctgcaggcttctgtatttctgtaaatagaaactttgctcctcaaagagactgggtctaaaactttgggctcatttggaatcattcagagataggaacacagagaaaatggcaatacatagatcttcatgcaacttgttccagacactcattcctgtcctttccagttttgttggatcagccacgttgcaattatgcatgataatgcaacattctcccaataagttcttctccatttctaagctcgtttacactggatttctattattagaacacattttgttatgaaagtcttcacaattacatataattacaggtcactaacacttgctaacttgaaataaaacatgatttttattaactggccatttcctaagttcctgtgctttgccattgtaatacagatgttaaaaataaaaacactgacttttcttttctctctttagaaataaaaattaagtttatactacttttgattatttgcttacataaatattactgccacaaggaactatgaattacgatgtaggaaaacaattttatatttacaaatagccatggtctcttaaatgcatgatactccttgcctgaaatatactataccaataaattaaaaaccacaattaaataaatgcaagatcaaaaatcacgattttccatgaaatagaggaaagtcattacaaaagttatatttttaaaaatccattacttttacttgcatttttccagctgacaccaaaagagcacacttaagttcaaaaggaacttatataattttacttttggattttgaagtggcacaaatcaaaaggtctgactaggagggccagattaatgctttggagacactacacacagaaaatattgtgttgtgttctcttaacccatacaaatcaacctgacgcaatacaaaagtataaatgtaagccactcaaataattctaaattttcaccttatgaaaacaatgatttaaaaaaaaaatcagctttttagtctactaagtgggttgtccaatgcagaagcagaagaaaaccatttctggaattgccccacttgtcctgaaatttatacaatttacagatactgtaaaagattcagcaagtagaggaatgattcaatttgttggaaatgttcttctctgagtgagatagagagctattgcaggattcagaattaagatccagagggttaaacacaaaccaattaacaattaggagattttcattattaaactccctgtcactgtaagtctagaattcaaacaagtataactttgataatttttattcatttatgaatcactctatattttttaataattttaatttgactttgaaaggatttaatatatttctaattcatgtaattgacaatggagaattaatctgaggaaataattggattttctcaggctatctcagagacacaggtaacagatgaaaaattattttcctttaaagtcctatactttagcttactacagaatacctctgatattatgatttgtttcttgtttaaaaattggaaaagtaaaatagatttacacataatgttacagttatctgaacctggttttgggtctccagggtgacataaatgtcacatgaattcatacaagaacagattttcagtttattcccctgatggaaaaaaatgttaatagatatgccactttttaactgttgtattaaaattaataatcatagcctttttaactttctgtgtcccaggagtatggtttacgttggagtacattctataagttgaaaaacaaaataataataattacctataatgatctccaaatactcatgccttttgtattaatttactcagaggagtaattttgaactaacatatacaaacacttcgtaaacaattaaggaattctgggaaataaatttagtaaaagctctcattctatttgtggctataaaatacacatatatacagcacaagattcacatttttattatcaatatttctcttacttttactttcatctactggaatatatgaccaggaaacaattggacagcaattttaaaacactgctatgtaagcagatttatgtaagtgataaaaagatacacatactttttttgtcttcagtaacttgtcttttagactaattcatcctcatgtatttgcttactgatgtcacatgtatttagatttacaaaaatttagactaaagcaacaaaaaatacctattgcttggttttttatgttgcttgctaaaatatttgcattttataaatgtgtaatgaatgtatgtaattaatataaattaagtctaaaatttatagacatatagattatatccatcgatacaaacatgaaaattgtgcaataaaacataagaaaatgtttatacatatagataaatacaatataaaaggaaggaagtagggaaggaaggataaaggaaggaagaatgggggttggggggacaggaaaaatgtattaactcatgaattaacccaagagaaaaaaatgtaatagtgtcaaaaaactcactaaactttctttgatatggaaattgctcagatggtttatatatgtatggtcccaattttacatatgattaaaatagaattttcaaatcaaccttatgaacattttcaaaaggtaaataaaatgagatgttatttattacatttataagtcaaagcagcatagcatttttcatttataaaccattgcatttttcataccaattcaaagtgaaacatgtcagtactcagacaatttgtattaaatttatggcccacatttctggatttgttatttaaattataattaatttgaatcgtaatgcaggatataaagtttctgtggaaaaattacttctgtgtttcaagtcaattatttaaagtgtatttcaagtttatttgtattcttccttgtctagtcgccattcttaataactgttttgattgatttaagtgttctttaatactaggcaccaataagatctatttattagatgtataaccgtgaacacacaaaaatgattctattccctcttggtcaacgtacactttccctcaggagtatcaatagtgatcatggccctctaaatctctgctgcagcttccaatgccttcatcttttcttttccaaatgagagaggagtgggcttgaatctactagcaaatcagatgcagtgcctaccatggtacactttgcatgtaattagggaccagaccttgtcgatagcaaagccctctctgcccacacacttcatcctaccctatattatcctatcctattctgttctatcctgtcctacctatctgtgtacatcagagaaaaaacatggattcttcttcacagctattatgtcagtagcagaggataatgggtctaaataatcttaactcatccacattaagttatttaggtaaaacagttcaataaatgatgacgtagttcttactttgtgctaacatcaatataaaattatctttggattcattttgaaccaaaatatacttatttcttaaaatttgaaaaatagtagggttctaatcaattgtgttttctatttctttctctctctttttcctaaagtcagtagtaataaactgcgcttcaaattcacttatcttttgtaaaaagaaaagtacaaggagttttaagtagaatcacagaatcataggtgtgaaaagttaacgttatcttaagcaatgcttgagccctgtttgcatcattccaacaaaataatctgtcttatacttgagaggctctaattacatagaagtccccattattccaggaactcattccattgtctgaaaacagtaatcaccacaaagttctttctcacaggtgaaaatctaccctctaaagcttcctctcatttatagcttcatcacataaaaacaattatattcattctaaattctgctgccatgtgcaagctcctcaaatatttggaggacctctttatgtcctctctggatgttcagttctccaggtaaatatttccagttcccttaaccattcattataggacattgttgtccaagtatactcattccttgtggtccatataaatgtttcttctccgcatacactcttaattccaaatagagaaaaagaaggaaacttcagcattcctaacaaaaagctaactacagagaacacagttcaatgcacccatcacaattggaacaatactttaagataatgcaataaatgcccgatagaaggactgcagataatgtaatagaaatgtgaaatattttacattttattccataatttagctgagagagcttctgaaacactctttctagaagtcaaaaaacagaactatatttctatttttctttttacgtatttcgatgttataccagcattatgcaaatgacaagtgcatgcaatgtaagcaattattatcttagggagatttcagcattgccactactgtttgcatcctgtatttattatatggtagcacaagtaaacttccaagtagctacctatgaatagcaaaaataagatcagaacttcaacataataaccacttatttcagtggaaataactgaagtaacttaagtgacacttcacacaaaattttcagttgcttcaagatggtatctgtaatgaatgcattgaggtgtagcacgggcgtcattactttaaagatggaatcactcattgtgccagctggtgagaatgatcatgactaacagctagctatcttccagattaaagagtctcgtctcccaaggttgcattttttttttttttttttttgagacagtcttgctctgtcacccaagctggagttcagtgccgtgatctcggctgggtgcaacctccacctcccagattcaagtgcttctcctgtctcagcctcctgcattttcttttcaaggtaacccacatctgatgactgatcaatgcagaaacataacaacccatcccttgggtctgggatgattcccatgtatttattttgaaaaactggaaggtggactcacaactttcagcaacaggaatgactttaagacccagtttggacattttagaggattaattttggagggactagcagtagcttttccaaagagagacgtcttgaagttagaaggaaattaagtttggaattgagagaaggactagagttggacaatatatattttaaaagttttattagaaatgacatttacaaaaatgagactagatgacattttaaagagaacgagcacaaataaaaaatgaaagaggtgttacaaatgtatggattaaggagatgaagagtaatcggcagaagaacctgagttggaatagaaaggtaggcagaaaatgaggcaggatgagatcgtggccctccgtgtgacaatgtgaagcctatagcaacagggcgctataggcctgcgagagaagagtgaaagaaagcatggttaccgctggaaaggctattgcctttttgtgtttgtttctttattggcctttttctgtttgtttccttattggcctttttgtgtttgtttctttattttacaacataatttttcacgcagcagaaccaattccctactgattcagtagatgggctttgcttaataatcccttagataatcattacattctatcatgagaaatccgcctatctgttggataggcaccaaacattccaactaactgtgcttttgactgaccaggacttaaaatctttgggggcactccttaaattctcactaccaaatctgcataacaatgatcatacagtgttgatgtggtgttctgatgaagctatagttacttttgtcattaattaatgctctctaaatgcaatttaatgatatttttcttttatatacatggttgaaaatatagatgaaatatagcattgatatagacattttggtacattcttttgatgaaaacattttgttctgtttattttatttcataacacatatttcaaatgtccaaatggataaggatgcaaagtctttgttctacagttaaacatgtaatgtcataaattcatggaagagatttattttgactcataataaatgaggaagtatcaaaaaagaccacttagtgctagagttgataatcattttactaaggtacataaaatcatttgaagtcatcgtacaaataagtatattttagaatgacttacaaactattaagcaaatttaagagatcatgatatttgactggaaaaatcatgggtagaatgtcttaagtggttttaaaatatggctatatctcttaaaagggccttaggctctggcaaagtaactagaaatgaattacagttaatctatgaaagaattttagtcttaaatgtgaaatgtaagagggtgctagcaaactaagagacactaacgtgagggtctttaggatcccccttcacatattttcgtatacatttgtggactatagatgtggcaccaaatatttattaattcaacatagtttaaaaatacaggtcaaatctactttcctgtacaaacaggtgactttgaatgatattcaagtcagtgcacattcttaccaatcaactgtgcaattaccttgcgcttcgtatcttctggctctgtacctgacctcatttgtactgtctttcccttacatatctaggcagaaagcctccctaccaactgtacctcgataacaggccatattcatcatgaagtcttgttttgaaatcacaattaaactccactatgattccataaaacatatgtagtatcttcactatagaaaaatctaccttgtgactggtaggactatttcttctccctctaaataataagttcctaataggcaaagatcacctgtataaggtgtgttccaatctactcactttctgtttcttatattatttgatacatgctaagggtgctcaatagatttttttgttgaattcaattaaaattcgtacaaaacagagctccatgctaacataccttttctagctgtgtgatattattaggtgagctagtaactttcttgatcattagttacctcgtatacagataatgttaaaatatctacgtataaatcccataaggatttcacagtacgacaaatttaaaataattatcacagtatcattcacatagtagtggagaataattcaagagatgttagttctcttactgcaaaacagctcttaaaattatgataaggtggccacacgcagtggctcctgcctataatcccagcactttgggaggccgaggtgggtggatcacgaggtcaggagatcaaggccatcctgggtagcatggtgaaaccccgtctgtactaaaaatacaaaaaattagccaggtgtggtggcgcttgcctgtaatcccagctactcaggaggctgaagcaggagaatcacttgaacccaggaggcaaagattgcagttagctgagatggcaccactgcactccagcctgggggacagagcgagaatctgtctcaaaaaaaaaaaaagaaagaaaaattatgataagcctaataaaattgtttgcactatatggcctcaatttatcgtgtagaggaaattatgttagaaacaaagctaaaaactcttcaactcaaaagaattactagtgatttggtaatagaaattcatttacgtctaggtaagttaatcatttcaacatgctgataaaggaaaacaaaactatttctgaacaattttatatactctttgttttaaaaattctttaacatgaggaaaactcttttgtccttgtgcttcaatgcgttatcaataataaagaaggggcttaatataaaatgtatcgtttgaattcaagattatttgaattttaaaaaggtacttttcttccagctatataaattgcagaaaacttaggaaacacagaaaaatatacagcaagaggaacaatatataatttttcaattcagggatatgtgatactaatgttttattgtcttttttatttagcttatagatttatgatgtagttacacttaaatatacgtgagtatgtatctatattgatttatacgcactattgaaattttatctcagtatacaaagtggatattttcccacatcattaaacattttggtaatgtaacattaattcttatgtgacattttactatgtattgtaccatcgcttgatctgttgcccagttgttggatattttcactttttttttgaaactgtaaagagaattacgttatatattctgacacataaccataatctacatttctgattgttttactggttcccaagaaatggatttacctgtatgaatatgtgaacttttgagatattattttatatagatgtattaatataagttcctaatgtgaacttccttatccaaaagttgatttatgcaggtagagagtggatgcaggtagagagtagaatgatagtagaatgatagatactagaggctggcaagcgtctgtgtgagaggagtttagcacacaaagaaagattggttaacaggtacaaaaatacagttagaagaaataagttctaatgtttaatagcagagcagggtgatggttaatagcaatgtattgtatatttaaaaatagctggaagcaaggacttgaaatgttcgcagcatatagaaaggataaatactccagatgatagataccctaaataccttgaatcgatcattacacagtctgtgtgtgtaacaaaatgttacatgtacccctaaatgtataaatatcatgtgtcaattaaaaagttaaaaaatagcctttatgacaatacagtctttactaattttaaatattattctttttttatatttctttgaagttagagattttttcctaagttcatatgctatttaaattgttttgtttttaatactggtattttgattatcttatgagagctaatcatatatcactacttaattatatacattaactctttctcacatttatggcaaaaatatttcagactttttaatgatggcattttgtgctgtgcattcgttaatactgtatatatttcacagtactggttttatttctttatgattgttttgcctttatattttatccttgcttgtatattttacatacatttataaagtttctaatgataccatttggaaatcattttccaattttttctacacatatttctatggattgtatgtattttttgcattattagtattatactatacatgttaatttgtcgttcttccacgtatgaagtgagcaacttgtcctaccattacttatccaatttcacatgacattttaatgtgttatattgagtaaatgaactcataaaaatttttcataatttaacattgaattttttatccacatactgtactcagtgctaaattctaaataaaaaatacatagtattactaatgtgcattcaatgtggcttaaatcgctcttactggaacacatgttaaattaataaaatatggtctttaagtcacttttctaagctatacaggtgttttgtatataaatgattgctgtaaaatgctgaatagctttttttattgccttacttaattggtagtctctttacctcagtcgtgaagtttgaaataggaactaaaaatcattagttttaccacttgaatgataaaactaaatcacaattttagacaaaaaaaaaaaaaaggacacagcaggaggtcaataaaagggaaagaaagagtaaaacacagtttatttccaggaaagaagccgtaattgttactcagaacacataaggagagcgtgattttaaacatttagaggaaatcacaaaagcttgaagggccttcccccagaggcaccttgaaagaattcatgtttctaaaataggaaacatttaccaagactttgtataagaacagtttcaggctagtgtcagcttaactaaagcaaatgaactttctggccttaatagtcttaatggtcactgtgctacttctgtcaacatggtttgcttttctttaaaaaagagtatctgtctatctatctgtctagtatgcatataaatataatgtgcaatatatatattgcacattaatggaaaaataagaaaacttcctcataatattaagctccacaatttttagaaaaagaggtacattttttaatgcaaataaatgatatgcttccattggaattttccaagattctttttcttgtgtgattgatttctgtctggaataaaacttacatacaatgattcttctattgttaaaattcgatacttaaaagagattagaagccattttctcccaatgggaatggtcattttacaataaaatatattttttatataattagaaagactacatattgtttctctggcaggtccccagtcatgcttgctccaatgataacaagatataacaacaaaaatgacgaaagcattttttgggaaataaataaaagtgtgtatatatagatacagatttagatagcaatcatgaaatctgaccttttgatttttgaggggaattcaactgattttgggaaaaatgacaaatttacatattttccatgttttaaatggaaataaattatgttttttgggacttctgactaaccaagtttgcttatttgctgtgtttttatttgtttaacctttaatgaagagctttaggaagaagcagagcaacacctcagtgaccatacataaaaggttttgtcatatcaatttaaagcagatgaataattataaactttttgagactgcaatagcctatcagtgtgtaaacatattctctttctttttaatcttatacgattttattttaagttccggggtacaagtgcaggatgtgcaggtttgttacacagataaacgtgtgccatggtggtttactgcacctatcaaaccatcacataggtattaagccccagcatgcattagccattatttctgatcctctctctcccaccccctgacaagccccagtgtttgttctcctccctacgtccacgtgttctcattgtttagttcccacttataagtgaaaacgtgtggtgtttggttttgtgttcctgagttagtttgctgaggatagtggcttccagctccatccatgtcactacaacagataggattttgtttctttttatggctgcataatatatcatggtatatatgtgccatatttgtttatccagtctatcattgatgggcatttgggttgattccatgtcttttctgttttgaatagtactgcaataaatatatgcatgcatgtatctttataatagaacaatttatattcctttgggtatatacccagtaacggaattgcttagtcaaatggtatttctggttctaggtctttgaggaattgtcacactgtcttctacaatggttgaactaatttgcattcccatcaactgtgtaaaagtgttcctgtttctcctcagccaacatctgctgtttcttgactttttaataatcaccattctaactggcctgatatggtatctcattctgggtttgatttgcatttctctaatgatcagtgatgttgagcattttttaatatgtttgttgcctctataaacgtctatttttgagaaatgtctgtccgtgtcctttgcccactttttaacggggttatttgtttttttcttgtaaatttgttgaagtcccttgtagactcaggatattaaacctttgtccaatggatagattgcaaaaattttctcccattctgtaggttgtctgttcactctgatgatagtttaatttcctgtgcagaagctctttagttaaactagatcccatttgtcaacttttgttttgttgcaattgcttttaacatttttgtcatgaaatctttgcctgtgcctatgtcctgattagtattgcgtagattttcttctagggtttatataattttgggttttacatttaagtctttaatccatctttagctaatttttgtattaggtatgaggtaggggtccaatttgaattttctgcatatggctagtaagttctcccagcactatttattaaatagggaatcatttcctcattgcttgtttttgtcaggtttgtcgaagatcagctggttgtagttgtgtggtcttatttccgagttctctattttgttaaattggtctaggtgtctgactttgtaccactaccatactgctttagttactgtagccttgtagtatagtttgaggtcagaaagcatgatgtctccagctttgctctttttgcttaggattgtcttggctatacgggctctttgttggttccatatgaattttaaaatagtttttctctaatttggggaagaatgtcaatggtcgtttaatgggaatcgcactgaatctataaattattttgggctgtacagccattttcatgatattgattttttctacccatgagtgtggaatgttttttcatttgtttctttcctctcttatttccttgagcagtggtttgtagttcaccttgaagaggtcctatcacttcctttattagctgtattagtaggtattttattctctttgcagtaattgtgaattggaattcattcatgatttgcctctctgcttacctgttgttggtgtataggaatgcctgtcatttttccacattgattttgtatcctgagactttgctgaagttgcttgtcatcttaagaagcttttgggtttagttgaatggagttttctagatattgtatcatgtcttctgcaaacaaagacaatttgacttcctgtcttcctattcgaatgccctttatttctttctcttgcctgattgccctggatcttaaactattttaagttaatgagggatataaatattttataatttcaattagtaattggtaactgccaaaatgtcagagtgctaatctgggatgaactgaaattaacgtatacttatctctatgatctaataactttggcttgtctcttatatttctgttattccctacatgatttcccaattgaattcatcaaaaaccgagcttctactttgtgtcaatttttgtttctatgataagggaataaagaatatgttaaacatataaaatgaagacaatgtgaacctttaaagaaataggaactagcatattttatgggtgcacaaatgcagaatgctttgttcagccgaggagaggttagtagaaaaatagttcctgaagaatcatcttcaagtcaatgttttgttttgcttacctgtagcgggccttcaaggcttctttccctcaggctacatggctgcatttaatttcaaacagcataaacaaaagtcctttatagtgctttgtcacagctgaattgaattatcctagataagacttctcaaacccagataaatatgccattcacttggtgctaaggaataattattcagtgatttcatataaagttgctttttctcttaactttcttgtagccagtgaaaatcccataacaagggacttccaatttgaaacaacaacaacaactaataaatgaaaacattttcaaaagcatattatgtgtggaaatactggggtgttattgagtgatttaggaggcacacaggtacaaataacatactggtataaattgtagaatgatgtttcagatatcgtcaaataataatattctttgtttatatatggtgacgtttcttgattcttgtattctgtataatgtgcccagagttaatagacaaaatattgagttgggtcatgatcaattagtaaaatggtgttgtgaataaaatatacatttaaattttaatcgtatgtgtattaaataatttgttttaggccggatgcggtggctcacgcctgtaatcccagcactttgggaggccgaggtgggtggatcacgaggtcaggagatggagaccatcctggctgacccggtgaaacccatctctactaaaaatacaaaaaattagtcgggcatggtggcaggcacctgtggtcccagctacttgggaggctgaggcaggagaatggtgtgaacccggaaggcggagcttgcagtgagcggagatcgcaccactgcactccagattgagcagcagagctagactccatctcaaataaataaataaataaataaataataatttgttttaacatttgctatagaaatacagctcaaagagaggatgtgaaatgttcccaacacatagaaatggaaactataaagagaattgcattgcaaatcctgacacgtaaatttaatctacatttctgaatgttttcttggtttgcaagaaatggattaacctgaatgaatttgtgaactttgagatattctttttcatgtagatttacaaataaaaattgccaatatcatggaactagagagtgagaatgatagttatcagaggctgggaagagtgtgttggacggggacgggggatgaagacaatgggaagaaggaaggcaaagagattaagaaaagagagggaatatgtttaaaatacatgaagacagaaggagggccaaaataaaggattctgtcttcctcaacgctctattcgtagatcttagcattatgtgcacacataggagatgttcagtaaacaactgttaactatttacaggcactgcagaatttgttacttttattaagttctattatgtaatttcacccataatctgatatgtatacctctatcactgtacatatcataccattgaaataatttgttttgtgagtatatctcctccctcactcttgaattaccttagaaggcatgatccaagtcagttatttcatctccactacttatgtgcctaataaataatcagtttgagtcattatttattatgtatttctaatgtagatatttatttaaaaataaataataatgtaaattttaaataacaatgataattaataaataataaaagtaaataaataataaccttgtgcctaagaaacaatcacttggtaaatagactcaactgacacagatatcattatgtcaataagcatcatcatcaccaataaaaacagttgtgaaaaactattcagcttgctgtgtctactactgaggaaacaaagagatgcatggcatagtctctgatctagaggtatttacaaagtcaattgagaaaccaggatgaaatggctaatgactgtttgaggcaggcctttttataacacaaaggaggaaatgaaacctaccctttttctttttttggaaatcaagtggcttaaaattatattggtaattacacttaatttgtactcataagcagacattaacattcacctttggaagataatttgttcattcaatcaatcttgtatgttctttggggagtgggggagattaggaagctgaagatagcacataacaaattatattttactatatactaaaatggagatgaagaataaaaaataaaagcaagaaaaaataaggatatgtctttatttgcttttatatagcaatcacacttaaagctaaacattatactttatccttacatgtatactttgggacctattcatgagcttcaaatttaaatgcaattcatctaattgctgagatgaaagaaaaaatatgagatacatagtttagcatccctaagattaaaaacataaagaatcaccatgttcccaggaaaattagagctattcaagtatttttgaattattttacagatggctctgtaatcatagtgaaaagtgtcttagataatatccttacaataggtataactatgagttaaatagggctatttcttatagcagtcatcaatataatatagtctgagtaccttattttatccagatttggttagatctgagaatattttaaaatatttgaaaagttagttggatttcttttccttggaattatattcacttagtagattttgtttctactgaatttgcaaaatgtcctatgaggaatacttaactgacagtggcaattgtctggaatgccagcagaattttcttgaataaagtttggattcctgtgttttagcagaaaatcaaattaggattgggttttatcctttcatgaggaaggcaaggaacctggaagctggcttctgcagtgaaccaaaataggacttcacgtcatggacgtggtattcttaaaaataataataaaaaattgaaactactgagagttaaaatgggcagtagaaacttcacaggtatgcttcattgtcaatatacttctaatctaaaaacaataataatctaaacagaaaaagactttgaccttggccaaatatattctcagtaatcatggagtaccaagcattgtgcaataatatttcccggtataccactcataattgagataaaaatctccaaaatgattgagttaacttggtttagtaatttaaatatgggggatactggaacttttctttccactacagcttttcttccttccttatctccttgaatgttccctctctctaggaaggataagtaccaatgtatagataagttttatcagatgaaatgccaaaaacaatgaagatatgcagagctactagccttgtgttattttaaataatatttttcagcttaattttaataatattcacaaatcttagcaaacattctacacacactcacacacaaacacacacacacacacacacacacacacagagagagagagagtctgaattaaatggggctcaaaatctgcttcaactgtttactaaatttataatctaagaaaaagtatcttcctcaatgcttatacttctcattggtaaaatgcagatagttataatatttttctcatataatttttgtgaggattagaagagtggccaagtcataaggcagaatgttgttctgataagcatggagagaattattgcaaccacctttgcaaacaaattacatacgatcgaagtaactgctcactatttttataagtattttcttaacagttttatttgcatatttcatcagatgaaatttagagtcattgtcaagttttccttggtcttcattcagtttgctctcggagtctgcccagtgcatttgctttgtatacttattccaataatatcttatattcctacaatgtattttaattttctgcataatttatatgtttattgagtttgttcctgtgatttaaatttttcttttttttcttatgtattatcacaatatttctacttggttattagtgatatagaaaagttttgtttatttgtatgttctttattctaaatgatttcatgtttaattcagtgtaatttttaggagttttttaatttgttattttcaacaggcaatattactacacgcaaaacattgaaaaatatatatctactctttttttatattttcttttgttcattctttgttctgttggcatgattaaaattgccttcattttgtgtaataatcttcagtatgttaacactgtgtaagattgatgttattgcaagataggaatcctttatcttgcagaaaatagaagctctatctctaatttattagttttattatccattcacctatttacttagtcatttaataagtatttataggccaggcatggtggctcaggcctgtaatcccgacactgtgggaagccgaggtgggcgcatcacgaagtgaggagatctagaccatcccggccaacatagtggaaccctgtctctactaaaatatgaaaaattagcctggcatggtggcacacacctgtagtcccaggtactcaggaggctgaggcaggggaatcgtttgaacccgggaggcggaggttgcagtgagctgagatcgtgccaccgcaccccagcctgatgacaaaacaagactctgtctcaaaaagaaaaaaaaaaggcatttataaaatgcctagtatgtgccagatacttcaatcaaaaatttaaaaataaaaacaaaactatagagataattttatgttttaattctttgatttaataattatgggtccaatttttataagcaaaaataattgctcttactttactcttgcattttatctcattattggttactatctacaaaccaaaggccaggaaaaagtcaatgaaaatgattttattcactattttgtttactttttgtattgttcctggtgcatttttcctaaactgctatgctatataacagagcgctattgtaaaataatctaacaaagctgcaaattctttgtaacatatttttcctgtaagttgaatataatgtcctctaaagtaatttgtatacagaaatcatatagcaatatatattagggaaagaaagcactgcatctttttaaaaatgggataaatcatattacatatccatcaaagtagaataatgcacatggggttaataaaaaggaacaatttgttaaattttttccagaattgcatctagaagcaaaagtcaatttggcttaatgcctataatggagttaataagacactttagaaagtgattggtttatataaaaaacatggggcgtttgaccttgatttttaaattagagagaatcgattggcataaaatgcaatctgaacctacacaatttcaattaccagattcattcttaaatgatatcccagaatcatctatcattgctgggtcttacacaccacttcaggaactctcatatagttgtaatttaagaaattttttgaaacaacttagtttgagaaattcattatggcttcgttaagtaaaaatttcataataacatcatacagtttggaagcattatgattttggaacattgcctaacttggcaagaaaacagtttgtgaataagaaatctagctatcttgttagtatgctaaaatattttttgtcaaaattttcactaagttctcctccaagaatagcatgtttcttggaaatggtaaaattgatcataaatgtattctatctacatacaagtgcatgatctgcatctcagatgaactttatgcaattatcaaatagatggtttacaatgattaaaccagttgaaacaatactaagataaataaaaattcatagatgcaaaaatatattgataggaaaataatttatcataatcattgtgactgaagaaaatttggcaaatgtagaaaagttataagaaataaataaaaactacctgtaactaattcctagatataactttttgactctatgactttttttacaggtttatgtagtagtttatttctctgttttcctcctcatttggcttattttcaatttttcattcattgtaaacagtactgtaaaaattaattgtacaaaatgtttgatcacataactgatgaataagaataggtaattttttaaataaaatattttccaattgagatgtaagactataagtactcaaactaatggagctgaaaaagtataaagattagcttctgattatattctaagagtagaaattaaattgagatttagccaagtttaattatcaactgaaatagttttaaattattttctagtttccatgtctgagttttgagtgataatatgtgtatgcaagtatgttttcattatggatcaatggttttaaaagtttagtctcgaatctaagttaatggaacattttttgatagagtcataatgtctcccacatattaggcgacctctgtttttccatatgaattgcttttaaaattgttgaaggacggaaaattactaggggagggtgattctgtaaactaactgtagctttccaactgtgagtaggaaaacactcatatctttctgtagacctcctgtacagattcatcacttatgaaaaccaggatggaactagaagtctcaaaaagtcacataaggccgggcgcggtggctcacgcctgtaatcccagcactttgggaggccgaggcgggcggatcacgaggtcagcagatcgagaccatcctgggtaacacggtgaaaccccgtctctactaaaaatacaaaaaaatttagccgggcgtggtggcgggcgcctgtagtcccagctactcgggaggctgaggcaggagaatggcgggaacccgggaggcggagcttgcagtgagccgagatagcgccactgtgctccagcctgggcgacagagcgagactccgtctcaaaaaaaaaaaaaaaaaaaatttaaaaagcgagtagtcctcttttaatatttttatgtaattcctaattggaatattgtttaagtagcccttgttccagatgcacatcaatataagtgtggtaagttttcattttaggccacaaattaaagttgacatttaatgtaattgtctttatcattgtctattactatctcagattcctagtcttttacatggtgaaaacttggtattgaataattgggggaggttttcctcttttggcttttgcctggggttgcctttaaatttcataggattttgatcctaaaagtgtggggacgaaattaagaggaaataatgagaaaaaatctattcagtgtgtgcaagggagagtgaacagtaggaaaaagtagagaacgggcattatctgttcatgcaggataccggctatatctgtattctcctcactctatctacaaaatcaggtccatcagcttgttttgccacgtccaagctgctcttggccacagaagaaaacatttgtgttttttccacaacatatggaaagctttcagggctatctctggcctgactgcctacacagagggaactgaaacaagtcttttctgcctcttcctcctctctctccccttcatcttcctccgcctttaccagcttattatgaaaaaaatttctggggtcttgcaacttttggatccctaaacctttttagaagtttttatcatttttcttatgaattccaatgctgaaccctggataaaacataaaattaagaatgaaaattatgatattgatcctcagttctgtctaaaacaaatacaaacaaacaaactgataaaagaaaacaaaatccttgatcagtgtgacaaagggcaaagattctatttggatttagatttctttcatgatagcgtctgccccgtaaaaccaaacacacagactgtgttaatgtcagggttttaacatgcgtcactactgaaaaacaacctgtgcaatatagaataataaatgtaagatatacaagtcagaaatgttcttaagttagtaattactctaaatcttttctgggacatgtcagtgtataaatacacacaattcgagattcaatgaataatcttatagaaggtatttttattttgtaattataacctgtctgtagtagaattaatctttctttgtttcagcccagtcttttaatattactctccatctttacaatatgtctacttagagaatctccatgcatgcatccttagcaatttatttccttggatgtgtactccttccaatactgtccgtaaaatgccaggcaatatttgcagagttgctaacaaatgacttggcattttctattgtgacactccttcatttgattgttggtttttttttttttttttttttgattccattctttctagtgctttggtggtgagaactttgttgtgttctcttcggagatgtgactcactcaatgattaggaactgatctgaaaatatattctttcttaggtggaagtgtgagcaccaaaatcactaaatttcaactcaaagcagagagcaagtatttctaattaacactttactctcagtgaagtgtagaccattagttataaggttacatatacatatatgtgtgtgtaggtaggtagacagattgatagatttttttaaacattggctgtccgtttttaaaatcagttttcatttttccctgtgtccttaatcatatgttccttttattacgtctataaaaataatttgttgctgaataagttgacaggtaacacagcttatttgatcatctccttgaagatcacaattcacagttatgtatcaaaagctccaagaaagtctgtagtaaataaatagatttaaactttgcattctggtgttttcaagatactgcagttaaatttgctttgttgtttataatccttacatagtcctccaatatatgtgtctttgatgatggaggaatacagcacacacacatacatacacacacacacaatttatctttatcatttcaattagtgaacttttaaaaattatattgttagatgacaaagtggtaacactatagtaaaccacaaaaaatttaattatgatggtaaatgccattttattatggagatttaaatccattcaaaataaaatgtatataatatattttcacaaatggaaaacaaaacatggcagaaggatttgccaagaagttacttctagttattggtagcaaaaaaataaatcacctggagtgtgaaatatgctattgcttcaaagaaaaacattgggctcattaatttggtatcaattagtatttcaatatttgattggtagaataataggtctgtgggaggtgtgtgaggaagaaacatattgaagaaaaagaaattcttaaatctgttttttcattcaagagtctacttacaagtcatgttaaagtatttacattaagacaactattaaatattcttccctgttagtaatttattgtctgtctcctgccacaagaatgtaagctccattagggcaaactttttttttctttcaacttttattttatgttcggaggatacatattcaggtttgttacctaggtacactgcatgtcgctgaggtttgagatacaaaagattctgtcacacaggtactaagcatagtacacgatagtttttcagttcttgccctcctcttttcctcccaactctggtagtacctggtttctcttactgtcatctttatgtccataaatattgaatgtttagctccagcttctaagtgagaatatgaagtactttgttttctgtccctgcattaatttgcctaggataatggcctccagctccattcatgttgctgaaaaggacatgatcttgttctttttcatggctttatagtattccatggtgtatatgtaccatgttttctttatccaacttactataagtgggcatctaggttgattccaggtctttcctatggtggacagtgctgtgatgaacctgagagtacatgactttatggcagaatgatttttattcttttggatatacacccagtaatgggattcctggcttaaatggtagttctctttttagttctttgagaaatctccaaactgctttccatagtggctgaactaatttacgttctcacaacagtgtataagcattccttatttgcaggctcacaagcatttgttgttttttgactttttaataacagccattctgactggtgtgagaggcatctcattgtggttttgatttgcattgctctgataattagtgatatggaacattttttcttatatttgttgatcacttatatgacttcttttgtcttttgcccattttttaatgggattatttgggttttgtcagtttaattatgttacttataggttctggatattagaactatattggatgtggagtttgtgaatattttcttccattctgtaggtcatctatttactctattgattgtttcttttgctgtgcagaagaagctctttgttttaattaggccttacttgtcaattgtagtttttgttgcagttgctcttgggactgagccaaaaattgttttccaaggctgatgttcagaatggcatttcctaagattttcttctaggatatgtatagttttaggtcttacacttaaatatttaatctatcttgacttaatttttgtatatggtgaaaggcggggttccagttttattcttctgcatatagtttccagctatcccagtatcttttattcaataggaagtcctttccctattgcttattttttttttttttttttggagatcagtttgctgtgggtgccaggctttatttctgggttgtctatgctgttctattggtctgtatgcctttttttcttttgccagtaccaggctgctctaggtactgaagctttacagtattctttgaaattcggcaatgtgatgcctccagctgtattctttttgctaagggtcactttggatattcaggttcttttttgctttcacatgaatttaggaataatttttctagttctttgaaaaatgaaattggtagtttgataggaatatcattgaatctgtagattgctttaggcagtatggccattttaatgatattgattcttccaatccatgaacatagaatgttttttccatttgtttgtgtcacctattatttcttttagcagtgttttatagtactcgtcgtagagatctttcaccttggatagatatatccctagatatttcttgtggctattgtaaattggattgctttctcaatttgcctctaagcttgagtgtcattgatgtatagaaatgctgctgatttttgtacattgattttgtatcctgaaacattactgaagttgtttatcagttccaggagacttttgttggaatcttcatgtgggtaaactattttcctttattttattcattggtgtaaccccagagcctacctcattccttgtagaaaattggtttggaataaatacttcttgaaccaatgaattattattataaattaacaatgacctttttttacagtctctaaagcttatgacctctctgtaataactctttctattctttctttcacaagtttaatctgttgttgacttcgagttatactcagtgaactacaaacttaaggcagtccttcagaatgtaccttctgaaatcccctgcatgagatcaccagaaaggttttaaaatgcctgctactgagtcctactacatacatgcaaaatcagactttttggtgcttaggcatatgaatctgcaaaaagtactcttaagtgattcttaggcaaataccaatttgagaattttcaccacatggtgactcaataggtcttggaggaattccactcaagtacctctctcctattccttcctgtggactgggtttatttatactcaacacaggcttttagaagaatgaaaggatagtattgagttactacgttacattcagcaaatattgattgaattattaattgtgaatctgaaattaaactcccgtgaaacgttcattgaagttctgcttttaaccaaaatatacttgcaagattagttatcaaagtaatgtttttgtgataatttcagtacaatgaggcatatgcaaaaaattattcatatcactgtcaaactgcacacactctttattgcttcacatgtatgcttaaattcaaagtgcttaggtatatttttactgatggtcgttctttgaatgtgtctagcaacaattaattctggtacaaaagtaagtaatacctgtaaactggagatataactgcatttatgtccctttctatatttctatagttttgattttctttgcataaacttattattactattattttttcttgagacaaagtttcacttcttgttgcccaggttggagtgcaatggcaccatcttggctcactgcaacctctgcctcccaggttcaagcaattctcctgactccgcctcccaagtaacagggattacaagcactgcctccatgcccggctaattttttttgtatttttattagagacggggtttcaccatgttggccaggctgatcttgaactcctgacctcaagtaatccacctgcctcggcctcccaaagtgctgaaattacaggcgtgagccacagtgcctggctcattgcataaacatttatatatgctatggacagtagagaccagaaaacagctttacactactctgactatatcccacggaaggacattacttgaagtacatgtttctgtcatctaacgctggcattgtcactttcagcactattgacatttggggccagataaatctttgttgtaggggatgtacgggactgtcttgcgtatcacaatatgtttagcaatattccagacctctattaactagatgacagtagcgtccctcaagttgtgacaatcaaaaatgtcttcagatactgccaaatatttcctggaagacaaaatcatcaccattgagaacccactgatctaagggatctgaatgggactatgttgtttccttgagttatgttacaagcagtgacatgaacttatgacatcttatactcataaacttggttagttgagcccaaattaattgtgtgtgatgtttcaacaatttggttaaatattaatttactttattttacttattatgaaaaatgagatctgaaacatatcttcacatgtcacaaatttaactggagaggtagttgttatctaatgaacgcattttgcattgttagccaaatcaggtaacgctgtaagaactagagttattcatcatcattataaacattaaagtgatctgaattacactacccacacattatttcatctgattatataataactggcaaaggcagtgcaggcaatgactgtgagccagcagaccctggaaaattggcatactaactgtgtgatcaagttggcctcagtaccagaggtttacagattaatggtaggtacggatttatattgtcatgaggcaggagccatcgttaaatagaatttcagcgcaagttatacaggtcacaagttcctaggttgcagctatcataccaaaattgaagctatgattgtccatataaatacctccaaaggctatgtgcaggatgattatggcagtatattccagcagctgccaaatagtaaactcgagtgtgaaatcactgtatttcaaaatatctttatgaaatgaggcttagcatagaaatgctaagaaagacaaaccatccaaatctttttattttgcaaactgactgattcgtctctgaccataaacaaaattcagactgtgaaattaagtatcacaggaacaaaaacaatattgacaaagcaagaatcattactaatcataggctagtctctttatgcatatgatacaaaaaagatctataaagctacagcttaaaattagagccaaaggattaatcacaaaatattaatccatataatttttgatttgcaacctaactttggctgaaacctttaaaatgctactttcattaaggattaatattgacagaagtttatagctttactgaaaagtgaacgtcagaaagtcaaaatgacataacttaatagtataatcaaacatctatgtagaattttctgtgtgtctggccctgttttagaatacagaacatttgttcaaaacttcttgggataattttctggagttattagcattgactattacaatgaatgttaagagtaggaggaagatttaagtatagatttagaaattaagatacacatttttattctctctccatttaaagatataatttgttttaattttctgaactgaatttcttcgtatgtaaaactgatttttggaagaagtaaagagcatgattcatgtaaagactctactccaaagtctgatgtaccatatacacagactttatctaattgcttcccttccttcatttcagataaaatatacagcctttgtaagccctgctacatttcttttattattattattattattattatactttaagttttagggtacatgtgcacaacgtgcaggttagttacatatgtatacatgtgccatgttgttgtgttgcacccattaactcgtcatttaacattaggtatatctcctaatgctatccctccccctttcccccatcccacaacaggccctggtgtgtgatgttccccttcctgtgtccatgtgttctcatggttcaattcccacctatcagtgagaacatgtggtgtttggttttttgtccttgtgatagtttgctgagaatgatggtttccagcttcatccatgtccctacaaaggacatgaactcatcattttttatggctgcatggtattccatggtgtatatgtgccacattttcttaatccagtctatcattgttggacatttgggttggttccaagtctttgctattgtgaatagtgccgcaataaacatatgtgtgcaagtgtctttatagcagcatgatttataatcctttgggtatatacccagtaatgggatggctgggtcaaatggtatttccagttctagatccctgaggaatcgccacactgactaccacagtagctgaactaattcacagtcccaccaacagtgtaaaagtgttcctatttctccacatcttctccagcacctgttgtttcctgacgttttaatgatcaccattctaactggtgtgagatggtatctcattgtggttttgatttgcatttctctgatggccagtgatgatgagcattttttcatgtgtcttttgggtgcgtaaatgtcttcttttgagaagtgtctgttcatatcctttgcccactttttgatggggttgtttgtttttttcttgtaaatttgttggagttcattgtagattctggatattagccctttgtcagatgactagattgcaaaacttttctccctttctgtaggtggcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggatttttatggttttaggtctaacatttaagtttttaatccatcttgaattaatttttgtataagaaatgtaaggaagggatccagtttcagctttttacatatggctagccagttttcccagcaccatgtattaaatagggaatcctttccccatttcttgtttttgtcaggtttgtcaaagatcagatggttgtagatatgcggcattatttctgagggctcagttctgttccattggtctgtatctctgttttggtaccagtaccatgctgttttggttactatagccttgtagtatagtttgaagtcaggtagcgtgatgcctccagctttgttcttttgacttaggattgacttggcaatgtcggctcttttttggttccatatgaacttgaaagtagtttttttccaattctgcgaagaaagtcatttgtagcttgatggggatggcattgagtctataaattaccttgggcagtatggccattttcatgatattgattcttcctacccatgagcatggaatgttcttccatttgttcgcatcctcttttatttcgttgagcagtggtttgtagttctccttgaagaggtctttcatgtcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgaagccctgctacatttcaatgacctaaaaactgttgtggcaaggccttgatgacaggcataagtgcttagtactatacagacacagattagacatttaatagctgtgaccattgaacaaattaatgtattttggaaacaaagggaaaatatatcaaccagaagtgctcacagatttaactcatgtaataaatacagtagattattgagcacaaactatataccggacatattctaggtttttaaaaagggtatgttatttgaaatccaaatattccaatgtagagatttttatgattctctttttgcaaatgagaaattaagacaaaaacttatctaatatatataatatattgatacctgagatttaaacctcagtggaagaatttatacagtcttctagtatagtgaactttctccctattcaactttttaaataaatacaatttctttagtgttggtaaaataacattgcaagtatattgagtattaactgtagctccataaataataatccacaaatagaggccattctttattcactgtcactacatttagatagtttatagtagacaagacatcctgagaagagttgtttgagcttttttgttatataataaggaaaatattaatttctattctgctttagggaattttggggtgagagcacattgggatcattagttgcttctcagtgaaggcatagacacttcaataggttctcaataggcatcaaatcactattttgcatttttgtgataacataattgaatagacatgttggcattgtcttggtataatatagtaattaggtggtaaagctagaaccagtgatatctcctgtgttccaaaaatcaattaacttacttcagcactgcctgcatgacaagcctattgcacttaacagagatcactttagaacaaggttcttcctttaatgttggaatcatttagtcattacttgacattataaattcattgagtgttgattaatgtctaatgcccaatgtaataccaggaaatacatgaaggatattaaatcttaaaaatgctttggtgtaataaattgttaattcactgataaatttaaaatatcattgggaaagcctcttggtatgtttgacagtagtgtccactctaatgaaatcagctgtagcaatattaaaaatctaaggaaatgcaagatatttgcttttgtattttaaattcatgctgaattttttttccacttaaattctgatgtacttgtttaagatagattttgttccacagggattcacatttttcttgtagttgaaacagtcatctatggaaggcgatgtttccatagatgactgattatacttgttatagtggcaagtactatcatgtggtcagttatctttggttattatcatatcccagatactaaatagtgaacgatatcatttacaagtcacttattctctctggggtccaagttttgtattctgtagaacaattaatttcccttacatctcttaaatgtctaattttctaatgtgcacagtgtggtctgaagaaacagaatttgaggcactaaaatttgttcatatggttattttgagtgttatagatttccccagggtaaaacaattagacttgggaaaagaaactattgatagctactttctaaaattaacattttattaatatcagaaataatgataactttgccgatgccacaatatccatgaatcagatacatctctctagggacagagttatagattgccattcacctttgtgttgttcttcaaagctctgcatattggaaacaaaagtcatctaagcaattcaaagaaaacaggttatttatatgttttattttgctgtctcatcttcctccccatctgaatgatataaatgtttataaataatttactataagagaagagatgtgatctttactctgtctggttaattaagaaaatgatctaacataagataatgcctccaggtatacatgtgtgtggaaagtgtgtgttgagggagacaagataaatacatttaagtaaagttgttttaaatgtctagaagaaatggaggtatcaacaaactagccagtcagttatagaaatagtatcttccatatctttttttttaatgtgtaacccaatactcaatttacctagtaatttatacaataaatgtagatggcaacatttcaagtaaaatatttctagatttaaaaaatgaatttggctttctcacctacgtaagtatctctttggaaattgctgatttctagggctataactataacaattgtcaagcagagagaatcaatgccttctttattttatgtggacgtacaaatatgtagcctaataatccaatatgaaaacacagtaggaatggtaacatttttaaatttttttcatgtatggtagtaacatgtgttttccatacaacgcctaagtggtggttggaaagcttcctttatccatggctatatggagaagcttttgtgtcctgtcgtgaggaaaacagtgagagagataaatatgatagataaaggtttaatatggaattattttagaaaagcaaatcataactttttagatccaagtgactgaaaacttctatatgtaactttgatttacatttctttctctttcaaattgcatctttatcaggaccctcaattctcattttattcaaatagtcttccttgacttctgagacccatcattctcttgattctccctcctgattttctttatctctcttcacttcttacttttgttaccttgcacttattcttccactgataacttcatattgccttttgtttaggggccattcatgaatctctcatcttttcgtatacaccctttttatgcggattagatcattttcccagaccttaactatagcttatttgtcgaggccaggtatccttgagttctgctcctcaactgtcagttacttaatgagttgtttaaacaaacaaacacacaaacaaaaaacacacaaaaaaaccccaaaatcacatctccaaattaattttaaaagcattattccagaaattattttgaataatcatatttcatcaaccagtaacatttatcttatatataactaaattccaaacccaaatggcttaggaaaaaaaaaaaagaaaaaaacatctaatgtctcatataatttagtggcagaaatttacacttcaattaggagtgtataaacatccccctagacctatcatctcacaaacgcttgatattaaaacttttaaattacttttttcatttggtgagcataaaatattaacccattgtggcttaaagtttaattcgctagttactaatcaattaaattgtcctttctcaggattttgattctttatattttttgttctgtgaaaagccagttaaagtttttactgaattgatatttctttatatagtctatgctctaattcattggagacattgtgttgcaaataatttctcctgattacaatgaagttgaatatattttaatattcatcttttctttatggtttgtacattttgtgtcttcttcattaatattcttattatgatgctatagcaagttctcttaaatctcttttttttttttggctttcacatttaagtagagttctgtttatgggttcccttatatatatttcattaattcgtgatatggtttggctgtgtccccactcaaatctcaccttgaattgtaataatccccacgattcaagggcaaggctagctgtagataattgaatcatggcattagtttcccccatactgttctcataacagtggataagtagtgaataagtctcacgagatttgttggttttataaattggagttcccctgcaccagctctttgcctgctgccgtgtaagaatgacttcgccccttattcacctcccaccatgatgtgaggcctcctcagccatatgaaactgtgaatccattaaatctctttccttataaattacccagtctcagatatgtctttattagcagcatgggaacagactaatagcattcatttggccatatttacgtcaacaacgtatagccataatttccatatttttgtaataaatttgtataccttgttcttttttaagagtgtttgactcttaagagtttattttgttgcttgtacttctatgtgcattttaagattaacttgatacatttcacctaagatttttttatttaattttactaactacattggtcaatttgagttagttatttttagataattgactcttcccacccctgaatatgatcattctatttctttatttagattgtatgcactctgatagcattatccctcgttgctgtataatttttattatacatataatgggtatttttatattgttttcacactcgttcctcgtgtgcatatatgcagttgattgtatgtgtttactttgcacccagcaacttttataaaactcattaactataatagtttatctatggatccttccctgttgtctatatgaaaatgtattaacacaaatatacgtttatatatatatatatatatatatatatttggtagaacatatgcataggctctatgcattaatatatacatacacatgctcatcatatattgtgaaacaatgtttaaatagcaacctgttataaatccaaaataatatttataatttggcttttttcatttaaaagattgcagtaacacacagtggcattctaagtttcaaataatggttaccaatggtaatattaaattaatgctatattagatcatacaaagaaagaattatggtggactggggtggttgaacgttacttaatggaggaacttatgttgtagaggagagatgaacaggtatggatggataaagtattctagggaagaagaaacataaagacttagtttaaaaaaattatacttgcactgaataacatgaatattcagtgatgtattgctttcacgaaatagggtgaattctgtgaacttaaatattaagtactgccgaaatacatcatggaaactcagttgagaattatttgttatgagaaaagtagtcattttgtttttctccaatttggaaaattaaatcatgaggaaatagattttgcatcagtaaaatgtatctttacattaattgaagctattgctttggctaattttattttctgctacttacaaaggcagtgataaaagtagtaatatgaactatatttgtcccagattccttattactgaagttgaattgttgataccttgaatgttcctattttagtaattttagtttcatgataacaaaaatatctcagtcagagtatgatttatttcaatatatacatggaagtgtttaaatcaacagattttaataataatgtatgctatcatttaattaacttattgtggtcattgaatattattgacatcataaatttttctcatgttaccccaatattaacaaagagtaaaatgtgcttaataaaaggtgaaccctgaaaataattaaaaagcaggaggttgagttccaatatttctgtagggggaaaattaagcatttattttggccaaagaatctttttcctttgactagtatactattttgaacaagccgatgttttcttaatgaggtttagcaatgttaaattatgtggaaaaactaagatacttatccaacaagaacaaaatagaaaggggtaaggccaatatttgtcaagaaactatttctattatatatatattatacttagcaacatgtatagggtgagtcacctgtgcattacttgaatagaatagaacatcaaacatttgtttggtgaaaactgcagttaatattaatgccagaaaagagttaatgatttggggatgattatttttaaaatatatccagaaaatgaaacagttgatgaatagtaattaagcatatagttatttaactatatgtaacgaatagtatttaacatatagttactattttgggtgaacaacaataaaagttgaaggggataaattattgtgggtatttggaataaatatattttatgacatacaaagtgaagaaagcttttaccaacgtaaattctgtttaaagattttagaatgcctaataatattacactaatataattaataaattaattaaataaatactttagagtcacatatatgagatacaaatctaagattgctatcattttaccatatgaatttaaaaactgcaaatagatattcaggagattaacggaccacaaaaaaatttacatctatttgttagttaatgaaaaataaagagctagtttctaatttgaaagcttcatagtaagtatgaattaaaagaattgtgcattttttacaaaataaaaatatggtcattataattttgtaatatttatttatatattttatatatacacacatacatgcataaacacacacacgcacacacacacacacgcacacgcacacacatgcacacgcacacacacaccccacattgggtgctctttcgtttctccactctgataaagctttatacttgatatagttcagcaacagttctttttaaagataaggaatttaatagtgacaccctgaaattgtgattgtttaaatctataaagaatttgggagcaaaatcaaaaatgatcagtaggctagaaatatttctatcattaaatgacagatagtattttcttgttttacaatttctatgaagaacatttacaattagaaaacatattcaatatattctgagtttttgttacaaatcaaaaatagaaaataaaatgaagtgaaaaactattttatctggtgttttacccattttagaggttgaggacacattttctatagctttgatttgtttattatatatctggacatctagaccctttatagtgtatacaaatgtcaagcatttagatttttataaatagagactttctctggtcttactgtacaatttcttagagaaatgagtgttcctttgaattgaaagagccctgcagctgtgtttgatagaactgccaaaagccatctataaaactattaagagtgaagaactattacagttgaattcagcattttatatatatgttttgtttgaccacaaatagcaactggattgtaaagccttttagttatttataatgcatttatttcataaggcttggtggtgatattaataaaggatattatcaaaatagaatgctagataaaatactataaatatatagatatatttattaccaatggaaaatgattacataatttatcaaaaatatatttatgccaaagttttcctgtaagcaagggactcttttcagtggcttctattaaacttagggtacagcatataaaataaaattacaagaactacatagataatataaacagaacaaattaatgaaactgaattcacaaactatacaaaaaattattacgcaataccttctatgtgtttctgtggttttataacatctaccctacaatcacacatgaactctccttcaaaatgtttagaacatattaaaaaaaggacaagtaaatgtttgcacatattccaagatagatgcacaccttaaaaataaggtaatgacattatgatggtgctaaggaggatactaataaaaataatactgattaagctctttgcccaaatcattcagatgccaaatgacagagccagattcagattcgggtctgcatttttctcagggtctgttacatgtgttagagaaggtgcacatggttcagaagaaaggtaagaacagaacaaaatctgggagaattcaacaaatttatttccattctctattagatttaggaataaaaactctattgtttgcagagcatcttcacaaatatttactctggaaaaggtgccatgtgaataaaaccaggaaggaagggtaggtcaaattccatttcacatgtgaggaagtgaactgtcacaagctaagagcattgctcaacgttgcacaacctcactgtagactggtggagatgaagacatgtctacaaactgtttttattgctctttttactagtttgtcaaactatccatctttactagtttgtcaaactatccatacctatcttaaaaggagctataatttcatgatgagaacacttcatagtgattgttgcagccaatttaaagaacattgtggatattcattgatttttttaatgaaaaaaaggtgtaattttttattcatttatttttaatattgaaatggttacgctttggattctatcttagcaagttcagatttcaggaaagtagttgaataaatatactcatttctgaagccaaggcaagtttcatgaagactgtcttctaatgtgtatgtcttcatattatagtatacatacacaagcatcctgtaaagcatagctttaagagaaatgtaagaaagtggagaatttgggaaaaatataaacaaaagtatgagaggatcacaatcatacttttctgtattgttctaatgtttacaaagtaattatcaagtatgtcacctaattttttatcattaagcctctgaaagaagtatcattcctattttacgcttaagagacaagaggttgactcaccaaaggtcccacagggatagaagggaaatttagtgagatgaaattccttgttcttcatgctatatcacaatgcctttctccccctgaacacctaaaactgaaattctcgcggagttttgaaaccacatccatgtgaatgcaatctcaaatgtcccgtgtttatgagacttctcaaacaaaagagtgtattctttttttaactcctatttttggtttgggggtacatgtgcaggtttgttatataggtaaactcatatcacgggggtttgttgtacagattatttcatcacccaaatattaagcctagtacccattagttatttttcctgatcctcaccctcctcccaccttcaagtgggccccagtgtttgctgctcccttctctgtgaccatgtgttctcatcatttagctcccacttaaaagtgagaacatgctatatttggttttctgtccctgcacaaacaaaacaatatattcttaagagtttattattggacctagtcttacttattgtacctatgataacatatcataaatcacttatttattttttgatttacacgtgtcttttttacatactccatttacacaagttaaaaaattacaaaataaaaaatcattccctctccaagtatgcagagataataattaaaattcagcttcagagattttaaccacatgtaataaactcattcattataatggtaataatatttcaaatatgtcaaattatacgttgtatctaggttttttcttatttatgcatttttgctagttggggttacaaaaataaaaaagaaaattattaggggttgaatgtaaatttcactgtctatttagtcagtaggtaaaaagttgtgattaggaaaataggacagacactaagatataaaattattttataattacaaaaaacattctgtcaagcgtatttcagattttaaaattactcatatccaaaaggatactgatttgtgtttttttattaaagtttctatctttaggaattaaaaatttatagctagagagtaataggccaataagaaaaatttaaggcaaagtatagtattattttcgagttatgatataacactttgtttttaaagataagttaatgtaatatataatatgaatgaataacatacacacataatacatgcaaatagtattgtatatatgtatgcataaggtatcatgtttgccagtgcatttgctatgcacaaattatgtatccatttattttctgaatttaaacaaatacgatcacatattcttgctttttttgtatactccccctcttttccatgtaaataatctagtatttttcctctgcgcccttacttctaaaatcctatacccatatatgttagtatgtttacacataagtattaatattaatatattcacatgccatgttttgtaatgtcaccatttttttgcttaaaaagtgagatcatactaaatacaatttacttgtgtcttcattactcaatgacatttatctgcagtggtgagcaagtatagctccaattcactcctttaaattgttatatgctaatatatggcaaagaaaactcacaggtttttcaactgataggcatggtctttgttttgacatgttttcttcctgaactacagtaattttatttggatgggatatattctgaggacaagaactgttgagtcttggtttaaaggaatgtgtgtgtgtgttagtgtgtgttttatgtgcctgtggaaattgaaaggaggtttacaaaattgcttttgaaaataatttcacatttctaggagtattgaataagagtaccttttgctctgcacttctgaaaacagtccatgttataattttgtttatttcttccagactcatgtggtataaaaacaatatctcgttatttgaaattttattttctaggctaatagaaaaatttagcaccatttcatatattttggtcactctgtaaactgtctattcataaccttttatcattttttcacttttttaattttccttgtcaatttgtaagtcctttctgtattatataaatattaatcttcatctgttacctgaagcgaaaatattgtccctatatattgttttcttatagaattcattgttcataatttttatcatgcaaaagttttaaatctgtatgtagtctaatgtggctatctttttgtaacatctgggattcctattattgcaaacatagattcatatttcttaactctattaatttattgtttacatgtaagcatttcattcatttggggatgtatgtaaactgccttaaatatatatattttaagattttgtattttaattcttctgtgtaattgttttttgatgctcaatcaaatgtggatagtgctctttacacatgtacaatgcctccctcattaaagatttagaactttctttaagaaaaaatggaattttaaaaatatttttgttcacaggtgcctactgctaaaatatagaaagggtaaagtcaatattatgataatttttaaacacaaaatatctcttggaagtttacaatcatcaaaaggagattcttttatctcttcctttaaatgtcactaaatataactatactttgtttcaaaatttggtccaaatcattatttctgaaaacaagaaaactacacacaactaaaaattagcatcaaaattcttacttcatattcacaatcctcttgtttttagagaggcagtgtgtagaaaaaatatggtattattggatggttatcaaggttttattcacatattcccaattactagctatgtgtccttgactaatttaagccaatttgattgtctgtaaaatgaagataaagctgatctcatggtattatgttagtatcagtgggacttgtgagggcacttaggaatcctacaaatgctatgtatgtataacatcactgatgggaaattccaaactcttcggaagcaagatgtgggcatttgtttactcttagttgaatggtattgcatagctacttggagctacttgtgatgaatcagtatttatagataaacttaaagagattatagaatgatcccctttttcaattgtcaaaacttctatttatctaaaaatctaccatgccattatattcaaccagtaaaaaaaatgcagtcctaaaatacatgcatattataaaagatctgtaatatttaatagctaaccagtaatgtaaaactaatgaacacatacaatgtcacataccataagtcccatgaatattggttaaaataataagtaataagaaaattgaatcgtagagttaattgtgacatgtaattgagattttaaaattaaaatgtgtaattcttcttagacaatatcttcataagggcaacaaaatagaaatacctactcaatagcccctgtttattgggtttaatgtagtaaaacattgattgtttaaaatgtttgcttttgaagctattgtatctcctatatacataagagcaggtttattctgaatgtgttttgtttatctatatttaactgaaaactgtcagtaacctccaaaataacacaatagaaaataaaacaatttaacactattatctttgggctaaaataaatgctaatgccaaaatgctgaatccatttcatgtaaacaggggcgttgacacttgaagtgatattcccttggggttgagcagtgaggctcagatgcatacacatttgtcagttttgtggtgtaattttcataactaacatcatcataattaccctctttgaagataggtaaggtgataggtgtatttgaatttgatatcattctcttatacatctagagtgacttacacaaagcatgtacttttattacgacacatttgtggcataactttcagtacaatctgattgacatggggtctaaatccctgtaaattctcatactgtagagccttcctaagccaaatcatgagaaagcaaagctgatgttcagcacccctcgggcattccatctaccaaaggagtctctaaggatattccttagcctaaaatctcctaattgagcttctgaaattaaggtttatttctaatgtgaaccatatgcttaaaccatactggtgatcatgtagtccctgagattcatgacatttcctcctctcaatatttcctttaagcagggattaaactgtgacatttgaaagccatggcctttggagatagagtactgagatatgactttcacctctaacagtttttaactctgtggccctaggaaagaggcttaagctgcaagcctattttccctttttaaaaacagaccttactcagagagaattcatgatgaatgaataaaacaatctatttgacacccttaaaacagtacttgaaattaactttggaaatactttgtttttattattttgataatggaatttcatgatgataattattatgatagtaatcataatgatagctactattattgattgagcatcttctacgggaacttcttcccattatttattctctaagtttcacttattaatcaggaggacagcttttattttgtctactctataatacctctttcaaaatgttggcataattaacctccttgtcttctgagccaaaaaacatgtattgcttatcatagacttctttgtttctttttttttttctctctcttttttttgcttcattatattttacatacacatatggatgaataccaagtgaagtttatttatattaatgtttaaaattatgttatgtaaaaacttgttttattctgctttgtttttaagggcccctcttaattaaaaacgttaaattgaattcttttatttaaaatatttatgcatttcttcatatttatgagttagataaaggtaatggtaatggcttacaatttattctttctcctgcaacacctagcacagagctactttactgttgattcttaagaacacttcttaaggtgaaagataataagaaaggatgaaggctggatgggtttgaatattataactctcttttctttccctatgtcaaaatgaattttattggatgccatgctttccattacatagaatacatcagccatatgatccctaagtgtaaagaattaagtcagcaaaaagtcctattgtcttaagaagtcctctgaaaaccaataatttggttttctgaaatttgggaggtaattttgagcacaggcagatatatcagatggtttttatgtgtcttctacgctccttttcatgtaaggtgtttcctgtgtgatgccaacagtaatcagcacaattgctgacactaccctgatcttagttccttacttttatcccggagaaaaaactatccttttgaaaagttccattatgttcagtgatcaatgattgtgcatgtcaattgagctttatcgtcttcaaatcttatgaatatcaaaaacaaagttttaagaatctgacactaatatgcctaaaattgtacaaaagtctattacatgtgaaaaacctcaatatcttatgaaaaattggttttatttaatgatttttcaaggaaatttattctgattatgagacacatacattatagtatgaacatctaagaaaatttgtataaagataaagttggttcaaaattcttgctttgggggaaaaagggagaaaggaaaaattattttatttgatttttatttcttgaggcaggttcttgccctgtcacccagatgggagggcagtggtgtgatcatggctcactgcagccttgacctctggggttcaagtggttctcccacttcagccccacaagtagctgggacaacacaacaggtgtgtgccaccatgcccagctattaatttttttttttgtagagacaggttcttaccatattaccctgattaaagattatttcattttacttatcttctgaaaagtcaaattagctaaatactactctagttgttacccgaagcaaaatcctgtgcatatttgaggttaatagtctcttaactcagttaatcaataagtatttatcatttactttatatgctgtttacagttctggctgtatttttctggtacatttacatagacccttgcgattgagaatgcaggcattataaagaaaaaatatcagttacacacttcaataaaaatacagatattctataattttcagttacaaaatagcataactcatgctcacaggatacctatttctacaactatgaacaatgaagagcaatgattattttaaattttatacaagaagatattatttaatattatttaataatattatttaattattcttgattgtacctttcttagaatttataggctaaattacttacacaaaatttgtttggatattgttaccccttttttgcacttaattataattttattttgttgaaattaattaaatgtaattttaggataaaaacatctatcatatataaacctacaaacatagattttatgggaggcattgagttaaagtcttaccatcctcggattgtgagatgctatatttggggatctataatatgaattcactgggtacctggagcaggggaaatgctacatataaaagcagaggtaaaggaagacacacttggcttactccacagtgatgcaacatgaagatgatagattttattcaatcatgcaacatagtttgagaaaaccttcctttagaatttgttcaatcgtttggaattttcaagcaatgtatgcctaaagttagatctgttaaaaatcctctctcatcattaattttacaaagttcataaacttgatcataaactaagaagttatttttgtgtgtattagtataagatattgtccaagaacaatttctgcagtaaactaaaatttaccatttttccaagaaaatgcatattaatttatcttcatttttttatgttaaacttcaacatgacaggataggtaatattgctacttgaaaagtttgttatcagctaattttatgtttttataattctttgaatgtactgaagatccttagatacttttattgcaaagattgttaatgttagctacaaaaaacaagcacaatctccctgttaaatgtatttaagagtttaagtgaattaaagtaaacaattaaaacttaggtgtgctccatgtattattagaatgatacactaactttgctctttccaaaagaattaaaaaaaaatagtaacttgaaaaggacctagaagagtaaggcatatagagaaaaatttggaatgagaataatattgcagaaaaaatgtttttttcttcatgtagcactataaaaacaggaaatagtcacacatattgtagaattgtgtgcaaatacttttactgaatcatttattttaataggtatttagtaagaaagagtatagatttatcattgttatcattgcttttgccactggcaaaagggtgataatattgcaagttagtttggaactgtggccctattatttggtgctctaattaattggtttagtgcataatgaagctgaaagacaataaaacagggaaagacaacatatttgaaaattggcatgattgaagctctaggcaaaatgattagaggtgttgtagcttgcataacaaaggtagaaatatttgatgtcttgctgagggttttccctttctaatgttgaaaataaattgctgcttgatttttaagttgtaattttcagtaatttatgtgaaattcttatccagccccttcccacccaactcatatttatatttatatattttatcttagaaaacaaatcatccattacaacagtattacttattgcttactgctccccaccgatcaccataatccattttactatttattgaatgaaataggctttaaaataataaaatctcattcactcggtaagtagctgtgtctattatatactatattaagctctaagtttggcataaggtatagaatgataaatagaaggttaacattgaattactgaatttgaatttcaatgatagaaacagatacataaacagattgtgacaatatagcataatttattctatgatacaaatgtacaagatataggaagaacagaggataagtgattaagtttgtcagaggaagatggaagcaggggaagtataaaaataagttcagaaaggaaatggtgtttgatctgtttctggataaatcaataatatagcccactgtattcatgaattcaattgaccaacaattgacgatatttgaacaaaataaataaataaataagtacataatatcaatacaacattttaaaaatgcattataacatctgtttacttagcatatacattgtattagatattatcactaatctagagatgatttcaagtatagaggacaggccagttacagtggcttacacaggtaatcccagtgctttggaaagcataggtgggaggatcgcttgaggccaagaattcaagaccaacctagaaaacttggtgggactccatctctacaaaagattttttaaaagttatccaggcatggtggcatgcgcctgtatttctagctactttggaggctgaggctggaggattgcttgatcctaggagtttgaggctgtagtgagtaatcattgcaccacggcacttcagcctgggcaacagagcaagatcttgtcttaaaaaataataataaatgaataaagcatatgggaggaagcacattaaactatgaaaacattttgccaacatagcataatgtattactgtgacgtatattgcataatggttataagcaaagcctatgccattttttataagggacttgagcatctgcaaattttagtatggggggaggtgccctgaacaaataatgaggaacaagtgtactttgccagaaaggatgatgggagaagccattttcagcagagacagataagtatgcgcaacctcaaataacaaaaataagagctgcagtgtttttatggaattgcagttagtccaagtgctctggcatcttggactatggacagaaggaagatttaaaagttttgaatttaatcctaaggaaaattgaactgcattctgtaagtactggagaataagagaaggctttaaaaaaaaaggttgggagtatggataagacgtgaattctaaaacttcttaaatggtaataacatggagaagaatgaagatgaatgacactgataccacgaagccagctagacaaggatagaaataatactctgaagacttgactgagaccttaataagtcattgtctattgacaatagaattcccaatgctagggttgttcatagaaaatgcaaacttccaactagttctaacaatgaaataaccacgtgagtttgttagtttttttaagatgacaaaggtaaatggtggaaatattcttagaaatatggaaaatggaatgatgaagaaaatatctttttttcagttggtgtctttaatgtaaatttcaatctttctaacgcttatatttttggtatctatgttacagtctatgtgcaattcaaaaatgtaacacttatctttttctctcattatgaaagtgagagaaagaaatttaattaaaccccttcgttcatgtgatagtaggagccttgttagtttaattgatacttggtcaaggcaatattgatttgataaaagcaaatctatttctaaccccaacaattaaaacatttaaattggctccatcttctttttgatgaaagggcatacaaccattataagcttcccataaaatcaatgaaaaacattaataagtgaataagcatccatttcattgaattccatttgcttcatattctaatgcactaacacattgcagtgtatggattcatctgtgagttccagatattcatggtatccttgtatttctcttctatcacttatgccaaacttagagatctctcttattccctccttgtgctctctctctctttctctatcaagtaaacacacacacacacgcacacacacacacacacacacacacacacacacacacattatacaaaggatcaagtcttgtttgggtgcaagttgaaccaagagcatggtgtccacatgacagaggtatttcttatttagttaaggtatgtggcagtcctcattttaaatcatcactctgctgtttgctagctatttggttttaggcaagttacttaatctttctgagctccattatctcaaccaagagctattttgagattaaaaaatataaaacatataatgtgtttaagacagttcaataaacccagaataaaaagtagctattaaagaaaggtgcctagaagccaatggcttggactggaaagtagaaccaatgagttggagaatttataaaaacaaagccagaaacaagcatatcaacactggccaaaatgatttaaccatttccaaaggttaaattcagtttaatgagattatttttaataaaattgaaaattatgagtaaattagtaaagtaataattataatattagatcatatataaaataaaatataatggaaaattataaaagcattattgaaaaaatactgcaaaaaggtcattattagtccctacattgtttatcatgaaaacaaggaccctgaaaggtgtttattcattgcgttttaggtaaagaagtgagaagtcatagtatctttaatgtgcaagccaaaatgtctggtatggtagtatacataatcagtgaggaataattggatcaacacacatcacatcaaatatatttttgaacaaatatgtgctcaaatgtgtttatttgtccttacaaaaaatatggatatgaaataaaggcttagagtgtagttacataattccttttagagcattcgtctaatgattgtctaattccttttaaaggatgtgtttagaaaggccatggtatttagatgtacctacatttaacccaggtagaatttaaagagaaagccctgctgtgaaaggatagtaatctccaatgaccctaaaatcagagtagagtcttcttccgcaaaatcaatctcttgatgtaagcatttgacctgttttatgctgaagagctggatcacagcaattacaggcttgtatttcctggcagagagacaagcaaggatagatttcctctgttttatgtttgtgttaatttaacctgtcaaagttaatcatcctgtcgaagtgccaaagcaccatgatgttgggtgtggtagagctgcctggtgccttagtcttatttccatctctgctagagactcgttaagtgccctttgttaaatccttttctgtctctcattttctttgtttttaaaatagaaggattaattattatctcctgtgttatatttatgttacattttattactttaggtaatagtttaatgatatatacatgacatatttttatttgttccctgatttttttttttaaatcgtgggggagataaacaaactaataatataaagattgtttaaaaaataatgtactcaaaagagctgacctgtttgtttgttgcttggcatttaacactgaactgcatatagaacataccagtttttattctaaacaggtacgtgattgtaaacaagaaatgatcttgtactatgcgtgtggcaaggcaagtattttttaaacctgttttgtccttactcagagtcaatgtaaggtcttccttcatgtccagagatatcttatattaacaaaagtgttgaccaaacttccactggacacattttttcaatctaggagtctacacaacttgaaatataaatgtactataagataattgaaaatatttcagataagtcatctataatattataaacttacttctagggtaggattattttcataagcattgtgtctcttagaggaaaacaatcccacaagaattagatataaattgcagaatttgattttcataagtgactgttttatattataattgatactatgttattcaatttggtagttgttatgcttttcttctgaaatagcaaacactctacttgggaaaaaatgcagaagaaaaacgtagacttggtaaacatttacatgctatggactagccttacataaaacttgttaggattggtgtgtgtgcccttcttaatctctttatttacttaccagtcgtgtacgtttgtatcctgtgctcattttaaccctactccaccaagcccttaaaaacactgttccatatttttgtgttttatttcatttttaactgacacatagtaattgtacatagttatgagataaaatgttatgctttgaaatgtgtttattgagtaatacatgtattaagtaattttcaaaaccacaatagagtggatatttaaaatagtttttcattagggtatgcattttttatttttccaaattaatctacaccatcttcagtccttctaaataagcaaaacatccctgtcgttatgctataattctaaaaattcatgaataataatttttccagcaccttcttaaccttcttacctctcatcagtggagacctaaccccaaaaccttcgggaacagtatttttggtctataacactactcctttcttccatcagaattgggaatataactttgaatatattatgaatgagtcttttttctcgaatgtttcctaaaatagtctacatatgacctctaccagctctactaaggttcatcttcatttttggagcacaaaatgtttttctattaataaaattttgtgagttaaagtgaaattaataataggcatttagaacagaaactctctgccagccttcctaatattataccgacatgctgtcattcatgtatttgagaagaaataatactaattccaaatccactttgaaacatggtgccaatacagccatggtggctctgttctgtcctacataataattacatctgtgaaacagggactctgcatagaatgcatgtttgtattcaacgtaatggcatgatttggtaaaagtttcctgtgtgttatttagatgaaaatcagggttgttaccaacatactctcctagactaaaagctccatgaagcaaaagaatcatgtctgtcttcatacattacaccttcagagtgtagagctgtgtttggaacatgataaatatttgctagataaatgaatgaatgagtgtacaaactggcataatttacctagttttatagtctccatttgttgtgtaacaaaaataatcttatgttgatataaaattaatttgcacctcaggacataaaaaagttaatttaatcagacttatgaattctgaagtgggagcaattaagtgtgatgtgtaacattaatggaaaatgcatttttttatttaactacttcttttgatgaaaaacacgcacggtaattaaaatagtatattttaatgcatattttattaatgctcatcctggaaactgttagttctacttttcagttgttgtaaaacatctgaaactattttatttatgggatggggaaatacactttgacaaaatttattcatttttagaataaaattatcagtgcaatttagactcaaatcataataacacttgtattatttattgctacataacaaattactccaaaattcatagcctaaagcatcatatatttaccatctcacattttctgtgggttaagagtctgtgaaggactaagtagggtatttctggcaagaggttttccatgcggatgtgatccaggtgttggctggggctgtagtgatccaaaggcttaactagagctgcagaattcacttccaagagaactcacaaaactgtcagcaggtgggctcaggtccttactgactattgataaaagcccttagtcgcttgccacatggatgtttctttagcctagcttgagtgtcctcagtgcttagtagctgccttgcccagactgactgatccaagaaaaaagatagaagcctcaatgtgttttacgacctaccttcggaagtcacactcaagcattttcacgatgttcagcctgttagaagttactaagaaatgcaccacaatcaaatgtaggggaattagtctccactggtaggtgttatattttaaaactatcacaaaatgtattactatctttcagtcaaccctacaaggtttatacataaaaacttattcaattcttactgcaactttatgatataagggttttaattagtcgatttgttcacaagaaaactgagcacagagcacctaagtatctttcccaatgtcacaaaactaactggctgcgtcacattttgtgctcaagcaggttggtccaagaatgtatgcttttaaatattgtcttgtgctgtacctgtacttgtgtttttatattcaatggagatctatttgagtaagcagtcttttttttttttaactgcaaatcataattcactgatgggtcaacatagagttttgctgttaagagcttatagaaagataacaaatgcaaactttttaatctaagaaaaaatagtatttttacaaaattattttagccacagggtcttgctgtgttactcatgccagcctcaaactcctcgaacaatcctcccatcatagtcccctgagtgactgagactacaagtgcacaccaccatgcccagcaaaaataattatttttacttaattatattttacctaaattaagtataattttaattattttcttttctcacatttagatatatcctgttacataacatgggaactatggtgaaatgcacacaatttaaaaattaatctgtaccatgatacttacattaaacaaagtgttaattgtattcaaataaaacacaaacatacaccattccagtgtgaccacaggaagaaacagttcttttggtttccacatacacatttagttttcaatgtattaaaattcaaattaatattagcagaagcataaatataaactagtttatctataccagtccctatattgactttaaaaaacttataacatttaaagaaaatactccttataaaattttgtattcaaatcgaattaagaactttacattgagagagtgaagtataagttacatttctaacagagacactgaaagcctgtctaaacaatttttaatttatacaatacaaataacaatgattgtgtcatggggatgtccttggctttacagcttagagtgtcacggaaagaaaaatgagtaaggaaaaccactaattagatacgtaaatcctagagttatgaggcgagcggtctaaatgggaaaaagccaaaaacagaagggacatatgcaccaattcttgtttggagctcgggaagcctatattgcccatgtgattttactctctaatctcattcatgtacattaacgtcaacagaaaagaggaaacaaacttaattttatttaacatcttctagactattctcaacacaaaatgtcagttcacttaaacaaaatgttaaatgtcgttcaatactaggtccgcttctctagtgtatcccaacgggaggagtcagctttatttgtacagaaccatttttcttaggaaatgaaaagtactgatttatccttcttcctggtgtttgtctctctcttgcttctactttagtgaaagccgatcggaatgagaaaagaaattttgccctttcctagctaagatgtcacacgttcatgctgtaaaaatatattgttcccaaatctctgtatctcggctggtttgaaaatatattttgataccttttttcttgaagaaatttgggataattgagaaatttctgatttgttttgtatattatgtcattcgttgtaatttatggacatgattgaatttaataactaacataaagatcttaataaaaattagattccataaaaatctgattatacttatgattttttttttgaatagtcaaatcatcttcaaagcctacaagatataaaaatattttctgttttttatcagttttgtcattgactactaaaaaaatacattgcttcttaggaacttttagggaagaaaaagatattacctttcagaactgatcctctacacctgtgttgaccactagccacaagtagcctttcacatttacatttaaactaattaaaattaaataaaattagagatgtagtttcttagtaacactaaccatacttcaagtgctcagtagccacacgtagctagtggctaacatattagactgtgcagatatgtcaaacatttccatcatcacagaatgttccattttgcagtgctatttcatcaatttatacctggggcttaatagtttaggagcagtaagcttattatatttgctttgtgctattactttctcttgtttaagatccctaatttgaatctatgatatcgtggtgacagaagctaatctcaaacaggctaaatttttttgacttgtctgaaatatgtgttaacattctaaaatatttaattactctttttgtttttaacagagcattgtaccagtgttcagagatactaaaaatctggcttgctttaaaattttttgagaagctgttttttaagtacaacaaacctcaggctgatatcattcagtacattgtaaatgtgtacaatatagtgtttgatatataattagtatcttttgtattaattcaaatgttatggaaatataattaactgtgatttactttttatgctttcataacagtgaggtagcaatcctcatcttgagattagtatatcaataaaaactactatatatatatgaatacctctactatatatatatatgaatgcttcttatagtttgtgtgtgtttgtgtgttctaattccagctctgacacttcgtagctttgagacctaaaaaaagttaatctttctaaacctcattttccacattagtaaatggagaaaatactgcctcccagatgctgtaagaaaatgtctttcaaaaactgattacaatgctgccagtgctcagtaaatgctgtgtatagtaattaatattattaattaccagtagttgtagtatcacaataacttaaaaataaattacaacacatcaaaatagtattgatagtttataatttgaaagtacaaaataatgcaagtatccagggttttatatatttctgtatttaagacataacttggacatgaatatatatctataaatgtgtgtatatgccatagttaattataaaatatttacttatatataatgaataaaaaagtttttaagacccctagcctcatgaaatgctgcctcctctattgacttcattgacaagccaagttcattgatatataaaaaaaaactcaatcaacaaacacatcttttttcatcttagtgcttgctatcctttttgtccttgtctcctttctttaaatatatttccactccctaaagtagtcttttctgtgtggttaaaacacagaaaaatgtaagtaaaattatgattttgcttaccttttatactataattaaattatatatgttcatattttatctttctacctatgcagtgcttagaataatgctctgctgataaaacatgcctaataaatgctttttgaatggataaacctaccaatgaagtgattatacttgttaggtctttctccaacaaaacatctcaaaactcattaacttaaaataataaccatttattattgttaatgacttcacaggtcagcgggattcctcatgaatctgtgagcagttttgtgagtagggtgtatatatttgctcgtcttggcagagctctctcacatgacttgggctttgactggggaaactaagtgtattcaactgtgaccatatagtctgtcatcactcagcaggttagaatgtggttggatttatggcaaatgagcaaggaactaagatataaagtgcaagtgtgcaaagccccttgaggtttagtctcagactggcatgatatcatgctgcattacatttgaccaaaaaagttacaaggcctatccttttgatgggagatgctgcaaaaccacattgaaagaacatggatacagaaagagaaataattgaagccatatttgaacaaaaaaaaaatctaccacaggcagatcttctctatactcttctctgccccactcttttcctagaaagcccaacttataaattccagtgagggaatcctttgatcccctggggagttacaaaaaaactgctctcacaagttcttcaatattcccctgatttaacttttctcaattatctcattgggtgtgctgtctctttgattctgaaactctgagtgatacaggtataagatggatcttgcttcaaagttaaaacatttgtcgcattcagttgaaatgtctttactttagaaattaacattttgtcaaaaagcaaaacatgcccagatttttaaatatttattttgattccccaagtcatgaacgcagaaaaacaggtaacaaaacatatttatgttctgaaataataaaacatttaataattaaataatcaatgaatacttaaaactacacctcactaatttgaatttcgaatagcatctgtatctttcctgtaattttttaaaatttaatttattgagttcagatcccagcttcactcttgctttgtgatcactgggcaaactacttttctcatctataaagtggaaataataaaacaatttaccttataaagttatgagaaatatattaaatataaattgttaagaagaatgtcttagaaattttaactgcttaataaataatatctattagtgtaccaatagaaacaggaattgtagtagtggtaaaaaaagtaccttctgaaaatttttatttgagtgtatttttttatacaaactatatatatgtatacaaatatatacacacttttcacaaatattatttaagggctactatttctatcaagttttatgtcataatttagtcattctatcactgtgaaatattttaagtatttctaattttctcctataaagaagtagttctaaaatcaagatatttgcacataatacttttataattaggattattgcaaaagaagagtcaaaaggctgcaattattaggatatgtgatataaactttaaaaaacaactctactcatttatttctattacttccatttgcctgtttaaaccgttattactaaagtaagaagggcctcattttctaaagcaacatacatatcattttgaaaatctttgctaatcatatacatagaagaatatgctttgtgttgtgctaggtgctgagggagttgatttgaattagaagcaatacaggtacccaggagaagtttcattttttaaaattttaagccagacattcttccatatatttattaaccagttggtttttctctagtctgtcatcactgtttacatcattagcctctttatgtactgctccccagcagttgaatactaataatctagcttcatatcatttctcagtttgatgtctttatatagtcatttcctagacttccatgtgactctacccttggcaactcatgcactcacaccattgagactcactgaacctgaaatggcccttttagaagccttgctctctttgtcattaccagactgctatgtaaagaccagtgacagcttgttgttttatttcttgaattgtgctgacaacattgtttttttctgggacattgtgtttgtagttcatggcaagaagagacgtgtttctttttttatcctctcatttcaaatatgtaccatttttgctatttgcagtactgaactatatttataactcctctagtcaaagaggaaatcctgttgtataactcaaagaaagtttggcttctttgatttgtattttaaatataggttcctgaaaaacaacatgtattatagtgacttagtgtattttaaaaaatggagccattttaagaactacgatagataaaaagcgaaaagttgactagtgtcttctacagaagtatttgtaaaaccaagacagggtttacaaaattccctggatcacgacacaacaatgcagaactgggtaaatctaacattgatttacaaagagaggaagttctgattattgaggtcaatttttcatagacaggtatagactggagcacgggtttcaaatacaaaataattcacgtaagttgtttttacacaaagaaagcaaagcctgtttccgactcaggaatctagttgacttcattattaacaaactgatattcaggagccttttttcctcacacagtgtcagtgtttcctttagcaaaacgagaatctgttgtaacatggaaatgcttggaaggtctggggtgtacttgaatataatatttattatgtgcttactatgtgctaacagtgggctaggctttcacttgctgtattttattcacaagaaccctgtgaataactggtaagtttaacagatgtagtcatgaggatggagatgagtaaatatcactctaaaatcattgaatataaaattcaagtttgtcctttttcagaattcaagttttttctcactgaagcacatttcctaaaaaataagataatttagaaaaatttaatagattttcataaaaaaccatttcaaaattttttgtacttgagattaagtttggtataaaataatagagatgctgattatgatgatgatagtgattatgaggatgatgataaggagctaaaatattgaatgcctgatctttcataggcactttaatatatgctttatgtatgtttattttggaagagtcatatcacaaaagcattgctatccgcactttaccaagctgaggcaacaagagcttatatacctcatccaaggtcatctaactagtaaatatctcagatgaaattaagaagtaggacatcttcactcatgaccattaattagtataattttatgtagtaatctgtattaaatatacattattcaaatgtatctgaaaagcacatcccacagcacaaagcactttcactagttctacaacattcttggtagtagatcaatgagtcctgtcaatatagtggaccgttccattgtgacctggattccattcctaaacttgcctcagacctttcaaagaaaaatcagggccttaggtataatgtcaagtgaaaatattgacatattataatgaagaatccaggggattaaacaccactataaaaacatatactttgcgaagtactctatccttgccactctaacagtcaaccatttggtgttttgttatttcaatatttccactgaatacatttcggttatatttaatctttctgtcaaacctattggactcactgcctcctccttcgtattcttcaactaggtgtttctattgttactgaactctgaagtggaagctacaccaaaatacatatgtgtctcaactagtgaacctcagtttgctggttggctaagacactttcttttcattagaaacttaggttgctagaaatatttcactcttatccaccagagaaaaaacagttgaaacttgctatgctgcactgaattctaagacagactaatcaatctaattccatctaaacctatttaccctgtccaggagatctgctaatgaggaatgccagtaactcctagttcctgacactgctttccaaaagtgagttaatgaaccagtttaaagggacatgcttgacatttgcaaattagtttaactggcttgttggggcagctttgaactgcattggactgatatggttgtcattaaaccattccatcatgtagtatttttatacttcagtaaactttaaaagataccttaataattgaataagtccgtgttatctagtattttttacattgcttgattatgatgctgaagttcagaattttaaaaatgctttttcttcaatctccacgataatattgtgcaattttgtgaggatgccaatcaaaagtaacgcagcttttgcacaaaagtgtgtattatcagtaattacaggtggctcggtgctttcacctgaaagcacagagggtgggtttggtgttttaaatgtctgcgtcatggggaaagagggggagacacaatctgaggtttctaggcaacaaagcataatatatctgttctttacaatcgactcagaaaaagaaaaaaaatcaggatatttttaaaggtaatatagttttctttaattataagagaaatagtttaatttggaaatagggtatatttacaaaggaattgattcatccatttatgaaatgtatttatatacctactttattttaggttctgagctgaacactgacaatataaatacaaaagaaaaaatactatatattttttctcatggggcttaaattgggatgaagaagatgtaccctccaaaacaaaggaataaatggaattttgcaaaatttaacacatatgaaataaatcaaaagcaattgatgaaagctatgagaaataaatgagggctttttctatctaaattagaatggtgttttaatatcatcaaaatcgtttagacaaaggatcacaggtgacatgattttgagcctacctaaggtggaatgccaaaaccaaacctcaaataaagttatgaaactgaaaaaggtacacattcaatgaaaggtttgactagaaaaaaattcaattgccagcaagaaaaacaatatggaaacatatctgtttacctgggttctaggttaaaaaaaaaaatgaacaaaccaaaatctccaccctgaaattttatagctatagacccaatctctgatggctttgaggatctctgttttatacagtatacagtattatttatgctctctggaggaatgtattctcaatccaagccccaaagacttttcatatatatgaaccagtaataagccagttgcaagtacataatctaaagttaataataatcttttgaaagtaccaggacttaatggactattcatgaagtcagcagaaataacatatgaatgaattatgtcaccaagttattaataattattagttaatagttaatagttaattatattgaatatatttacagttatatataacaacatcaaggaatcaaggaaataaaaagagacttgcagattaaaaaaaatcacataaaatttctagtaaatcacaaaaatttaaaaatcagtgcatggattgatcaatagattaacaaccaaggattacaattactaaacctgaagataaatttgaagatattaatcagaataagcatagataacaagaaaatgtcaaagacaggttactgaatagaattaaaagatctgattaaggattcagacaggacaaagagaaagcaaagagaggggaatagaatgatcagagtttttatttaatatgtttgtggctagaaattatccacaaagataaaaggaattttcagattcagaaagcagaaaccccaagccagaataacaaaaagaaatcctcatataaataccatgaaacaaaactgccagatctagagtgaggcaagtgagatattcaagggctcaaaatgtaaaaaggcaatttctgtaacactgatgtaagtgcaaaatcagctaagagtgagtgcttcctcacctatgtccagagcatcttatccatagctcaggtggttctcactcacaggtttctgcctgaccctgcttgtgcaacacctgggaataagtgcatccttaaatatttctccctgggtcctgactgactcacctgctttcatttatgaaactcacggtctttataacttctatgtcatcattagctttattgcatctttaccagtagtttccctcttcttttgctgggttgtttactttatttcaatatataatcatattttattaagatattgaattttcttctgagtacagtttatatgttttgttgactaatatttttattagaactattttgaagtgttttattattaaaatgtttttacttcacttattcataaaatgtttagagtgtttccaggaaatgattaaagattgaaggattttcttgcactggtcatttaaagtaggacgttggagcctctgggcttggatttccagtttataatcagaattttcggaagtagaagcttctacttttatcaagctataagtagtctatctgtgctccaccaaatgttttgtttgtttttttgttttgttttactgtgtatgaaactacacaagaatgattctgagaaaaacaggtccccgttggtattgtctgctctggtgtttataaccggaaaattttattcacgatctgaaaaaaatgtgcataaactcagtacaatttttcctacaataagagagattgtctcgccttaagtgttgaaaacaaacaagaacataaacatccactaagcaagttaatatgtgtataatacaaatatggacaataagctattatgacagagaaaaagaaatagataatagcattgtggggccatgctgagtactacggtaaggttcactcagaagacaagatgatatctgagttgagacgtaaaaattcacaagaacaaccaaaaagggaataacatttttccatgtatgatgagggaaatgtgagctgctaggtatggattgatattccaagtaaaggaaatcttgagcaaaagagtagaggtgagagagcgtgcactggttagagagaagtaaagaaatgaagattatggtaaaattcaaggataatgggaaatgcacattcatattatgtctaacaatttttaaagtgacattcttatctgttgaaagccaacattaaatcctcgaataaatctggggcggtcttttggaaagcaaacacagaaaagttaccactgactgttgtgtggctaatgatttcagctgctagtaaagtaaactctaagtaacagtaacttaaacaggaaagcgttacttttccctcaacaaaggaaacccctacttagattcctgctggtattccttcagctcacagtaatgtcagacctgggagtcagcatctgtggaattatcaggggcctttccccaatggccattagatggctatagtcttgggcatgacatccccaatcaaatggaagaaaggctcatttttttttcctaaaatgtaggagctaaaataaagcctcctacaattcaacagacgtatcatatctcatttgccagaaagatgtcatgtggctaattcaaattcaagatatcctggggaaagagggcaagaagagcatgttggaaatagtccattggtcctttgattagtcaacgtaaaatgtttgccagaaccaccttctctgagttctcatgctgtgaccactacctctgggaagaatgactcttactctctcagtcctttctttaaagtatttacaaatggtttaatcaattattgtatcaatatattacctttgaaaagaaaagaaaggtttacacttctgaaaaattttagctaaaaatttagcactttttcgctaaaaattttagctaaaaatctatggtactcttcgtcagtgttgtttctctctgtctcacacacacatgcacatgtgcacacacacatgcacacacatgtgcttttgttttccccatctacgtatctagtttttgttaagagttgtaggaaaaagatctgaatagttttagaaagaaaacagaaaaaaagagaatcattcagtccacttttattttgtcaagcctaaattaaatgcctcaaggaatatatgacatagtgatacttgatgataaaaattctatttggtgcatagcattgtattacaaagaccagttgtttgctagtttgtaacgagcactgtgctaagcagggaaactattacacacttggaattgctgtaggaaacaaaatgtgatcatataaaaaaaagagtagctttgctttttagaaatgtccaattgccataggagaaaaatgagtgaatttagattcaactgtattggaatgaagggaataggaaaggatattaaactttggaagtgattactaagaaatcttataaaagggttaactgataccattgtctagaatggtttaaagaagcatgcctcatacgagcagtacattaaccttgcaagactgctttggacatatgtattaaaaacatatgcatctgatcttcaaagtaaactttagcgtggtaacaaggttgctgaagtcacataactagtgtaaatcaatgtatctatgtactagcaattgactctatacacattccaagatttaaagtgaattatggttctcttatcaaataatctcctaggctttgtcagtggagtgcttaacaccaggctagtctcatactagaggtgtaattgtttttggaatttattggaaattgagttcctttaaaattctagaacaatagtctctacaaacaaacataatggaatttaaacacacacacgtacacacatgcacacaaatgcacacatgacatgttatgggatatattttaacagttttagagttctgtcttgagaaatgtttattttaaattatatatcaagaaattattcaacactttttctgttatgctaattaaatctatagtaccaggtctgtggctccaacggtgacttgttttcttatttaccttgtaaattttcttatttaccttacctgtgacatattttcttatttaccttgtttaccagtggtctatttaggaccttaggaactcagctttcctttgataattatttcttggaagaactgtttaccccagagatgagtggtgtgtgtgtgtgtgtgtgtgtgtgtgtgtgtgtgtgtgtgtgtgtgtgtgtgtgtgtgtggtgtgtgtatgatattatgactaaggatattggcctagtaagttatagttagttgtttaaatgctagtcttccctaaaagactgagctgatgtcagctcttcataaaacatggataatggctacatttccagctacttttattttactttgaacccatgctgctggatagtagataaataggtggataaagatatagatatcatataggaaagaatgagcatttcttggaattgaagatgaccttctacttgccttgcttttggttaattgtttttcataaattcatcgttaaaaatatatcggacactttttgcttggattgctatatatgaatttctgtttattttatttttaaaattttttataaaatgtaaaatttttgtagttactttggaaaatctagatagtgataataaggaaaatacaaatgtgaatgtgtggtttcccctgtcacccctagccttccaggtaggcacctagtgagttctcagatttctactctggactcagatgtggcagataaatgagtttattttctttaactaacataatttgttattgcacgtctactgtactaagggaaagatctattggaattaaaacctgccaattaatttattttacttcctttagtgttaaaaatctccatttagaagcaattttattgagtaaataatgatactcctagggtttttctttttctgactccactccttccatcagccacgggtatctggatacagcaggaatcctgtgagatttcatgaggagggaacattgattcatatttgaatgtgtgcccttgttttgatgtctactaaagtagggtgctgttttttaaaatggaagattcagtaaagaagtccttgctcattaaacaagatttaaataagcagaggatacaaggaggagaagaacattcaagttaaagaaaaaaaaaaaaagaaatgaagattcctttgtattgtgctctagtagagaactagaatgtaaacaatagcagtagtcagcaaggatgatatgccacagaaggaagctgtcgatacacagaggagttcatagtaatgaaaaatgcatatgaaaagcagagaaaggccaggcacggtggctcatgcctgtaatcccagcactttgggaggccaatgcaggcagatcacctgagttcaggacttcgagaccagcctggccaacatggtgaaatctcgtttctactaaaaatacaaaaattagccaggtgtggtggtgggcacctgtaatccgagctatttgagaggctgagacaggagaatcccttgaacccaggaggcagaggttgtagcgaggtgagattgcgccactgcactccagcctgagcgacagagcaagactccatctggagaaaaaaaaaaaaaaaaaaagcagagaaaattgggtaacagagtcttcatatttttccatttactttcaatattatttctatttctttctgctttctattgttactatctgaaagaagcagatttggcaaaaatcttctgttgttatacaaaaagatgggagaggtacccgctctgtttcagttatcatcccctaaatatgtgttacacacacaactttgtcctgcactcaacctactacttggccctattattcagattgctgttatcccgtttccaactcatctaacatcctgagctgctaaggaagtaaaacctacagaaatagaaatgctgggagtgaggtaaaacctgcttcagcatgattttgaacttgacaaacagctgttcacatcagagttgtcttatattccaagatggataaggagaacgtgaagaacatattagttatggacttagtaggagacttaatgttaaaaatggtatttaaataagtctagttatttaagaaatcatttaaactcattaacacataggccatcaatgatgtctaaatccttaaaattttaggtcagtagatatcaaatataataacaaaagaagcctaatgtttacaaacctttgctacaagaatactttcttgtttcctggagctaaatggaataatccataaaaataaaaattgtttcacagtacatctggatttatagattcaagcaaacaaaataagcctttttagcataaaatacaaaaagaaactttataatgtaagaaaaggtttaaactaaattctctgaagtaaaaatatgttactactcttgaacaatttaaaaatataccacattttaaaaacttgcaaatcctaactaagctatattattttaacagttttctaaaacctgtactaaggttgttatcctctgaatttggaatatgtcaaacataactctttcaacaatacctttaaaattctgaagaaattgtgtatgcattgcctggaaagtgaagttttggggaaacatgataactgcctttcaatatttaaaaggctgtcatgtggaaaagacagcaaggtgacaagtgctctttcattggaaacatttaaagcagaagctatgtaaaaactcagaatactgtaagtagagcacttaggtggttgaacttgttgacattcatatttcatttcattttatcctttcaattaggaaatacattttatttaatgaagctgaaatagtattattatgtgttttcctggacattgaccagaagaggtgaagatgcctccttgagattttaaaagcatgttttaggaagttagaaaaattaatgtagctttatctggaaaaaaatagtgcctttcagattaatttctacttataagactgtctcctattattcaaacatccttctctctcattattcacaaagaccaacagcttacaggcagggaagttaagaaattgccatccttaaagctattgcttatccaaattatactgtcccaataatcttttcctactacaagtggattatatgagaatatagaggatcaaaacattataatatgattcagtttctatgaattactatgaggaatttagtagttgacactcatcatagtgaatagataatattgtcgtgtgtttctctgttatgcatacgattaggagccaatgaaaatgtaactctacaatagtatataaggacattaatactttttcaaaaaaaagtattctaatatgactaactcatgtctctctaacatctaaagtaaaataattataagttagaaggaggaggaaaagaagggggaggatgtggaggaataaaggagaagaggaaagaagataaatgaaaaaagaaggaaaaagaggaataggagtaggaggattgttgttccaattgcgacaatcaaatgctcttctcgtttaattccacattctcaaggacccttatcctcctcttcactttggtatgttcagtgtttttgtcagcactgtgctgcagatgtctatgcttacatggaaaaatgaacaagaaaaaatctgttttctttgtatttttccttgctgacatccatgcataagcaaaaatgtgtataagcaaatgagccaaatgattatgggtaattagcttgtggaatatatgaaagcaaattgtttgctatatataagcagggttttttttttacaagattatattatcattaaagcatatctggagttagccaattaggacactcactgaaatttagccaattagaagtcaactctgtgagcatgtctgcaagaagttttctagaatgttccaatggttctctggttttgaaaatgatgtaattttattgggatgttagtctactgatattaaaagaatgtagtaatttaatctcttgtaaatgatcatctttagattatgctctcatcacagtatttgatatcatcttgagctgtccaatgatgtaattgatcttagtgttattgtgtgtcaatttcaagatacataatttgcttcagtgtcatttatcacactttttaatcaccatggatgatgactacagctttaatgtagttctgtttttgattagtgtaatgtcatttctgagtttcattctctacaaaggaatagaagaattgtgtctctatgcctgtcaagtctcacacttaacatgaaaactaaattcacttcaaaggctctatgaaaacaaatttcattacagcacccttgcttaaataaaatgaactattattttgaaaaattacttataataaatatccttaagtgggtaatttaaaaagctaatacatctgggtcagtgtttcactagtttgtgagtatactcatccttatctataatctctgcagtatagaagcatctttactgggacttgggacttggctgtgtatttggttcctagatcctcacagagctatcataaaagagtagcatgtgaacaatcagatctagatttccttcccagttccactgtttactacagttttttcttaaagatttattttccgattctcaattccttgtctctataatatagataataaacacttagagttagtttttcagagttactatgatgtgataatacataagaaagcacctaacatattgtctggactaataaagattcattatgctattatcttccttcctctgcaactgtaccagatatttctttgtcgttacttatggttcattaatttttgtatctttattttttattgaagccatttaaatagtcacaaaacatattaattaggagggactaggcatagactgtttggctagaaaataagtagtctcttatattttaatattctcaggtcatctcaaatggaagatcacattactgggagatcagagtgtatacattgctattaatagttacctacttaatatcctttctctctcttcactggcaaattttattcacttagatgggcaccaatacactcaactaaaatatgtgatttttcctttcttattgtctctgatgtttgaaatattcttgtcaccttttatgtattcaatctactccaaattatgaccattctactttgatcatcatccctgtagagcttctacctccttttccagagcagcttttaatctttcagacccattttttatctcctgacatatgcttctcaaatgttcaaggacatttctcgacaagtgttgatcattgtaaaatatttatttttatattttacctggctatgaatgatttcatggaactagactttgaaatgaatgtgttttctcatcattaaatttggtaacacttagcaagactatgaatgggatagctctttttctacagtcatcttggcttaacatctaatgtgtttgcatatgcatgattatagtctcctcgtgaacttacattactaagtacttttaaaatacaaatgcttctctaataatcatattgataatattcctttttttaaattgtataaagacattctgctacatctgaagttattaaaaatgaactctgaatatttttaatacctccagaacactgtccttcttatttaaaattataacccccccaaaataaaataaacttaggacccttatatactgaatgcttattgagcgcttgccactttatttagttcatgtaaccctcacaaaattgaagaagaaattggtgttgtccttgtttaaaagtagaagatatggaagcttgcatagagacattttgtaaatagcagaaattgaatgcaaatacttgtgcttgtaattttaaaggagctgattatgattattctgtttgattactatttatattcatatatgaccagaaaaaaagccacacacctccaggaattcttaaaggtcccacaaaattgagtaaacacaagtactcaccaaagtgatttaaggctactagaaattttctgtgggcagcctcatcagagttctctgcaggtaacatagacagaggtggtgtttcatttttcattctacatttactacagaaagaggtatttacattattcctttgttagagctgaagatcaggtagggaagaagtgcattacttttctagcaactggcaatttattttatgtaagatataatgagactacatttccaaaatgattaccaagtatattcccaatcaatggaattgaaaggtacatcatcagtaagctttcagagtccatcttttgtatactacgaagattcttgttatatttcatatttaatttccatgtttaactgcttcttccagtaatcactgatgaaatgtcggtttggtgaaagtttctaacttttgctggtttcattaaagttatgctttaacttactttgataattatatatcatgtttatatgacactattgttatagcataactgtactgtacttgatattctatctaatatactctatgatgtgttagaatacattaataggcccctgcctaacaacaggtatgtgctgctaaacacagtgctgtgtccaaatgtaaaactaattcatgactaaggaacattgtaaaaataacaggcatgaaaaataatgggattctctaatttatttaacaagtgtaataatcatactataaaaatgtgagagactattttgttaaaatgaaaacattttctagtgaggccatatttggataaatacactgcacagattaatgtttctgtttctcactttcttcatttgtcttaataaaggatttaagaaagaagttttcaaaggcaacttcttacttaatattttatcaaggatggtatttttgcaaaaatagggtcactcatatctttattacactggaataacaacactggtagataaacataatattaaatggccaataaattgtttaaaacagcatttgctatgctgtgtcttataggagttgtcttttctaactacctttggcccagttattttacgttttagttagaaataaatttctgattttatttctaaaaaatgtgctttctacagacatgaatctacaaaaaacatgaaaaatatgatttgttaaaataaatgtgacattaaaataaaagtgtacgattatataacttatagctatacatcgtataatgtgtggttatctcagaaaagtgaatactttgttctttagttaataagaaaaagaatttagctgttctaccagaaagttcctacaacagaaaagatctgttttgaatgtaataaatgagcctgtagctaagaaatgcatgttgactgagcttagtggattcacactgagtctaacaacgccttttattgataatcttccaccatctgctctgaagatatattcatacaaagaaaaaaaagcaggtgagaagaaagaatgcaaataagtggcaatacttaaaatttgaatcatgctgtgattttgcaaactggattgatgctactgttgcttttaaaaacattacaatatttgatgtaacaaagttgatggttaacttccactttcggtccatttgcttacatgagcaggaaagtgctcccagaaatgtccgattcataaatttaaatgattggtagaaacagtactaatgtaatttacattttgtatagggatagcactttcattctggcaaaaataaaagaataatgtatatattgatggtcctctcaatagaattgaaaaggcctttgactaggtataaatagaaaatatatatatataaaagcttacaaagttaaaaaaaaaacacataaaaaacttccacattaatagtcccttgaaaggtagggaatcactgaaaggtaaaaatatggtaggtcaaagtaatactaaatctggggatgtaaaaagaaagactttccagtgaaatcaaaggaaagaccacttatgtgtaagaaaatagaggaaaggacgatttgctgttttcagttccaatttgaaaatttctttctcttgtcgaattgctctggctaggacttccagtactatgctgaataaatgtggtgaaagtgggcatccttgtcttgttccaaatcttagaggaaagggtccagtccttccttcccacctactttcctgctcacttaatccccactgagtgtgtgtctggagagtcaagcaaaactctttttaaattttatttttttattttttaaagagaggacagacatttgaaacattttctccaagtttccataaaaagcactttatgaaacaatctaggcttaccagccttgacattccccagctctctggacttaatcacaaagggagatgaggccaagccttgggaggtagagtagaagaaagtataggactcctttgatgccatctacacacattaaatggaccagccacttctctacattgggcctttatcttttaactattaaagcataaggttattcatgtataaggctggctgcaaaatccttcacaaatgaaagtataccctgtaagtgcacttaataggcccccctttaatttctattgttcatagtggcataaacaagggttttcaccattcaataagaagttaactgtgggtttgtcatatatgacctgtattgagatatgtgccttatatacccagttggttaagactttttttattatgaagagatgttgaatgttattgaatgcctttggggcatctgtggaaatgatcatacgatttttatccttgattctgttaatgtgatgtttcacattatctcacaatgtatgtatgtaaaacctatcttgcatccctgggatgaatcccagttggtcatggtgaatgatctttttaacatgttgctgaattcacttttatagtattttgttgagaatttttgcatctatcttcgtcagggatattggcctgcagttttctttttttgttgtgcctttgtctggttctggtagcagggtaccttgtagaatgagtttggaagtattcctcttcaattgtattggaacagtttgagtatacgtggtattagttctactttaaatgtttggtagaatttagcaatacagccactgggtcctaggcttttctttgatgggagaacttttattactacttgtatctcattgttcattatagtctgttcaagttttctattttgtcatggtttaatatttgaaggttgtatatgttcacaaatttaaccatttattctaggctttccatttttttggtgtacggttgttcataatagtctctaatgactttttgtgtttttctggtaccaggtgtaatgtcttatttttaactctgattttatttatttgggtcttcttcctttttgtcttagtctagctaaaggtttgtaaattttccttatctttaaaaaaccaactttttattcattgatcttttgtaatttttaagttttctgttttacttatttctgttcttacctttctcatttctttccttctactaattttgaatttggcatgttattgctttttttttagttttttgatgagcattgttaggctgtttatttgaagtctttttttatactgtaagcatttactgctataaactttcttcatagtactgcttttgttgtatcccatagatttgggaatgttgtgttttcattttttccaagactctttaaaatgttattcctaattttttaaattaattcattggttgtacaggagcatgttgtttaattttcatatatttagtggttccaaagtttctcttgtttgtgcccttgtttgcaaacgtgaccttctacttacaaaatctaaagacaccaccaaataattgttagaaccaataaataaaattagtgaaggtgcagtatactaactcagtgtaaatagctcattagcatttctatgtgccagcagcaaacaatttgaaaaagaaattaggaaagcaatcccatttacaatgagtatgaaaaatacattacctaggaataaattaaaccaaagtaatggaagatctctataataaaaccagtaatatactgatcacagaattttaaaaagaacacacaaaataatggaaagatatcccatgttcatggattggatgaagtaatattgttataaatttcatattaccttaaaaaaatctacagatccagtgcaatccctgtggatgttactgtttacaaaactgtaaacatggctatatttctccattatctgcaatgctgcgattttggttactctgccaatgagaacagatggaggtggaatgaggatactccttatttagagcatcacagacaccactgtcgacgacgttcagtagtttctcttgggcagttttcagctatttttgtggctttaactgattggcagaattctgaagttgcttttttcccctcacatgtccactcttttatggaaataataaatacactgagttggccaggttttcacttacatgagattgtgaccgtaacttagggccttagcaccactctcagttaccatcattttgggtttccagtctcagaatgtcattcatagtttacggtgtcctcatggtcacacatttctttcagctgctgtcattccagttgaagagagaccatttgactttctagagatggctgcacgcaaacatttaaaacctttgagagaatacagtgcaccagggaaatgaccaagagtttagagtatgctccttatccaggattcccataaaccgaaccaccaaaaaacaaataggttaaagaatgagctagctgaagtgtctactcacttgactaagtagtattttcattaatcccctacaactgaaatattgtaatctacatttgatgtatttctctataagccacaagtatcaatagctgcacaggtacttttctgtttagccaattctattatttagcataacttttacaagagaatttaaagtctgttgtgtaatgatagcctttaaagtagaatttgctgtagaacctattatgagtgagacatttctgaatattgccacttttattctaaaccatggaaaaagagcctaacaaatgatgtccttctagaagactgaaggcctcctggcaatgttctctttaatccaggatgtgggttaagagttttgactgattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccaggaagcagagcttgcagtgagccgagattgcgccactgcagtccgcagtctggcctgggcgacagagcgagactccgtctcaaaaaaaaaaaaaaaaaaaaaaagagttttgactgattatgaggcaacgtacgtactactaaagtttctcacctacattgggcctttatcttttatctattaaagcataaggttattcatttataaggctggctgcaaaattcttcacaaatgaaagtataccctataagtgcacttaataggcccccttttaatttctattgttcatagtggcataaacaaggaaaaaatattcaaagataagagtctcgtgagagtagaagccttgatctgtgatcttgggaaaagttgttcacatcaaggatgtcatctttttctggggagaagctttcctggttagttttaccttaagggttccgatgggtgtacagttccaggagtatggaggcacccttctcagctgtgagattataaacccaaggttcaaagctaacaaattttgctgtagtgtgaatggcagagatagtctttctctgatgttctcagaagatccaatcttcaggttctagattgtgaagagattatcctcagtaagccataaaaaagctttctttacctggtgaaaatacactgtagcataataatctacttttataataccagctctcttgcatggaaaagctgttatacaaccaaaaagcatgcactgcaaatgacaattgaataaaatctctttataaatatttaaatggctcatcaggtagccaaatgtacctgaagctttgattgtcttcccaggaatatggaaccaaacattggttttagggtggagcccttggaaaaacagggccaggaaagtggtttctggtgcctcctgtttttcccagggagtccaggctattagagcttgaatatccacttttaattaagctggtttttaaccatagtactctttaatgaagtccttttaaaatttcttattacccgattttagccaggccaaaaagccaatatttctggcttttgaattttaccaaaggtaacctcccaggtgcccagagaaaggaaaatttaagatagtgaatggaggagagactagacaaggttatgcagatattaaaccaagaagggcttacttcctaggtggggaattgaaccatcagtgtgaaaggccaaagtcttagctactgagctatagcacagggcagtctctattgtccttcccagaaggagtctagagtagttaaatttgaacttgcaaacgcttttaactactcaagataatttttagagctaactatgacataaaccctaacatttctgttccctggcaggtgaagactaatagaaaatactgccacatggttacaaggtcaagctcccaaggacataaaacaagagggaggaaggcaaaatgatcagggaagccagagaaagacccatccattgaagcgacactgaaaagttcaggtagctgcttctcagtagcaaaggggtctttcccagcagtcccatcatctctcaagtttccccttttagggaggaaaaggctccccatggtcagcgatcctgtacatccctaatcctgtcacccacagccatcagcacagagtgcaaggcagattaatccaaagagaagagcagatgacatgctgtagtgccaaacccattcttggccaagagggacttttaccaagagccctcatttttaaaatgtacttcaatggattgttgttcacttggaacattccactgtaagttatcattagtaagtttttgccatttctgtaagacttcactgccttccgggcctaatgaataaaccagaaggaactcagttttctagaaactaaggatcccatttttacctaaaatactggcttcgatctcaggttctcttgattaacctggccaatgatttttcatacctcagcatgcaagaaaaatgaaacaaaggggtaaaacacaaaaatccctgggaattttcaaaagacaaattttataacccctgcaatattagcgcttactaccagtttctttctctcccagtcagatgtaagaggtctctaactggatccaagccagttcattcctgtatcaaatccattcctggacccagtgcagtttctgttgcgactccaaacccagtttggatcagaaatttgctcaaagaaactcggagaactcaaaacacaaatccgtggagctcagaaatctgagagggagcttatccatgatctccagctgctctgagagattaaaggacccaagtgggccctgtaggtaccttgcgtgttcactcagtgctcctaggggtcgctagaagctccacttctggtaccatctgataaaagaaaaacttcagaattaatttaaaggagtttaattgagcaatgaatgattcgcgaattgggcagcccccagaatcacagcagattcacagagactccaggggtgcctcgtggtcagaacaaatttatagacaaaaaaggtaaaatgacatacaggaataggaagtgaggtacagaaatagcgagactgattacagcttggcttttgccttatttgaacgcagtttaaacattctgcagtctgtgagtggttgaagtatggccactgggattggtcgacactcagccactgttaacaggtgcatactattaagataggttttcgcatttgtctggctattaagctaggttacagtttaaccacaaggactcaaatatagaaatacggaatctttttaggccatatttagtttgttttaacagatggaagaatctgataccaaagttgttataatatattatctaaaatgtccagttttctggcagagcaggaacatcaccatctcagataggcactgccattttaagttccccttgattaaaaactgcctaaatccagcccaaaaaacatcaccctaatggctaatgtcagcataatcataaacctcaaaagacacctctgaccagaaacattccaaccctgagataaacccccctccaaccagagacatgccagcccctaggtaacttcccctccaaccagagacattccaaccctgcaataaaactctcctccacacaaaaacattttcagcctgtgaaaagctctcttcctaaacccttaaatacccttaatctgtaagagagaatgctcctgaccaaaatcagccagaagcccctcttgggtttattctccaaaataaacctgtctttgaattgttgatctgcttttcgtgtttcttttttctatcttcaacttcacattttcgataacaacataaacaaaatacaagacataccaaaaaataaaggaaaatataccacatatacagaaagaaaagtacagccaacggaaaacataccttagagggtacagatattggtcttactagacaaaagactttaaatcagctgtactaattatgttcaaagaactaaaagaaattatgtattatgaataaaaataatacatgataacagtgtctcaacaaatagagaataatagtaaaggaacagaagttataaaaaggaaccaaataaaaattataaagttggcaagtatattaacaaaaaaaattactggaagggctcaaaacagatttgaactggcaaaaggaagaattgaagaattgtgaacttagaggtaaaccaatagtggttatccagtctaagaaacaaaccaaaaaaaggaagtaaagaaaaataaacagagtctcaaagacatgtggaatggtctccaatgtcacttattgcccattgtatacccatatatgtccattgtttagcttccacatataagtgagaaaatgtggtatttgattttctgtttctgagttatttcactaggagtgatggtccccaactcaatccatgttgccgcaaaagacatgatttcatactttttatggctgcatagtattccatagtgtgcgcatgtgtgtgtgtttcacatttttttaatccaatcacctgtttagggacatatcatgtgactgctatttgaaatagtgctgtgagaaacatacaagtgtaggtgtcttttttatataatgttttctttcccttcagatagatatacagtaatgggattacttgatctagtgatagttctatttttagttctttgagaaatctccatactgtctccatagaagttgtactaatttacatttctaccaacagtgtataagcattgccttttctctgcatccttgccaacatttgttattttttgactttttaataatagttattctgacaggttgacgccttttatttctttttcttgcctgattgttgtggccaggacttccaattctatgttgaataggagtggtgaaaatggcgtccttgccttgttccacttcttagggggaatgttttcagctcttcccccattgactatgatgttgtcagtaggtttgtcatatatgatttttattattttgaaatacgtttcttctcatgccttgtttgttgataatttttatcatgagagatgctgtattttatctaatgctttttttaatctatcgaggtgaccatatgattttcatttttattctgttcatgtggtgaattacatttattgttttgtatatgttgaaccatccttgcatacctggaataaacccatttgatcatggtgtattatttgtttgatatcctgttgaatttagtttgcttgtattttgttgaggatatttgtatctatgttcatcaggatatttgcctgtagtttcttttcaatgtgttaaaagaaagactatcgatcaaaaattttgtattcagccatgctctcttttaaaaataagagaggaattatgatatctctgggtttaaaacaaactactgaaagaattaatcaccagcagatctgccctacaaaaatagtaaagagaatctttcaggctgacatgaaacagcagtagatggtaacagaagtacatatgaagaaacaaaaagggcaggtaaaagtaacaataaagagatcataaaagacagtgtaaacttgtaaaacatgatgctttcatcttcctgtctattcaaaaagacaatttcataaaataataattgtaacattattgtgtagaaggggttataatatataaaaatataatttttatggccctaatagtaaaagtggggagcagtacctaaggtatattggagtgattatttggtatactattgatattaagttggtattaatccaaattggattgcactgagatgttaattataactcctagcacagacactattaaactaactcaaaaaatacagtaaaatattaaaagagaaacactggaagtatatatttgacacaaaagtaggcaagaatctaagaacagaaataataatacacatagaaaacaagtagcaaaatggcagattcaaatcctacgttatgaattataacattaaatgtaaaaatgagttaaataccccaaagagcagagattgactgaactgaaaaaaaaagattaaaaaaaggtccaagatttacaagagagatacactttagattcaaagacacaaatagatcaactgtaaaatcatagtagatatgcccatttaagatataatcaagagaactggaatggctatacgaagatcagactgaattaattataagacaaatattgttactggagacaagaggggcattgtattataaaaatagtatcaattcatcaggaagatatgatcattataagtatttatgcatctgacaacagggtctcaaaatacctgaagcaaaaactggaagaattgaaagaaaacatagacaatgaaaaaatagctggagaacataaccccatttttaataatgtatagaacctctaggcagaagagaaacaagaaagtagaagacatgtacaattctataaaccaattagtctacacatttatagaacattctacccaataacagaaaaaatgtgcactcttcttaatgtacatgaaacttctagatagaccgtaagttaggccacgtgacaatcgtaaataagtttaaaatgattggtagcatgtaaagtatggactcaaaacacaatgtaattaaattaaatatgaaaaagagaagagagttttaaaaattgaatatttgaaaataaaaaacacactactaaaaaaacccgtgggccaaagacaaaaagcttcagtaggagttataaaatactttgaaatgagggaaaagaaaaacacaatatgtcaaaacttgtcggatacatttgtagcagtttgtagagagaaattcatagttataaatttctatattaaaaaagatgaaagatctcaaataaataatcttccaacttaaaagaaaaagaagagcaagctaagttaaaagcaagcaaaaggaaaaaaagaataaatattaaagctgaaaagtaagaaacaggaaatataaaaacaatagtgaaaagtcaatgaaaccaaaagttggtttgatgaaaagatcaacaagatgggcaaatatttagctaaaatgaccaagataaaaataaagaaaacacaatttaatgaaatcattaatgaaagaaagtcatcatttctgaccttatagaaataaaaagataagaaaatactatttacaattgtatactaaaaattagataacttagaggaagaaatggaaagtgactactaaatggtatgctgtttatatttttattgatacataatacatatgcatattttcaggatacatgtgataatttaataccttcatatcatttgtgagggtccaatcagtgtaaatggtacatccaccacttaaataattgtcttttctgtatgctagaaacattaaaaattttctaaatttagtttgtggtaactttgcaagccttaatacattgaaaatgagggaactgcatgctttaaatgggtgaatattatggtggtatgtgaaatatatctcaatgaagatttagaaaacaacaactattaatcctatacttgagaattctatcaaaaatgagaaatattgaaaaggttatctttggtgtttagaagtttctcaaaatggaatggaacactagacttcactaatattatttaatattaagtaaatattaatatttaatatagcttatacatatattagttatacttgaagaaacaggtatacaacattgcatgtacatatacctgcaatctataaatatttttcaggagatttcatagctcttaggagataaaacacacaaaattatataaataactagtcattattcatgtttttgcagtgacatgaaccataaagttttatgcatccagtgcatgtgtatttatatatatttattcactagaatccaattgaccttgtattacagcccatatgcattaagatgcttatcgattttagaagacagttaatttctaaatgttaggaaaatgttattatactatatgcatatgttgaaatatctggtatgctcataatttttgtaagcgcttaactcactatttaaaaaatgttctgaacagatagtgttacaatataaaatactaaacttagaacacatgattttaaatagtagatgactgtacaattattaattagtattacagatttgagacacatttatcttcaaaccaatttaatgcaaattagagcaaatgattacatggcagcataattatatctagcttgtgacctaccaaagataggaaatggcacacgagattaaaactggaggaaagaaatagaaaatcttgacccaaactaatatctctgtagttcaattacatgctactaaacactggctgtaccctctgctttctttagctgaaaacaccagtgctgtgttccctccagtgatctgtattcaagtacttgagaatttctcatcagtactagtgattctcactctgggggtgagccacattttcacattttctttggtgattgcataagaatgcctatggttgatatttaaagttctaaaaagttaacagggctgtcagtacttatgttgaggacatcacctcattcccacctgcataatttcttctttgaagattatattaatcctttagtaacaccatagtgtctaataagcaacatatttgtggaggcctaaaaaatggtttgaataatctcctcagcatggccttcatctgggggtggtccttcagaagtttcttccatgttaatgtctgtctcaacaccaagtcctttgtcttcatgtaccttgttgttgggaagtcacgacacctaaaatgatttcaagctaaatgacagtttttcttgatctgggagaataaatgacgagagcaaagctaagcctgagaaatttgtgaaatatattatgtttgtctttgaagtgccctaacgttcttcacacaggacctctctcattgttcctgcctggtaatctaatgcccccaccaaacactataaatggactgatctttccaaacctactttaccttaaacagtctcatattacagagttacttctcatctcctatagatccttccatcaaaaaaatatatatttccttagtacactttgtgtaaggaaaataatctgattaaaatcattcacatataaatcaatttgtcttagtactccatttgacgggacaaagaagttgacatttctttaagtgaatgaatcaggtctaataccaaactccttgcaaaaatgttctccctcctctgtattctggagagaatctaagagttattctggtaataattcaaattttcaaggtattgtttacaaatctggatgcagttcactcacaataaaatttttaaactcacactcactaccttgggtttgaaaatggcttaaccaccatcatcacagaaatgctttgaaatacgtttcagtgttgtgcttttagatggtaaattccttgatgtccagtgagattaaacaaattgtttgccgcaattcttactgtgaaacaatcaataacttcactcctgaagtatggtcatctctattgtgaggttcacaaggcctttgcccacagaaagaattgagaaatcaattttgactccctacgagttgtgactgtgtctctacttgactaaataaataagtagatcaagtggaaaagaaagaggatgtcatgctcagcaaaggttactaatagatatatctgttagcccacagatctggggtaatgatattttagatattacttgactttcccatgcctatccagtaacccttaagaataccctctttacagaacaatgtcaaagtggttgatttagaagaaatttccaaccataagcattccagaatgagggaagtacatcactctaggagcaagcaaactgtgttaccctcagacaaaagcaaaataaaacacagcaattagaacactgccttaataagggctttgtctctctgaatgaattatgagataaaaaagaatacatgaataaatcactcagtaaagtgtaaagtgtcatgggaaaaataggtactctattcctagtatattctaacagaagagatgcttgttaacatctgtttgagtttcacaaacagcaaaagctggcaatctgtaaagttttaattaaataaagcaaaaagaatttgtcacttggtaaagtttctgggaaattgatgcttaaaatgtatcaaaataaggaatgaaatttctaggtcagttttttctttgatgtgatatattaaaaatgtcctacctttaggctttttatatacggtctttcagataactgcaaaaaaacaatttttctctgtaaaataaatgggcaatttaacaatccacagcaatgttagtgctagtcagaattgccattttagcatttatataataagaagaaaagtgtgcagctctgttttttgtttgagagttttatcttggccaggtgtggtggctcacacctgtaatcccaacactttgggaggctgaggcaggtggatcacctgaggtcgggagttcgggaccagcctgacaaacaaggtgaaaccccatctctactaaaaatacaaaaattagctgggcatgttgggaggcacctgtagtcccagctactcgggaggctgagacaggagaattgcttgagcccaggaggtggaggttgcagggagccgagatctcgtctctgcactctagcctgggtgacacagtgaaactccgcctcaaaaaaaaaagaaaaaaaatagttttatcttgaaagatgtctagaagaactatgagaaagatacattgaagaactaaaatttcatacaatttcttgaaatgttgaaattttatccaaagctaccaaatttttcaggaaactatgtaacttaagtaatatagtggagagctgtcctttaggactttaagataagcaaaatgatattaagctttgtaacacagtagaagaactggatccaagtgtcagacaattggtttaaaatccaaggtgtgacatttattatctctggacattggggaatttacttatcaaataggagcttcatttttctcatttgtagaataatacttatcttttagggttattgtgcattcacacaaaaaaatgagatagtggacaaaaaaagttgtaattatgtaaggcgtatagacaaggtaaataaaaggtaaatatgagatatgtaaatgaggtaaagaaaataaaatacctaccatagtgcccaataacttcaattagctcacactgtagatatttccaatatagattatatattgtttcagagtttgaattgttaatatgaatttctctaacttttagatataaattaaacaaaaatccttaatctcttttttaactaaaaaaattcaggaggctgaggcaggagaatggcgtgaacccgggaggtggagcttgcagtgagccaagatcgtgccactgcactccagcctgggcgacagagcaagactccgtctcaaaaataatgatgataataataataataataataataataataataataatttattgtgataatatacacataacataaaattaaccatgttaatcatttttaagtattctgttcaatagtgctaagtacaacatattaaacttctaaaagtattaagaagtcataaactctcttttctgattgttgtaaatttatttgtattaaggcaaaacatcttcctgagaacaacttcagtttcccattctccactggtgtgacctatcattcctacattctattagcattcaaattagaagtgaaaatgagataataagtatacagattcgttttgatccctaatgaaatatgaaaagaattaacatgaattgttgtatggtctttccctgagtcttagaatagtatttaaatattttcctagtgcctcatatggcatacaagaaaatcaaggctaatgttcagtgatcactgtaacaaataattatccagcactagaactaaggattaattcgttcaagttaaatattctttctaaaacttcaagttgtctcacagtatttttttttcttttcatggtgcttttctttctattcgttggtaacaatgagatgactttctagtgtttttgttcttgttgtgttttgttttgtttttagtaagacaagatgacacttgttatttagttcacctggtgaacagtctaaagaaatctattcaaaaaatgcatattttctcctgaaaacattcagctttatctaactataatatcttggataattatattatacttctgtcgtttatcacagattcatctgcctatactgaaattaatgtaacagtcttctgtttgttgaatcagagctctaatatcatgattcaatctgtgagctgctccccatttgaatcaataaaaggctgagaggtcttgacaagctatattttttctaatattgatcttgatgaccaagctggtgcccttgagtctaaccattgattttaaatgggaggcctgtcaagttggaggccaattttttgctattaaacagatcgggtcttgtaattaaagaaaatgtcaggctgtcatattttacaagagggccatgggaatattttcacgcagttttcaagcaaattagaaagtatgcagacctgctggagccaaacacatacacccaaaccagcataggcttacacagaaactaaatcaatgttcaaatagtatgtgattcattggctttctattttcccaagactcaatgatttaaggaataatttatgattcctggctctaataacatgcactgctgcatcaacttaaaatgcatcaaactcttctgaaagaaagtaacattcaaatgaaaagctaatttactgtcaggataatggagaacatccaatccagtctctgcagcttttgcttcctgtttctttctagtactactggaaaccataacttcttactcctctttttatgatacatttcctttattcttccatcagttcaagaaatatttacagaaaagcaacaaataaagagctgttgaaagatcacattagtgtagaagaaacagaccagtaagcaaaacaacattatatttgttgtaatataggtatagtacaagtgccttcaaaagctaagaagtgaagggctaactttgctatggatgtagtaccatattgagcagagcttgggactactgtatgagaaattgagagcctgaaatttttatattggaatgtgataaggactcacataagtttgagaattgacttctgaggctagggatactataaaattgaacataaaatatagaactttcagaactggaaaagaaaatattaaaataccaagagaaaacatactaagaacacaaattaataattctcccaaaaggaaatatgaattactataagctttcaggaaaatattcaaccgttatttctccaaatattgattttgtccaataaatattgtcctaacattgtttcaataatgtcccagtcaatatctcttttattattctgtaatttctgttacacttatgttagtacttctgcccatgtgacatgatctaacttatgctctgttcctctcattcttattttttcctcccagcttcagtttgcatatttttattgacttgtcttcaaatgtattgatatcatctttgactgtgttgaatctgcttttaagcccatccaatgacttactaattcctaatactgtattttattccttatacaaaatatacatttgattttgtatatattgtattctctgtaaaaatatttcatcatctacatattttctatagtttttctgtttctttaatatgctagtcatagttattttgaaattattttctgctaactacaacatcaggagtttttataggcctgcatgttaataatcttatcactttttattaatatcagtcactttttctttttaaatatctagagtgttgggtggttttgtttttgctatttcttttttttttttttgtattctggaggttacaagtgatacttataaactattgaaattctgaatcatggatccttccttaaaaaaatgtttcactttgttctggtaggcaccttgatgctgaagagtcccactgttagctttgttaagatagtcctgtattagtttggaaagcacagcgtatccgctaaaatctttccattctggatgaaccagaaaaatgatttccctcccaacaacaaaagactcttgattcttcacttgctttctgcctcccagcagctgctgccttgtgaacttccatagtctttctctgtgcttttgcagtccagaaattgtccaaggatctaagaaatattttcaacaaatagatgggatgcttatccacattccgtctttgatagcagctccaacttccacttatcaataccactattccatgtttgctatctaaatacctacagtgaagcccagaataatatcccaagactcattttatgcatctcaactccaaaattccctacgatggttgcccaatgacagccgtcagttgttttatatgataatattaatcaaacaattgttttattaagttttttttaaaaatttaactattaatatacattaatctcaaagttattgtactgcgtgaaaggcaaacaaaagagattatagaatatagctcgattgtataaaatgatggaaaataaaaaggagtccatagtgcagaacacagatcagcagctaaaattttcatttatattatatgactttatatggtgataactttggagggaaagattccaaagagatatgaggacactttttacagtgttgactgagatgattgtttcatggtgtacaggtataattaaatgcaaaattatacaattcaaatatgtgcaatttagtgtatgccaattttgcctcaaaagttgtgaatacgcacgcataagtatctgcacatatttatatctacagaaagacacatacaatgctgattaataatttataaggaaataatatagtaattttaaagaaatttggaaatatgcatcaaatagtgaaaatttttcaacttctatgaaatccaactccaaggaaatgttatgaactataaacaaatatgttttcagaaagacatttataatagtattatttaaaatcttgaaaaacttgatgcgtgataaattatcaataaaacactcttaaatattgacatagtcacatagtgaattatggtttaattattacgttggtaaaatgtttataatacaatttacctttttgcccttctttacccttttatttgtttttaggcacattattacattgaaacacatctatatacacatttcaatgagttttgaaaaataaatacgcctataagccactatcccaatcaaaacatagaatatttctgtcaattgagaagtatttttgtgatacttttattcaatacacactataaacatgtagccatttcctgatttatagcaacaatgatgggtttggcatgtttcttaaattaatataaatgaaataatagactatatactattatgaattgcctatttatatgaaaatatcacaattcatatttggtgactctctattggttgaattatggcaaatatttttctgtgtctattaagatgagcatatacctttttcctcctttattatcttactgtaatgaattaggttgattatttattatttttttttttgagacggagtctcgctttgtcacccatgccggaatgcggtggtgctgtcttggctcactgcaacctctgcctcccaagttcaagcaattctcctgcctcagcctgagcagctgggactacaggtgcacgataccacgcccggataatttttgtatttttagtagagactgggtttcaccatattggccaggctggtgtcgatctcctgaccttgtgatccgcccgcctcggcctctcaaagtgctgagattacaggcatgagccaccgcacccagcctgattagtttttaagtaggaacaccatctggtattctttcccactgggtcatgatgtatttttacctacattatctgatttgatttgctaaatttctgtcaaatactttaatgtccatatataaggggttattgttctacaatttgcttttttttaagaataccattgtcatatttgggcttcagagttgtgttgaccttatcaaatgagttgaggagtgacaatttaggacaatttccagagatttcatttttgtttaatatttttcaccagttgtggttctttcactagggaaggggttctgaaacctcatcacaatgctctcctaaaatttgtccctagagtcaaagagtgctccagtgttattaaaccaaatgctcttactttgacctttgccaaaggtataaataatacttaatgtcaaatttattttcaagtggttcttgaaataagcctttttaaaaagtcgaactctttaaatcaatagtgttagtattttaagaaaattgtatcttttattttatgctagtttgttgtagtattaaaactgaccatattattaattgtgtatataatattctagcacctatagctctttgtcctcaaagccccagaagatgattaagaaatattttctttcagttgtttctctttccctaaaaattacttttaggcctgtttactatctacaggtataacttgccaaattctttgcagacttttatacctcctaagctactacctctgaagaaatcaccttggttggctgttttgttgactgctactgctggttagccaggagataaatttcaagtggccacaaattcattctttgattgtgactgggttgcatcacgtgatatgaaatatcagaaatgtagtacagaaaatgtgttctgataaaacatgaatatatattttgcatcaatccaacaacaaagcaaaacaaaaaataaattaaataatacataaacaattttatccatatcatttgcctcctcaaatattgcagtggagtggcagtgtttgagagggaaatacatataatatgaaacaccggggttaaagacaacatatgttcctctaaaaaattatcttgtcacttacttgctttttgaatagaggcaaattatatatcctgtatgagccttcgattctttatgtgttaaaaaaataatgctgacttctttatgggattgttgtaaatattcaataatagtgttttacacaatgcatgacctgcaagaaatacaattttttctccgaatggtagttaattgtttctgctataatatccttccttttcattcagcagaatgcattataatatagtcagacagttaagaaaattggttctattcagtctctctatgccaaattgtatggtattgacaaattatgtagcctttctatatctctgttctgcataggattgctgtaagacaattcagatagtgtgtgtgaaatgcttagaacattctgcaacattttagtaagtattcaataaatattacccattgttattatattccaaaaaatcctacatgataaatgagaagaaaaaaggatttaagagaaattaagtgattttttttttttccccaggagcctcagcaaataaatggcctaaacaattggaagcctagggatgtaattgctggtcttctattaaaaagtgaaggagacaagattttaatgaaggtactcattctattcataggctggacaaaaatagtggttttaatagaacgagctaataagtaagagataaaagtagaaaacccagagctacctggaattacactacactcaattatactcgatcgtatatagacagattagccttcctctcaggtgacatctcacgcaatccaagatttgaagttttttttttttttctatcactgctattttctctaggataatatattcaatgaatagaaatcaaatagaaatcaaatcggctttaacagttatgatgtaagattactccagtaaaataacttcacagatgtacgtcatgattcaggagtaaaaacaaattatcttgaaatatgtaaatcattgtgacccattttcagcttgaattatttgtgctttcacacagattttcacttcttttgcttataaaagtaatgttattaatacatttttatttgaatttttaattttaagaacaaatgcccatccactaacttattctagacttaagactttttttacagacagctgaaaatttgctaagaacatactaacattgaaacagcagggaaattctcacatagggaaagagaggagaaaattatttacttatggtttatggggatcctatctgctccagtgaatttaatttaccacaggaaagatgctctgtatacgaaataaaatatacttctttatctcaaagtgtacatttcaaggaatattttgtctcctttacaagaaggattaattcacataaaattaatatttagtaataattatttcatgattaaaattctatttaacaaactccacttaaactgtgtctataataatcaaaacaactgaacagcaaatatttattctaatgatttgcagctgcaatagtatatattgtgcttgcaaaaactttgccatcagtttatattgcttcatccttagtcgtatcgtagactttcttgacccaataaggaatttactgataaatgacattctaggacaagcatatcctaggctacaaatgaaggagaatggtgaagactagctgcctctaaggtatctgggacataagtcagaaagttcaaacctgagatttaaactcaaattagcccaaagggggttggtaaaaggtgacatgtgaagctgtttagacgtgtataaacaaatttcaatatcccaatagtcaacaaatattaattaatataataatgacagttttgagggtatatatagcttctgggtggcataacataatatataaaaaattatgccatgtaaatttgctgaacaataattaatacattgctagcccaagtaggatgtgcatactggtgtgttataaaatattttaaggaactgaaatattttagctatccatatctcacaactatacagatgcagtttgatagaaaaagtatgttctattagtctactacatgaagcattctgaagtgccatttcatttattctatgggtgtgcttatgctgtaccatgtacacttggacatagagcatctcattccaaataactactttcacttgttcggtagtgactatgtaaaggctagttttattttcatcattaaatagtgagagattttactgtctagacaaaggagagagaaaaggcatctttctatggagcaggtgaaaccaccggattgaaaggaaaaatgcaagcagttgattgtcacacagccagaggaatgggttaatacaataactcctatccctactactgctattaagtaacagtgagtgagagaatagggtagggaaaggagaaagggagaggggaataaggaaaggaagagaggggaggagaaagaagaagaggatggggaggaggtgcacatgtgtaattaaaatatccataacactttaagatggatgctctagtaggatgtgaaaaagatatagtgggaagataaagaagaaagtagcttcagagaagagaatatttgttgtatataataaacagtgggatattgtaaaaattgcatattcttattcagtagctctgtgggtggggggacggggtgttgacattctgtgtttttaactaacaagctcctaggtaatgctgatgttgctgttcttcagaccaaactttaagtagcaattaaagtaattaagtaattaagtaattaagggtagagaagacattgatatttattctaggcagagtgatgaataccctctagtagtcatggaagaataaaagcatttggtctggctagtagttcactgagcataaatagttcactgagcataagtagttcactgaactatcagataatgatttagaaaaaaaaagtattacaaatgacctcaggctaaacattctgaacattattttgtgggcaaagggaagcctacaaatgcttctgttcctaagtgtgccactgtaggcttgttggtaaggaaaccataaacatgttatagtttaaagggcaagatggaattagagaaagaggaagaggaagaactgttagcagacttcagccattgccagagtgaggaaagcaccaggttgaactttggagatggaaaagaaaattccagatttggcacctacttctgagtcatcaacagaacatagtcaattattagatggaaatagttgggataaaaaaataagtaattgacaaggaacattactttatattttgtgttgttttatttcgctttagccaagaatgcataggaaaaaatagataatattaaaaaggtaaaaattatgggatggtatgaaagcatatagaaagtctatatgggtatattgaatagacaaagttttagaatgtaaatcgcggagtgggccatggatattgaaaattagaaggtgacagggattacacagggattgaatatatattgcaagccagtgattttttttcatagagtatttcttttaattagaaagccactggtaaccttagcaagagttgaatgatagaaagaagagacaatagaatgacacaaattatagagtcgatagaatgacgcaaattatagagaggtaaatggatttgtgtgcctcatgggtatatgtgtatgcaaatatggaaagtggctgtgggaagtaaagcccctggtagttgttctttaatttggatgataaaggtggcatactttttgtttctagaggaaccattcctgttttctgattatgaacgcgggtagcagatgtccttggaaagaatgtccactagatttgctccaaggccaagggcatcatcctgtagattctgataaaatagttagttaattatcgtatccaagatgaaagctgacaactacaaatcataaggcaattgatgatggcaggaagtttgtcaacattcaaatccctcgagtcccatccctcgaaaaagacatattcttcctactccttagcagtgatagcgttgtaccaatatcaaatcacagatttttagagggaaatgggtataataaaattgcctatacatttttatagtaaattctagaatttcttaaaatctgagaaattatttcaatgacaatttttttctacagtatatctaggtaatgatcgctgagactcatagagtgatgaaaataaacatttaggtgttgtatatctctcatatgttttaataagttttcaggtgtattttattttcagtagacgacccttcggtggaggattggggaacaaattttaattcaagccattttctcccagggcacacatgctaatgtattacagaaagctgaaccataatattctaagcacttcagttagtcttcacttttgaaattactcttttgaactgagtcaaaaaaaaaaaaagaaaaagaccctttcatttcattgaagtgaagcaaatctctctgctttaattaagagcaatcggaggaaatagtgataacagaagtccagctccgagccgtgtataaagaaatgatcgcgggctctggctgccagccaggctgccaggctgtttttcatgggtgttactcgactgacagtaccttcctgacatttgtacctcgacaccagaagtgctaacagctgcgatgccagtggtagaaaagcaaggaagatctttttcagctttagttgctctcagattctcagcaccctaagagaataaagtctgttaaaactgacttcagttggctatgtcctttgcgaagatttttgtgttggtgtctgaaaagcagttttattccatgacattgggcttaggggagattattttttcaagacagaagacacatgtggtaaatgcgtgacaaatggcagtaacaaagttgggctgggagttcatggttttatgaaatgaaatatttcagcaaccaattccgtgctctgttacttgctgcagacagcccttttgaccctacactgaggcagccaaaaaggactataggagaaaatttctagttatcttgaagttggatggtattcttaactaatagtgacagatgtagcaatatgacttctagtgcttgctgctaatggcagagcttcaagccatcaggaaatgagaaaggtcagaagacaagtgcacatatgtgagaaacgagttcagacgataaagggtgagatgtggtttttggaaaagctcattttgggaacctttccagtctgtcttggtggtttcaaggtgattcttggcacataagcgtatccctaacattttgacatactctagagaatcaaggtcctgaaaagaatataacactgcttaaatatcaaggagccacgatgcactgataacttgtttcgtacatttaatcttctttatgattttagcgttgctactgctttgatcttaaaaataggaaaaatgtttagcaaaacataataaattttctaaaatttaaaggatatttaagagcccttctacaataattaacttactgtaaaaaaaaagaaaacttctataaatagttcaattgctaatgctttatagcagatgagttttttacaaaagagtttgtatttttaattttataacaactgggttgtctccacatgcacttttctgtcacctccatatttcagacaaatctgggcagattctgggtggtgtggtcctagactgaaaactctgtttcaaaatccaagtataaaactttgtctttaatgacatttcaaacgtttcatatacacaatgaaaagatttttaaacagcataaaaacccataaatgtaagagaaatatcttcttacatgtacattataagtattcttattgagagaaataagtgttctattgataactttaagtaaataaagccaaaaggacagaagaaagtctataattaagcacaattcaatcattgtggccatttaattctgttgttttcatgtataatctgaagtccagagaagttaaggaaagcatgtgattttatgcagctaattaatgattagaattcagtatgccaactcccaatcctggggttctttctagaacaacatccctggacatgctcagaaagcaaaaatgtcagaatatttttctttcagcactaatgctatgattcatgtcaaaacaaaaacttcagctgaagaaataaagataaattgatttaatgtgatggcatcacatcatagtaatttcaaaaacttttgagaattattttttttttttgtaattaactctccaatcggcaatggcagagaggagcatcatccaaaacatctacagggaagtctgcatatttttttcatttcattgctaatgagccattttcacctggctcctgctcccactactcccccatgaagaaccagctgtcagtttccacagctgagcaggtttggtaccagacaggtggcagcagggtggggaagaaattgtgtcagtgggatgtagttaatctggaattatggtgatccacctggtatcattaaacattgactccatatcatgaatggttcactacaagacaatcaacacttaaattaaaagttaaagttttaaatatccttgaaaagacaaatatgaaggtttggtattaattgaaaatctgcagtcttatacacattagatcaactaagtccatttagagatgacagaattttatattctgtttatagaaaaggtgaattggactgtgctattccagattctaacattcactcactctgtaagctttttatgctataggctctgtgggggaaaaagcaaaacaaaacaaaaaactatcttgacatcagtagcactgggttgaagcttaaatgggttaatatattcggaaggattttgtaaactgatacttaatatgtgtgtaagtatggagtctactgttatcattggtatttacttcatgattatttttaactctcacaataacctagaaaacgtccttaatgtgtcaaatgatatggccaaccacatgactcaactgatctccctggtcacaatgatagtcgcccattggtgtttgattcagttcgtatttttcttcaggtggaagtcacctccccataaaagccttctctgaatgctcagtaatgggctggatgcccttcctgtgattctatagcacccgagctgacccctattagagaacttatcacacagcattggaattggctattcaccagtttcattctcccactggaccataatgtttatgctcagagaccttatgttgttcactttttgaatttccagtaactggtgttgtgtatatcacataatggagactcaataaaaattatatacattattgacatcaattagtttcatgtatacaaagtacaaagcacagtatgtaaattttttaaatttatataaatttaaaaaccatatctagacatttatttgatttgcaatttgaaccaccattctggcttcatcatgaagaaaactttgaagtaggccgacagtgaaatgcagggagaccaattcaatggtgaatgcagaaaagatgctcattcaaacaagagtgggagtggaaatggagaagaaacagacctgagatatatacagaggtcaaataaacatgatttgataaataaattcatgggtgaggaagaatgagatgtcagaaatggctttagcatgcctgtaatcccagcattatgggaggcagaggctggtggatcacttgacgtcaggagttcgagaccagcctggccaacatagtgaaacaccgtctctactgaaaatacaaaaattagccagccatggtggcaggcacctgtagtcccagctacccatggtggggctgaggtgggagaatcgcttgaacccagaggcagagtttgcagtgagctgagattacaccactgcactctagcctgggcaacagagcaagactccttctcaaataaacaaataaataaatggctttaggatatatggtttatacagctaggaagatgatgaaagtattgactgggattgagaacagtggaagacgagatgattattgttaccattgctgttggaagggacaatgaaaggaagcaggcatagttcctagtgtcagttttacacatgtaattttgttgtgactttgaggaatccaagggaaaaaagagacataaatttggaagttttttgtgtataggtggcatattgaagccatggattgcctaggaagtgtttaggaattaaagaaagccagaatcaaacacggaggaattcaacacttaagaaccttctaaggcacagaaaaagaaaagtgaaatattgagaatgaaaggtatataacaatgggaaaggaaaaagtatgatgtataaaaaggaggggagtaagtacagatatctttttttattcaatatagttgtactgtttaagaataaaatagggcaaatgttgaagggtgatgtaaggttaagacagtgtgatggctaattttatgtgtcaacttgcctgggccatgggctccccagacattgggtcaaacattattttgggtgtgtctgtgagtgtttcttgatgaggtgaaaatttcagtcagttaaccgtgtaaagtagatggctctccctagtgagagtgggccccatccaatcagttcaagtcctgaatagaacagaagggtgacccacctgtgagtaagagggaatgtcttctgcctgccagcttttgatctgagacattgcttgtttttttgtttttcttttcttccttcagactttgaaacgtcagcttttgctgtgttttgatgctgccagcctttggactggaagtacgtttttggctctcctaaaccttcagcttgccaattgcacatcttgggacttgtcagctcccataatcacataaactaattccaattgcatacacacacacacacacacacacgtgtgcacatacaacacacagacagacatacacacacatacatcctactggttctgtttctctggagaacactgactaatacagaaaggagattttatattatatacatatatttatatacattatatatatataacatatatatattcagatagagaggacttaaatgtattcaatactgtttttaacattttaatgtatttaaatactgttaaaaataatcccattcattaggcttctgggtaatgtggtatgtaattaaaccagtgtatcctgtgatcatatgtccactgatgtacctcctttgataataagtatggccatcagttctatgtaatgttatccaagttctgtgtcagtggatcaaagacttggttacttcttggagagtgctgctagctgaagagatgtgggcaagaaagggaaacccacacctaagatatgctttgattctactcaaaagctattccttccaccttgattgattgattgagtagaatcaataatatcatattggtgaagggtagtgggtgatctcagtgtagcgctcagttgctggaaggttgagatttctacagaggtagtaggtagatcagcttttgttgaacgaggattcatgttttgggcaccatgcataacctccatctctgccagcgtggccacattgttaatgtgtcagtgtgcttatactacaatgtgctcatactacaatggctgatgaaagagactggttttagtttgccaagccattctgtgcactggtttgtttagtgcctcttgcttaccaaattgtagagtgtccataaacttgtatgtctattccccagatctccttgtccccagttgtattagttttctagggcttccataaaacagaataccgcagactggttggcttaaatgacagaaaattttctcataattctggaggctagaagttcaatatgaaggttgcgccagacttggtctcttgtgaggcctttcccccagcttgcagtcggcggccttactcctgtcttcacttgatcaccacactgcttgcacatgtttctggtgtctacttgtgtacccaaatttcgtcttcttataagagcaccaatgatgtatcacttagtgttgggcaatacatttaataaggtaatttgtagcaagtttcagaagtagaaagaacacaaaaaattatcaggaaaacttttttaaaaatctcatatctaaaccaggattttaacatgaatagaagctcttcaggtggacaggggtggcaagcggtcatttgaagcatagggaacagtgctgaatactgtcttgaagttactatgttgttgataaaaattaattatcaatttaaggtttaattacaaggttttatttcatgttaagtttaaatatttgtttttctggtcaataacacattaagaatagaaaattacaggcagagtctattcaagacagccactctaggataagggacaaatttttgtatcccagcctaataaaagagagaaatgagataaactctaaaaagaagatacagatactgatgatgatttgaaatagagggagttatgattgtaaaaaagaaaataagaatatcaggtgattacatggcttttacaattttaggctatttttccatctgtaaagtaaaattcatgttagattaaaaaatcacagcaaaactatacaagataaatgtatgttgacctatggtgtgtgaagcaaggttgtgaaataataagacaacttaccttctttttcagtaagtcgcctacgattatttatttagatttggtctagctttcaaagaaatggagagaaaaatataggttggcaaaggtcattctttttcataaagtgtaacttgaggaataacaactaacatatgtaaaactttcagtttaggaataattttctcatctattatttcttaagatttttattataattccttgagcagacataggatctgacatcattacccccagaaatgctaaataagtgtttaagatctaagcataagtatatggtagaaacttaaagaagtctgactctgactgcaaatgaagtagtctcgtcatcacaacatactgtcttaaagacaagcatgagtttattccagagacaaaatggaaaagttttgcttctaagaagcaaacttgaaacttgaggaaggaattggaaaatgacaaccatcaccacaacaatacagttcattataatttttttcttttgctatgttagttcataatgaaatgtgaaaataattagtgatacttcttatttgctcaatatgtgctagacatgttggtaagctttttatgtgtattatctcatttaatgttctcagtatttccatatagtagggaaaaatgatgcactgtataattgctaagaagtaatggcagtaaaaagaacacaaaattctgacttccaaaaacattcatcttaatgacaatccaagatgaaaaaaacataacttgtcaaatcctaaaatgaagatgtgctgtttgcttaagtaactatcattccgcctaagtttgtaaacctcaacaaaattcctgccttttttagtttttaattttgtgcaagaaggcataaagcagaaatgtaaaattgttacaatattaagaaaagaatgaagggagaagaaaaaaggaagagggacaaaagcgaggaaaagagggaaggaggaagaaacagaggaagagacagagggaggaagcaaggaagacaaaaaggaatctatagttccttctgttcacaatttgtatactacaataatatctataatttagacttgatatcagaaatgcaagctgagattaaaggaaatcttaggtcgacatatttaaaattgctgatatttcactacttttgtttaacaaaaatgtcaatttcctgaagttccaaataatataaatagaagtcataaaggtcaataccctttggtagtgacaactacaagcaactgaaatactttttatcaatctgatcatgaaatatgtaccttaggtttccctggactcttggtagtattttaacatggaatcttacttgatggccttcaatcactctgaggttatcaatctcaagttctaaaacttatattccttaccttgattatgtcaataagcataaatgctctataaacattctggaaatattattaaagagaaaaacagtaaaatatttgtcctcactaaatttttagtttgatatgaggatggcaagttcatgaagatagtgtaaaattgctgaaaacaataagaaatatgttattagattcttatttgaaatatatgtatgggtagctacgctaggttttcaatcctaatacatcaataatctaccaaagattaaatttaatggaaatatgaatttcagtgtatagagaatttcattaaacaatgaacttcattagaaataaagagaatagaggtggccccattcatgcctatccttaatggagctcctaacacaactcacggttactgcaagctccacctcccgggttcacaccattctcctgcctcagcctcccaagtagctgggactacaggcgccctccaccacgcccagctacttttttgtatttttagtagagacggggtttcaccgtgttagccaggatggtctcgatctcctgacctcgtgatccgcctgcctcggcctcccaaagtgcctggattacaggtgtgagccactgcacccagctgtaaattcttaaataaaataaataataaatttaacattgcatatgctaggaatagcatagaattttcatattattgtcttataaatattaagaaaagcttggaatggtggtataagttagtgtgttaaatattctaagctattgtagcccatgtaagcttagagtgacattatgttatattattaaatataaattataaaggaaaaatacatctgaaaaagcaactacataaatatacctaattagaagctgtatgtgtttatatgggtaaaaagcatagtgattgtatgtataactaaatagaacattgatctaaaatatttaataagatgcatgggttttggtcaagcaaagttgaaaaaaaggatgatttttatcacaatagtatatattatttcttaacaggtgtctttaaaggattgccatttaatgccattcaagatctactaagcatcatttttgcatgactactgcaaaaggattactttacagataccagttcctttgtcaagagcatactttggaccctgttttcagaaagcaggtatggttcatctttattaaactgcctataaaattgaaagacatgttgaaaaaaaatataagattcatgcatatccttaatggagctcctaatacaactgctgaatatgctaaagcttaatatgttattttctcaaattaagtgatttgtctttgaattgaaaacaccttgattgtgtcagtaacataaatgctctataaatattctgcaaatattattaaaagtgaaacacagtaaaatatttgttcttactaattttttagtttgatatgaggatggcaagtaactgaatgtggtataaaatggctgaaaacagtaagaaaaacagtactcagatatagcctcctgttccatgatatctttctcaaccgacatataatgtgctagtggatggcttttgtgctttttgtatgtgctcgaattttaagacaatgcttaaagttaaataagcaggaagtcatgggtggagagaggtagtgtcatccccaccagggaacggggatcttctgaaggcagacgacttttatgcagtttgcacaacagctccgcattcttacatatttacgtaaccaacagaaattactaaagagtgattcacttattttgagtgaaactgggcattgtgtaataataatcctttaaaatgaatactctaaaatactttgaaatacatcaatggacatttattatttacgactaagtggcaccagtagacgatcttgaattaaatccattgtgtgctatttaactacaatacttctgatgtactttttagataatcaaccaagaaggtcaatacactatgaatatagaatgattatctttattttctgcttatttataaaatgttgacaatagtgtacccaatttcaaggctgtcacttgtttatcctttaacttgttaggttaatccaggttaattgattcaaaataggagaggagtttcctcatcctactctatgctttcagtaccttcaagcttgaaaattagcattaaagaagagaagttactaaatgtggatgtgagagcagttcttttggaagatgtaggagtctgaagttttaccacgatatgtgattttactttctactagccacactcaaattctagcagctcgttgcagaaaatgttactttccatgtgtcttttattcatttcattaaatcatgccagtctgtcattttgattgcaggccctaactgtaccaggtatctctaaattaatcttgtgaagaaaagcaaccacataaaagaaaaaaatttaaagacaaagtataaagaagggaaggggaagtatctaacagtgaaacctcaaatcatgggaaaaaattgagttccatataaattaatccattgctatattctaacattagacagattgtaagccaaattttgccatcaaagttctatttgttacaataagaatgatttaagaataggttacatacacaaaataataataataatctgtattctgtctataaacgtaaacatcttggaagctgttatttcctatatataaacattttgttcttaactcataatcatggacgcaccttaacaaatcaaactctatatttttttttacttctgagatatctgtgactactagagataaattaaatctaagcaccttaattgaatttagtaatgttagaaacaagttgtttatgatgcttgtgacattcaaagaaagacaaccgaaccactgaacacagcacagcagctgtatgtaagagggtttcagatctaatgctcacttccagatggatgatggataagcaatttgaatttatgctagacacatcagcagatggaaatagaatagagtaaatgtcttggacacctgtgaactggtgcattctatcaattaccaaccaaattgtattaaattcatgtaattcaacagaagtctaattaattttttagaagaggctctttgtcaatctattaataaattcaggtttcaagttgaggatgtagagtgtatttaactgtacagagaacctgtggaatcaggtttggcagagcaaagtgcactcttattatgccatttttgttgttgctccttccaactaattgaaaagcatattggtagaataggaagcaattgaagcaaatgagacaaactgagcactccaaaaagacataagtgaattagaattgatgattctgacaagagtggattcacagtgtcattttaaataaaacgccatttcattcatatacttgcacctaatctgtcactgtaacaactgaaaacattcagcggcaaaactgacagtttcatcttgacacaaccaactcagttcctgccataataagaggcaatatatattaaaagcggtcctgagttcagcctttgagaatgaaatgtttcactcaataacttatacaactcatccaggagacactggctcagctccaagtggaagagctttatttcattagagaagagtctgaatggctctaggtttatagatttttagcattgccaggattctcatcaattcatgaagggaaacctctaagtatcaatgtatgcatctcttagagagtattacagttgataagaatagagtagaatgtgctctgaatttcaaaaataggaaatctaatgttcatctttaaagctcttgacaattacacagaaatttgaagagaaaaaatttctcatatcgtttgcgacataagtattgtgtaaattaacagtgctactacttgctaaaatgtttacagtgtggccagaattgacaaaataatgaaggaaggtggacggagacagttttgaatgaatactcgaaagaatttcttagcaattagagtgtccacagcaatctttcaagggtcatgtgtccagatgaatgaaaagcgtaatttcttatcatcaggaagggagatggaacagttccacacaaaattgttattcaacaacaaaatcctgattaattttgaggtggttcttatagacatctgtgttttactacttgcaaaaattggttatttattttaactacacatatagttttttgtgttttagaaaatattgttttccagtattttataggaaaatttgttatatgaagtataaaaatgcctagtaaggttggacatggtagttcacacctgtaatcccagccctttggaaggccgagatgggtggatcacctgaggtcgggagtttgagaccagcttgaccaacatggagaaaccccgtctctactaaaaatacaaaattagccaagcatgatggtgcatgtgtgtaatcccagctactcaggaggctgaggcaggagaattgcttgaacccaggaggcggaggttgcagtgagccaagatcacaccattgcactccagcctgggcaacaagaacaaaactccatctcaaaaaaaaaaaaaaaaaagaaaaaaaacaggaaaaagaaaaaaaaacctagtaaggtgaaactaaatagaatggcttaagtaaatacatgtataagttggtgtgaaacattgtaatctgaggctgcatgaatttcttggacagcatttatctctatctgccagttatggtggtgggacggggtggttcaagttggatatcgatggattattttcattatcagcctatccataggaaatatgttggtgcattaatattttccaagttgaagttcctaaggagatgtaagaaaactgaatttgcccaaagcaagaggaagaaaaataaggaatatattttagtgtgataatgtaacagatcatataggctttctagtacataaatttttgctagtgtgacacaaggcatccacaggttgaaaacatgcaaacactttcattaatatgaatgtatgcaaaatatctcctatatgatacttgctcagcaaatgttaacatttatttaatatttccgttgtggaaataactcatggaaacagaggaaatatttattttctggagtaagttttgagtataagaaaatttccatccacctctgctcacaaacaagaaatggaactcttagtctgaaggctcagtcacctgaacacctcaaggctgtcctacaacataagaagggctctatctcttcattagatgggtctgaaattcagttcatctctctgcgctaagcttagtatacagagtgaatcccagacagacaaattcttaactagatacagacttctgcttagaaactgtcacatatgctgagtgtattgaggcaattctaacaaatggaaagattataggctttgaaataagttaaaactaggattgactctgtgctgtaatatttgctgactgaagatacttggctgtatctcaatttttataaacctcaactttcatttgactaaaaaagtgaatactatctcatttttgtaagggtgcaaaaagttcacacaaaatcgatcttatctatatctgtacatatacaagcagtgacacacacacacacacacacacacacacacacacacacacacaatcccttatatttaaagcttggtatctgaaaagtgtttagcagatggttattattgtcatagaataagtagcatacatttttaaccaccgagtggactgaaacttactgaaagtctcgtaagacttaaaaaaaaaaggaaaagaagtacatcaggaaagaagggaagaaaggaagaaagaaggaaacaagaaaagaaaggaaggaagggagggaggggagggaggagggaggcaaggaggaagggaggaaggaaagggagaaggaagggaaggaaggaggaagaaaggagggagggaaggagagagacagagtaagggggaagagcgggaaggagagagggaaaggaagggaagaaaatatagatttggcctttgggcattaatatttgcattctcgggctcttgtgggatataagactaacaaagaaaaatgatacattcctatctatctgtcataaatgattagaaaatggaataaaaagagatctcatacataatggaaataatgattgcgtagtattgtgctggattttgggttagtacacagcaccctttcctaattcttgtgctctccagaatgttagaaggccagggactctgataactgtgtttctcaaaacacctgttagcaggattcatgatgaggtgccactcaatgggagatgtacaagagatagggaaaatgtaagagaagcagccacagtggcctcagatgcattttttagtatcatatgcctcagtgctggaagctgtgctaattgctggtagttatctagagttctgcaatgacccactctttgaaaactctcagtcattttaagatttagcagtggtctttcctgtcatttgtttcttcagcttttctaacagtttaaaacaagttgatatctaaatttctttttaattaaaatacctaaaaatttatttttatttttctgacctaaacttgataaaggagatgcctaaaaataaacatacacacacacatgtgcacacacacacattcagacacacacacacatacacacacaaacacaaatatatatatgcaaaagcctactgagatgcataaaaatggagagatatattgtgtttgtagacaggaagactcgattttcaagagtgttaagcttccctcaattggttttattttggtttaacttcaaaaagttaatttagcaaaattaagacagtgtgttttggggacagggtagagccttgcagtaacctttggaagatactagaaagctcagagaacattttctgcctctatgaaaacttgatatacaagtgatgtgataccgaagaccagtggagaaagaatggactatgctataaattgtgctagtaaaatatattactcatcaaaaattaaaataagatctctcagaatgccatacaataaataaattaaaataactatagatagatgtaggacttaaaaggcagaactttaaattttagaaagaagaaattggtaataatttaattacctcaacatgcagaaagatattttagacccacaaaaagcagttaacaaaatgacagaggtgactatagtggaaaataaatgaaaaagaaaacacaattgtgacaaaacaccttggtgcctagacttttaataactttcttttacctgtaaaataataataaaagaaaatatttagcaatcattacttttacatatctgcagtagatcaactttccaagtttgcagtttaacattttagtaaattgcaatgttgtatttaattttttaactcttcctatctctgcacattcagtgtctgactttctagctcttctcagcaaaggaataaaatatacctacttgattcttgactttgggtttagccatgtgacctgctttgaacaattgaattaacaaaaggaatagtataccagctgtgaggtcaggccttaagacacaatgcatatttccatgagccatgttgctcttttttcaccatcaagagaataatgaataaaaagagagacgtggaatagagtcatcccagatgaaacatcccagccaaacccagccacaatcagctgaccttcagccactcaagatgagttaatgataataaattactgttgttttaaaacataaagttttggggtgatttgttatatagcaatagctaactgatagaactattattcacaaaataatttatattccactaatttttgacaactcattatccccaaatatgcattttactttccttcactaatttctctgtttatattttaaccctatctggcatgccctatgctccaaattattccacttttcatgttaaaattaagatcaaatcctactatttccacaatgtctcagtctcatcttatatgaaataaaagaaacatgctgcataataactgatagtatcaatatttgttcttctgcttttattttctatacaataattttaaagcttggtattgtatcttataccaatctgtgccccgataatgtcttccacatagtgcattttaaactaatatttgaagaataaattacataagtaacagttgatatggctgatagtcacggttacaaagacagttttttttatcatatacatacgcctgttttatttacaaattatttctccagattgaagtttttctcttactctattatggtgtacaacaattaagggaaagagagagttaaaatgtaaataaggagaattggcaaccacgcctctacaaatgttaggtcatcttcaagtgatgatctattatcatcagtgacaagatgtcaaaattaggaagcagaaaacccctgcagctaatgtatggtaaattaactaattagtctattagtatccaagatcacactgtaaatggtttccaagtgtcagtatttaccttactaaattttaagaggcgatagccagaggttcaaatattggaatgttatttcatgaatgatataattcacttagcgcaaccgtatttctttttcctttgtaaataaagttaaaatatccatactttcatgcatcgtaatttagaagccgctacctatatatgctttttagtgataatttcatgtgtgaaaaagcataataaattgtccaaaaaacttcccgggtagcttttaaattgcacattgtggcacaagatcagtgtttagtcaaatctattctattaccatgattgcaaatgtcatttgtaaaaagttttatgcttttattttaatgctacatttggcaagctggtatgtttactattcaaacaattttttcttacctaattttcttctgatatgttgaaaatgggaaaaaaagaaacacatttttggatcacctgtgatttaggtgacttttggggctacacttacacatacaataaaacagataggtttcagggaaattagcttaaaaattgtagttgcttatacttataaattctcatgcattctttttgctttatagaatggggaaaatctgcaagacttagcatgaccaccacttcatagacttaatctacaaacaatatccatattttattgaatatttcctactatcgctatgcttcccaaatagattgattacttaaaataataaaacattttataattactttctgaaaataacttttaataatgtattaataatgtatttgatactaagctagcatgtggaatagaaaatatatttcaaatctctgagattttatttggggttaaaaggaaggtgaaaattttctgttgtgtctatatgtcactataggaaatcatattctaagatttcaatgatgcatggcagtggaaataacagagatgaatacaatagactttcccatagactgagttttccaggtcatttaactctctctagtgtcttcaaaactctccaacagagttaatgataacggattgtcatattattgtcctcatggtgacctgcttgggtagaagataaaaaatgctatactctcaaagctatgggtaaaaatatagtgattatcaactcatcaactttctctctctctctctcacacacacacacacacacacacacagtgcattgtatccttttattaaaaatataaattatcaagaatgaaatcaagagctgaaaattaaacaaaaaccaaaactaaaaaggccagcacatacacgccttgagtgataaaaatcctgtcctttgctcttaaaacatctcagactctcactcacaaatacacaggcatctttgaaagcaattcaaacaaattttattgtctggcttcacaattcatgacagggtaaaaatagaatgtgagaagatagatgggcctctagaaatacacacaggactattcaatgaattgagaattgacagccccatagtagcagctaaggaaactgtaagcatattaaataattctacttgcaaagaaactttgaaatagttcataaagtagccaacaggtgggaggatgtggtgatggatgtgatacttatcttaatttgatcattatacaatacacaggtgtattgaaataatagttacccataaatacgtataattatgatgtgtcattttaaaacaaaataaaactttacatacacacacagacacacatacacacatacagtattggactgagccacttcctaagcaatattagtatattgttaattaagtttgtactatccaataaagatagctactagccacatgtggctattgaatccttgtaatggggctagtttgaattaaggtgtgttgtgaaaataaagtacaacacaagtttccaagacacagtatgaaaaaaatgtaaaatattttattaataattatcatttcatgtagaaattataatattttagatatattgggttaacaaaatatattttttaaaataattcttttttcttaattgttactattattttctttttaataaaacatgaaatatagttctaatacacattgtttctgtattgcctgatttgagtaggagttatttgactttctggccctcaacctaactatcagcaaagccaaatagacatgcttgaaacaataatggacattcagtgtattcctcagcaatacttcctctggaagtcgtattcactggcaccagagctgtttcaaccactgcttctaggccaaattggaaaacctataataacagcaatagcaaatattcagcatttgtttgtgaagtgtcagaagctgttctatgattgattctcacagcaacttactagttcaagcttattaatatctctaggaatttaaagcagtgagatcaagaagtaactagttgagggagtttcaaacctctgcaatcttgttctaaagtctctgttttttagccacatctctcttctgccatacagaagtcttcaatcttttaatcctgcttatgaaaacataagttctctggagtcatgttacctatatggtgcccatgctaaaaattctagacattttttataataaaattgccagactgtttttggaagttgctttagtctggatttcctttaggcatacaatgaaaatagtttaacaggaggtgacctgaggaagcaagcagaagtgagagggtagggaaaacaagaccgagaatggagaaaagtcgagaaaggacataataatgagcaggtccacacatgcaagtatatggagcttcatcttgctccagcttcttgtatatcttccctctgaggtttcatacaaaacatacctcagaattctcacaatgatagatggaaagctggggtaaatatgtccctaattaggctcatgggtgagggttgactttagggctgttaacactcagattcctttcaagctgccctgtacttggttgaacaagcctccgtggtgctagagaaaatcttgaggcagagaagcaggatgagactcggaccctcgagatgagacaatgagtacaggaacagtcctctatgcctgcaggtggactgattcaccattgtggactggggcattaacagcatctgctactgaagtgtaattaaaatatagtcagattccctggaaacacagagaatcctacaagattctgtttgagccttcttcagcctaaccttattcttggataaaaaaaaaaactttttgtttttagattgctgatttagcctttaatttatcggaggggtatgtttgtacacagtagtaaattcaataaatgtcaactacattattttaactagtccctctaacactaggaaagttcagtcaaaaatatcaatcaaattagctattaggtatgaaattgtcaaattggttaagagaatgtttcacttttttgtgtgatgagcttatagcttggataaacaacctaagggtataatttgtgcactctgagttgcttgaatggcatggcctcaaacgggtatgccacgcaggaaataatctgttgtggaattccttaaataacatttattttactatttgtcttatatttctaatactattactgtgaaatagtaattctgtgtaattcacagtaatagtattactgtaaaatagaaatattattgtgaaataaaagtgactttttttctatttattccacaattttcttaatgtcttataaactagacaagaataagaaataggcctggtgcagtggctcatgcctataatcctagcattttgggaggctgaggtggtcagattacctgaggtcaggagtttcagaccagcctggtcatcatggtgagactccgtctctactaaaagtacgacaattagctgggcatggtgctgggtgcctgtaatcccagctgaggcaggagaatcgcttgaacccaggaggcagaggttgcagtgagcctagaccacgccattgcactccagcctgggtgacagagtgagactctgtctcaaaaaaaaagaaaaaaaaagaataagagctaaaatgtttactaaacagtagatatagaaagaagatcactatgacagcatgacaattcacaatagtaaaagggaaacatgcttggtgtacagatttttttttacaaatgaccatgttctaaagaaatttaacaagaattttgaagtcacataaggacacatacagagtatttcttcatgccttttgaagctagaaggggaatcagtgtatttcttaataatttttctctatatcttgtcagagaagggacagtccgttcaattttttcctaatattaaggtgtatgtgaaatgaagataagcataatcttagaagagacttttgaaaaacatgttgtagctgtggaatttaagttaatttataaatattacagttaaatagtgcagagaccagctcggtcggggagaccctaacccagcagcgctagaggaattaaagacacacacacagaaagatagaggtgtgaagtggaaatcagggatctcacagccttcagagctgagagcccggaacagacatttacccacgtatttattaacagcaaaccagtcattagcattgtttctatagatactaaattaactaaaagtatcccttaagggaaacgaagggataggccgaattaattgcagcaggaacacgcccttaagacacagattgctcatacgtttgtttgcggcttaagaatgactttaggtggttttctgccctggacggaccaggtgttccttgccctcattcccgtaaacccacaaccttccagcttgggtgttatggcgattatggacatgttacattgctgcagagattttatttatggccagtcttggggccagtttatggctggattttggggggcttgctcccaacaaaatagtaagttacatatttttccgggactatctattattttccacttgaggctattcaaagaaaaaaatgtataagaagtctttttttggaatattgaaagtataatgtcagtagttatttctatgttctataaaagtttaaaaaaatcaaagcagaataaatctgtactaaatgttgttttctttactattgaaatgactactatcacattaaaattggaaaaattattcaactataggatatttcagagtattatatgccatattacatgctttagtttaaattcataaacttatttgtaaaaattaaattgctgtaaaatagaaaattaatttttctatatatgtcttttggaagtggttccttccatttacattagcattataagtaggtgttaattttatactgttatgaacacaaagcatctttaaatatgcaacacaatgaaatatctgctatttcattcaataatatctactcatttaaaaatgtttgacttacttatctttccacccagcctggtcaaacagctctatacttgagtctcattctttttctttcataaaactgcttttattgaattgcattttggtctttgctatttatttttattgaggggcataataagattcagtaatactcaaatcacaagaatgagtagggcatggtgtccaccatgtctgacagggttccattagggggttggaacagaatgaggggtggagaatgtctcttttttcttacggcagagaacagttgttcgttttggggataactttttttgttgctgtttaattttattttgttgctatttttaacattcagtgagaaccagggtgtgtatttattttaatctccctgattctgtaaaataatgtcatttatagtatttcattctgctttggctgatgtgaggcttaaaatcaaattaaagccaaaatgggagccaagaaactgtactaggttttatgatgtcttccattttcttttcttattggtattttctctatttgtatatgctcatttattttatttgcttattttgtttatatttatgtaaattgtgtcaactttagttataaaatgtgttaaataaataatctaggaaaatcattataacatcttttttctaattttctaagagttttgttggtgcttaatcaattttatgtattttgttcattcacagatatatatatatatatatatatatatatctgtgatatatatgtgtgtgtttgtgtgtgtgtgtatatatatatatagtgtccattatgagtgaactagaaatatagccatgaatcattttattagtccttatccctatagataaatgctgaggggatggataccccatctctatgatgtgcctatttcacattgcatgcctatattacaacatcttatgtactccataaatgtatacacctactatgtacctacaaaaattaaaaatgaaaacattaaaataaaaaaactttatccttttgaaattcactttctagtatgaaaataaaggtattaaattaatgaataaattaaaatgcaaaatatttttaagtgatgaatgtcttggcagaaataaatctcagttaaagggatagagaatgttatggttgggtggttttttgctttcgtttttctgggagattctggaagacctttttgctaagccaatgtttgctctgaggcataaagaatgtaagggtgccagtcatgtggattttttggtgacagaagggacatcaggtgaaaatgtcctgaagtggccaggctcagtggctcacacctgtaatcccagcactttgggaggccgagacgggtggatcacgaagtcaggagatcgagaccatcctggctaacacagtgaaaccccgtctctactaaaaaaatacaaaaaaattagccgggtgtggtggcaggcgcctgtagtcccatctactagagaggctgaggtaggagaatggcgtgaacccaggaggcggagcttgcagtgagctgagattgcgccaccgcactccagcctgcgctacagagtgagactccgactcaaaaaagaaaaaaaaaaaaaatgccctgaagcaagaatgtatttgattggactagagaagagtgagtgagatggagagtgaaaaaagtgagataagagagctggtaggataaaaccaaaatcattttttagaaaaaaaaaatacatcagtgtgagatattgtgtggactttggttttcaccctccgtaagggtatatatagcaagctggtggagagttttgaattgagcaatgtcgtgatttaatttacattttaagcaattattgatggattagatatgacatgtaagaaaagggaaagcataaaggacgatcccagtattttgttccttaggaactagagggtgggagttccctagacaactagaaacaagattcttcttgttgagattgggcaagtgtcagagaaagcagtttgggatgggaagattaaggagatcatttccagacaggtgtggggtgcgtatttgatatactagcaaagatgtaaaatagttagcaggacatataaatttggagtataaggaagctgagttgtctggagatataaaattgaaagtctgcactggtgtgtctggcaatactccaaaagaagacaggaaaagtaaggattatagggaccaaaacatagattacagagatgtggataattaggggggaaaaaaaagcctgagaaggagcagctacagaaattgaaagaacaagtgaagaatggtgatgtagattataaagacttaaggaggaaatgaaaagccatgacaaaagctgctattggttagataagaagttaggagtgactttttatttgttttggtgttactgttacttgctaagagcttttgcaatggcgtagaagttatggttgaactgaaagcctggtctgagtgcctttgagatcaaacggtaggagaaaaagcaaagaaagcaagtacagatagatttttctctaaagcaacaattactaatagaaacaatcataaaaataattctataaaataatttaatgaaagtaattaattgcaaaagctatggtattacaattacataaatctacattaaacatattcatgaccacaaaatataattccattgattttcttagaaattatattttcaggctgctaactgtcaatattttgggtaaacttttctgcttgattctgctgcttctctaatctcccccattttgaactgcctggttaaacagtaattcattaaaggtcatactttgggtgaccgaaatacttgatatcttataaagcatttgctggcaaattttattattatgtttgcatctcataccttttgtaaattagataaaagcctaacaagagatgaaacaagaattcaataccatcttgtaactggaagagaggcttctctatgaaagtatgtttattctaatgaataatcatagcaaactgaaataatttaacttctaatatcacaataaataaaacattgaatatttatttaaaatagatgtaaatatgtattacaaacaaaatacaagtttccctaaatgaaatatttggaatttgttttcagactaaccacatgtgaatacaaatagtttacatatataatctcattttatattatttcaataatttcatagtatgcctttttgaagcattaaaacttagaggtagtctgcaagtatgaaattatatggaatttgtcatcaggaagcacgagtttgaatcccaattctagtaattcaaactgcatgatttggagcaaaccttcattttctcaggttcttcacctgtaaaattggaataatcagaatatttaccaaactggatcactgtggaattcagtggaatgtgctatggtcagtaagtcacatgtcttgtactctttgtggaaggggaagtatgttatctacaaacaacaaaaagaggaaaagaaaagaaaaaggacaaacttaaagcttatatttaaccttacaagaacgttttttacttgaaggtcattaatcagtctctgttaagttattgaggagacaaaattccagtgatagaaaccttcatgaacaggccttgagtccagtttcttgaatttgcaattcaagaaaaattaaatgacaaaccacggctgaagaaaagtactgtgagagaacaaaaatagtaaagaaaacactgatgtaattagcatccaaggaggaatcactacaataatccagatttgaattctaataataaaagttatgatttaaacttgattcaagagcatcttggcctgcttaataaaataataagctatctaacatatctagtaataaatcagtgtttatttgtcatgctgatcttttccatatttaaaaatagtgttagtctcagaaagatatggaaaaaatagtcttaaatatcagaagcaaacattttacttgctatttgtaaataagattttacagactttaaaatattttaaaatttacaatctagtgtgtgtaatttgactcattgccacaaactatttctcataacttgattcagagacaactgtgtgaggagagggatatatatgggaaacctgaatcaatgctacaatgataaacgccaaggcttttacctataacataaaacaaagtaggacaatcattttaaaaattatttatttttttataaaatttgaaatggtgtcattttattatttaagaagcaggcaaacaggcgtagtgactcatgcccgtaatcccaacactttgggaggccgaggttggtggatcacttgagtccaggagttcaaaatcagccagggcaacatggcgaaaccccgttatctcaaaaaaaaaaaaaaaaaaaaaaaaaaaaaaagcagggcgtggtgacacgtgcctgtgatcccagctaagcagctaaggtgggcaggatcccaggagatggaggttgtggtgatagtaccactgcactccagcttgggcaacagagggaaagcttatctgaaaaaagaaagaaagaaagaaagaaagcagatggatattagtgcccaaattcaagtgttattatactgtttatttttaggactataaaaaaatctttggatacaattaattagaaccagacaaacttaaggtgttgttctagctgagatattagtaatattactgagtctgtgtagaaaataacttcaatgatggtcatttgtcatcagattaaaaaaaactgagatatacaaaacaaaaaacaaaacaaaacaaaacaaaagacaaaattttgtaaagtggaaagggagcattagattgctatcattcaatagttgtgaagcttggatccagaatagaggatgctgcagtgtcattgtgctcttttcttgtcaggcctcatctggaagagaggcaatagcaagctgcaggtggctggaaagagaggagggatgacgaatctttatcacctgggaaatgatgaaagaaattgaggatgtgtactctggaaagcagtagatttagacagacacaatatgtatgttctcagatgtttaaaagtactgtcatgtggaagatggattagaataggtatgtgttgctccaaagaatagcctgtggaccaagactagctgtcagaaaggtatttcagctcagcatgataaaaaggtttctgactctgaattacatagtgttagtgagtgcttcattataagacgtatcctgttctgaaaaagtagactaggtatgatatccaaggtcacttctgacactaagaaatctttgatttttgtgaattaaagtatattttaaatgtccattctcagttttagtaaaaagccctgtgcatagttttaagataatctgaaaaatttatattattgtgttatacgtcgatctctgtatctataccttctaatatgtatctatcttttaaattctgcttaaagcaagctgctttaaaatttttcaaggagcatttttgaaaaacttatattcttaaaatgaaaaactcataatgaccagtcattcatttaaaacatttgaccacatttcgacctacaaaaacagcagtttcatataaatcaatcagatactatgggtcaaataatgtgttagaggtgacaatgaaacagggcaagtaaatgtgtaattacatagagtgtgctaagtgaaacaaaaaaaaatttacagacgcttgtgaaagcctcatttacattcataaaatgtcatttcaagaaaatccaacatttgaaaatgataaacctaaaaaatacaatgtgactatttataaaatagccttctcatatagagataatacctgataaatttaattgccaaacttacgggaagacaattgttttgtgactaagcacacccagccccacatctcctcaacttcaaagtgcgtaagttttcggtagaaagtctatggcacgaggaagctttcccagttagtgctaagagctttataaggtaggattttgtccaccgatagatcgataacttgctgataagtaaaattaaggatctgtattttcaaaaaccttttaccagacatattttggaggaattacctttctcattgtttacctcaatccttagttaactgaaaagaataggaaaaaaattgatcctcactttctttcaggttttgattaaagctgtcaaaagagattcactcagaaaactcttgttactaatcacacattgtttcattttttaaaaatcctgatctgacagggtcttcatactaacgtttatctattatgttaaaaataacaatttttattacattaagatatccatcttttgaaaaatagatataaaattttttagttcaccacttttctgaaaaagaaagtgaagataaatacatctaatgtagcaaagcagatcatataaataagagcaaaataagtaaatagaatggctatagggtaatagaaaaatttaaatcaaatgtcatcagtgaagctcgtgatctctgctccgaaaagcatcaaaatgagcagcacactgcttggtgatctgcacagacaaggggtgaaatgactgactttggagacccagctaagggagcattcaaaaataagaaaagtatgtttaaagaagaaatgttacaatgagctgtaaggccccttaaaatctagttaattgcttgttctccaagaccatagtatattttaagtcactacccttacaagattagacatttctggacctcttattgggtagacaaaagaaaagttggaaatgtgtagctttctgcatctgaagggcctgtgatggaacagaaaacataatggacatagtcaagacccctggacgtggaacctttttctcaggccaatatttgaattactcccacttgtactgattccaagtgttaaattactcaaaagggaaatttaggactcctgtaaagcaagcatataagccatatgaatacatatatatggaagtatttcatatttaaaataaaacatacactcaggaatactatgaaaacataatatgggaataatattgctcatatattagcgctcagtattgtttttctaatgaattatacactgttgttgagggggatataatctttttagtgacgtaaactgaatctaatgacttattaggattatgtggtttactcagtcctttcctttcaactatcccattcctatcttcacctttgtacacaggcatcttaaaggcaacttaaaataaatatatccaaaccaaaacttatgccctcatccctgtggtggattgaaacatttttctcaattcttaaccttgaagcacccaatgaggaaggcgttatcactcaaattttacaaaaaaggaatatgaggttaaaagaagcaacatgtaccatgtcatataacaataatagctcaagatcaagatttgatccgatgtctaaagagcgttaatacctgtgttttccatctgagaagatatgttaagaatgatatgcttggaaaagactttcagtcttagttctattaaaatgtagattatatatatttgttgctatgcatatgtaaattattacttaattttcctcagaataactgtaaaatatgcctttcattttgtatactttctcctggcccctttgaaatagaattattaaaaattgattgtatttttcccaaaggtaagagtaagtagaaaacctcaagtatttcaatcaaaaatttcaaaacaaatcaaaagatacatgagagattaattacatacattaatgcatatttcataatattgaaggaacaaaataaagatgaaaaatagttagcccacattcacaccatgctaacataatactttttaaagcttgtgttttctttcagtttttgtccataggcgtaaattcctatcattattatagcacagatctaattctatatttgactttttcactccacattatgtcatattgtgtgaatactgcctctaaatattgacttccaatataaagtatatagaaagtcagtagaggtgctgagaggcaagcaataattctgcttaattgatgatgatcaacaatcgattgattatcaacaaagaattgaattaattttgaaaatgtaatgcaaaaattgtgaactaatgtattttcaaaagtgtctatatggtattgcaaacacctgcctttcttctctcatctccaccaatactcagcctgttttgtgtccagaaggccttgatctcctcaggcctggtggcccttgtgacagggattatgattacttcgccatccctggagagagaagcctaccgaggtctccactactgtggtggaggaggtgtcagctctcccacaaggtgtaccctgctggcaatagtcacagctccagtaaggagttgaacctcaccagagcagggtgcacttgtgactaagaaatagctgatatggactgaatgtttgcatttctccaaaattcttatgttaacgcccttattcccagtggtattatatttagagatgtgacctctgggaggtaaggtaggttagaataggtcataagtatgaggccctcatgatgagattaatgcccttatgaaaagaggaagagacacaagctcgctctctcctgtgtgaggacacagcaagaaggcagccatccacaaatcagaaaggaaaccgttaccagatactgaagctgctacacctttatcttggacttcccagcctctggaactgtaagaaataactatttgttatagaagctacccaccctatgatattttgttatagcagcccagactgacaaagacactagctaaatgtcattgactgatatgagacactatgttgttttgtatgcaaaatctcatttattcattgtatcagatctgagaggcagagagttttcatgttcttccagagtttttacatctttggcttaatatccctgattccttcaagtagtccttgtgtcccagagtttcaagttcaatcacaatcctggttattctctaggccatgtctttatgctactgaaatagtcctgtcacgtggatagttgtggattctaggaaaatctctgccttttgtgtttctatactagcacaaaaagattattattatcaaagggtaaaacaatgacacagggcgtgggaagtgttataaaacttccaaacaaagaaaataaaggattttatgaatctcaatgtttagcttctccactcactagaaacaaaagtaattaatataataacacataaactatatagagaaaaacataggctcaaataacataatagctatattaaaatttctttgttttcttatatctaataagagaaagcacatatcatatcacttttcttaggctgttaggcagttcagtcccacttttcatgagtctgacctgatttcaatttattttgcactttaattaatggaaaaataagaagggaggttaagaatatgtgtaacaagggtgcacagtgtgtttagtatgcgttatttgcatttttttggtaactaaatgacaattctaccatgatattagccccgatatttttcgttctgaggtgggtaggagttgtttctgtcagcagaactcctgctaaatgattcactgtcatttctccccaatataatgtgctattaataattttctttactaaaaaggcactactctgctattgaaaataagttttgtatattactttaaaaatacgatcaaggtgtaaagtttgttgtaggcaaaaatattctgcttcagtttttgaacaaatgcatttgaacagctgaatttgtttctttatatggttgaattatcattaataaataatgttatttatttaatgaaaataattcattagattactaacaaattaaatttaaataattgcacaaaagatcactgctactagcctatcttcttagcggatcacgaggtcaggagatcgagaccatcctggctaacatggtgaaaccgcatctctactaaaaatacaaaaaattagccaggcgtggtggcaggcgcctgtagttccagctacttgggaggctgaggcaggagaatggcgtgaacccaggaggcggagcttgcagtgagccaagattgtgccacttcaccccagcctgggcgacagagcgagactccgtcccccccaaaaaaatacactagaacagtcttctgaagtaattcaagtatgactggttgaaactttaaggcctagaacatattgataactcttctactaccatgtagttatgatatttttgattatattgaaataagtctgctgaggttaagttcggtaatctggatttaaggaaggttttatatctaagcctgccaactgcaaatggagaaactccaacctacagactgccttcggatatttttttaactccttagtttaatcacttcttctggatagatggcatggtcccaagatccttcagatccatctaccaccagttagacatggtctactttggttcagataatcttaagtttcttaattttccagttgacagtgtgtatgtgtgtgtattatatatcacatatattataatacatgtaagatctgtggttttaaatcattacttttagctttggaagactccttggtgtgcacagcactaatataaaactctcccctgcaatgtcacccagtggtgcctaagtgctccatgtgttcaatcattgatacgtgcattccacaaatacatactgagcactctgtgccaaaggttcactatagcaggttcagtatagccaaataatgaaacaagcaacaaagatccctacggtcacaaagcttttattctagtgggtgatttcaaccaacacacaaaatgagtaaataaattacatggttattagatggtggtaagtgctatagagaaacgtgaacaagaatgcagtgatctgggtatgagatgacaatcagaaacaccatctgaaaagctaatattagtctatggccagaccaccctgaatgtgcccgatcgtgtctgaaagggcaatattacagtcacaagctgaacaaggggaagctttcctggtggaatttaacatatgcttatgagaaacccaaatttttcaatactcctccatagtcatgctataaatttttttcctggccgtctgccagaaaatatctggcagagatatagatagattggccactcttctccccactacccttaagtgaactgctgttcagctccatggcatttatgacagatttttttcccctggttttggtccagtttcttggcaagctgaatttaatctgacttagtccttacgttcccattgccaaggtacacacaacatgtttgggcatatggtcttgtttttatgatcttttaacctttatttattataaatacaccatggtgtaatggatcatttgggggaattgaacacttggaatgacagcaggtccggttgaggccatctggagatgttagaagggagaagtttgcttccttgtgaactaaacttttaaagggagttaaataaaattaactggaaaacttgtgataaactcatttaagaacaggatatggtggcatgtaacatagatgagtgggttgaaggatggataagaatgtgataaaacaaggatacatctctattctggaaactaatattctagaataagccatcagtttcctaccactgatctctctgattttagaaagaagatattctaatgtgtgcaaaaatgttgtcattttcttttcattttagacgtggacatagtgttctcacagcctacctatatacataattagaatgaaggtgatagaaggttgaaaaaaataaatgtggaagaatatttttttcaagttatattgccaactaaagtcccttttaatgtttactttgtgtgttttgatggtgagctgtctcctagttataattaggagttttatttttaacactaaaacacctttaactacaatgtattttagcctaggtgactgatgtactttcccttccctagtatttttttcaccttttaataattgctatgtatatgaaaagtaagcaaattaacaacggaatgcctaaaatacaccacctgaatgcctaaaatttttttaaagaatgaaaacaccaaatcctggcaaagattttagatgttggaactcacattcattgttgtggagactataaaatggtctaaccactttagaaaaactttgtgcgtttacttataaatgtaaatatagatatgcactgtgaaccagcaatttcactcctaggtatttacccaagaattataaaacatatgttcacaaaaatatgtgtacgagaataaccaaagaaagtttattcataattacctaaaactaggaagagtcctgctgtctgttaaaggtgaatggataaacaaattgtgatatacacaaaagaatactactaagcggtaagaaggaacaaactactgatcatgtaacagtatgagtgatctcagaaacactgtgctgcatgaaggaaacctcagttaaaagagtacatacagtgtgattctatgtctatttagttcttgaacagaaaaatgtcatgtatgataaaaagaaaacaatcagaatagtggcaatctctgaggatttcggtaggggatgattgagaagatgtgtatgataattttctgtagtgggaactaaagtgctttgaaaatcccagcagaaatggattttactagcattttactttgaaatatgcaatatttattaagttagttcctaaaaccaagcagaaagaattccattttatgagagcaaatggacccagggaggggatcatcacacaccaaggcctgtgggggtgggggcctaggggagggataacattaagtgaaatacctaatgtaggtgacgggttgatgggtgcagcaaaccaccatggcacatgtatacctaggtaacaaaactgcatgttctacacatgtaacccagaacttaaagtataataataaaaaaaggtccatttaactccctgttatactagtaattattgaactctattgtgtactgatatagaggaagccaagtactatcctaaatattttgcctacattgctacacttaccactcccaataccgtgaggtgagaattattggccctgttttgtagatacagacactaatgcttacagagtctgaacaactttccctgccaagcttgtgcaggctctgtgggatggaactgctgtttaaattcaggcttgcctaactcagaagtaatagttgttgtggtatacaaattcctccttctatgcttacattttatgttcctttcattttaaaatccttcctctttcatctaatttatagtgtttaattataacatatataaaatacctaagcattagtattttcagaaataaatgatggtataaacgattaaaaacacaaacataagattcctaatttggtcccaatctacctatacagtatttctcttcatgatagatttcccaaattgattggaatatttaaggttctccagtgaactactatataaatcaaatttgaaaatatggagttcaatgttactgaggctgtcatctgagtaggaaatgccaaaagattacaaccatcttttttgttctcctgccaagtagactaggcatctgccaaggaacctcagatctccaatgaagcatagttgagtttgaaaacacagagttaaatacccactgtggctggaacctgattagaacgtaccaaagggttataagattttttattcttctgccaaatcaactttgctcctgcccaggaaattgaaatataaagcagatgacattgacaagacaaatgccattaatagaaagaggtatgtaccatgcatgtacaacacagattaagacagtaaatgcccagcattgaatgaaactagaaagtttcgaattcttcaaagtgtcagatttgtacatgatagctgtgtgaatatccaggaatatgaatagacctgagtgatttgtggaggagcctgttgttgttcccacaaagactgctttctaaaaacctgtggagtgacctcacagcattaaaaaggcagtctgcaactaaatgttatctatttaggatgcctattagagccaaggtattttattctgtaaattggctgtctcattcatagacaggtattttgagagtattaatgcagttgaaatggtttttatggttcctttccttccccatcatatatttatttttctgacttggctcttataatttacataatagcaaacataacttgtgtaggaagacagaaatttaatcatgatgagtcaaacataccaaaattttcttttcttttttttctataactgatctcatgttgtttggagcccctattcctaaagttgaaacaataaaaacaataagaaaattaaacttgccaagtaaaacccagtcttccttactttccacaatttctgtgtagatagatattcagttagctcacagaactccctagcaggcattatcttcccagccaagaggtatcatctttcattattcctttccaagattgtctgggacaaggtgggagcttatataaccttgtgttgaaaagggaagaggaaggctctggcctacgtgctgtccttggggtcaagggccttgtcgcacttgtcaacatcacttctagtcttagttgccaagtgtcaacacctggcacaaccctgagtgtgttttcctgactgtcaatgcatagagatggctgtctgcctcactgaccaggcaagccagctcaggctctcccttataccacagatcctttgagagccgggcggtgaatctcttgtcgttcctttcttctgtgccatcattagccacctgccacttgcccctgccacttgcccccatagctccagtaaacttaaggatttcctataagccctttcagacagggaaatagaaagacactatacaaggcccaatctagctatttctctccagcagtactattgctattttcaagttactcaataatatgaggaaaaggcacaaaggcatcttacctgccttgaccgcctataaatcccacgtttttataaagtattggtttctcattcaaactgatgtaagtgtacttcatttacatttatgttccaaaaattattagtagactacaaaattttttcaaaatagaatgacacagggaattctgggtgcttgagtcttgatccagttgagtgtatgcttgtccaaactagtatttgggaaagtaagagcggggaatggtaattttgtcctggcctatccatatgtttcactgtaccctgcatttacattgtatttgataattttgagactgatggagtgcaaacaatccagttgctactatctccagcatatatctagaaaagattgaatcatggtcagatttaactttgcatatgtatggctaagtcaaaagaggagggcctccttcacacaggcttaccatctataactcagttccactaatgaggatagccaggactaccaagacatttgcagatctgttgcctaagaatgaggttaatttctctgctgtgcatcctgattgtcctgacttttttcttttgcctttaaataaaccttgtttgattacccacatcatagctgtgtttgcactcaccatcattttgaatatattattgacatttgtccatacagtggtgttcttgtttataagtaactgctccaaagaaaaaaacgtttaccccacgtgaaggctgttcctcagttgcttggttgatttagggatatgtgtagtttggccagattggcatgatgatattttgtcaatccagtagatggtctaaattcatatgctatataattcatagcatttttagcaatcttagcgcatcctaagacatcaatcaaaaggaattaacgtgatacctcccttaactacaggtttcttaagaataattaatcataattggctttctctcactccacaattatgtattttcaatatagtaaatgctcatttagtataacatgaatgctacattatgctacatgaacccacataagcatgaccagataaatcacatgctatttaaagtatattaatacacctgtgaaatatagtgatatgctgccaatcatcatttgaccttagaataggggttgggcatgttttcagtgtagttggtcatcaattaagagttcccgggaccttgtttagatccagataagcctaaaattttttgaagaagttctttaagtccagctgaaactggagattgctataaggattttaacacattttatagatttatgaaagacaacactagtcagttgaaatgcggataatttttctatgatgttgtaactggaaataataaaaagcaaaggggagacatcagcgacccctctttttctcataccccgtaatcagtgctaagtgaattttaccagcataacctctaacatattccacattatggtggctgttcaccctctgcactatactccaaaccccatgatctctctcctgaaaaatcaccacctaactggcctccctacttccaccattgcctccctggtctagtcatcttgaagcagcaaaagtgattctttgaaaatacaaatctgagtataacagttccatgtttaaaaccctgccatagctgtacatcacacaaagtaacaagcaattcttatcatggcccagagaaaattcacaatctacagtttctggcgctctttccatcctttagccctacccctctctcctaaatactatggacagacaggcccccttgcagttccttaaatacacttatctcagggcccacaaaactgctgttatctctgtctggaaagaccttaatcactggtaattttgtggcttgctcccttattttatttaaatccgttttgaaatttcacctcctcagatcagactttcctactgtgttatcttaactagcacactttctactttccattgattgtaacatgtttcgtttttcttcccttgcacatatcaatgcatgtattatttgtctgtttactggatgccttgcctgatactacaaatgcttcataaagtcagtaattcttttttgtttcaatagcatattgttagcctatagaacatatgtcctcgaatactaaacaatgagtaaatatatattgaaataaatcattaattaaagcataataaaatggaccctgtgctctaagaaatctctctgggaccagtttcacatgagaccccaaaacaaggataactttaatccataagacccctcagtgcaagtagaattggattttgagccatagtgccctgaatttggaaaggttagagctgcagagtctttctctttgacacacaccacagggcgttctgtggatgatggtggtggaggggtggtgctgtcatctagaaaaagtagagtgtttttgtgctcatgcttgtgataaacattaccaaaattttgaaaagtggttttcttcaatgacttagtatcttaatcaggttttagctcccaggtacctaagtctcctatgttatgggtgacccaagtcctttttagacagcctataatatcggccttaactagtttattgtcctcatggtcacaaatgcatctgtcatggtttttttttgttttttttttttttgttttttttgagacggaatctcgctctttcgcccaggccggagtgcagtggcgctatctcggctcactgcaagctccgccacttgggttcatgccattcttctgcctcagcctcccaagtagctgggactacatgtggccaccaccacacccagctaattttttgtatttttagtagagacggggtttcaccatgttagccaggatggtctcaatctcctgacctcgtgatctacctgcctcagcctcccaaagtgctgggattacaggtgtgagccaccgcgcccggcctctgtcatgttttatataattccaatacggacattttttacactatatataatgccttaaccacccccccccaaccaagttttagtgtggcttgtggggtttctcaagttagaaacaattttaaacaagtacacttctagatctctacaaatcatatgtgaccatgtatcaaactaatcataagagtcactctttattgagcatttactatgtgattgacactcagcatttaaccaggcaggaggaaaagcataatttctgcttcacaggtaagaaagttggcatggaaaggcttatttatacagtatgtacaggattgctcagtcaatcttattagtccacactcatatatttacatacttttcagcagcatctttcatgtataaccctcctcaacatcatcaacaaacacttttgaacacctacgttgtgcagtgcaatgacttcgtttttcaaacacttaactggaagaagtctgtccattattctgtcaaccctcttagagtatatttacctttaataacaattccagaatgattaagagtcaataaatataattctgctttttaatgtataataaaacaaaatcacatttgatgaatgttcctaggaatacgaaaaagaaaatagaattatatttagtcaggcatattaatagaattattattaaagtcaatgggatttctaatttggcagggtttgattcaggaaataattaggttctgtatttggaattaaactgggcttctatttttaaagattatcttaccttaacaattggaagaataaagatctttacttaaatcagtgaaaaacatgtgtatataacaccaagtgtcatgattgtcaagtatagaaaaaggaaactaacaataattaagcaaccatttcatgctaagctcttaatttatttttctttagtataatgttatgcaatttaataacccagtaaggtacattttaatacttttattgataggtggcaaataaagagcctaaggaatttgatcagggatgcttcgctggtcaaggatggcagtggcgtttgaactcacagatatgcgcttttaaattctctcatattactaacaccttgttgcttcttaaaccttatttgcctctttttaaaattctcagacttcaatattcccctagtattcaatatagccaccagcgtatacctgagatccaatagttattagcaactgaaatagcaaaagggtgagttattcgcttagagattttcttcataactgaaattaaataacaatattatatacttgaaattacataacaatattatatacttgaaattacagaactcctttgcaagcttgaaaacacacacacgctcctccccacccccaccacacacacactctaaggtttattttcgacaaaataactaacacagcattgataatgataacagagagaagaataatcctctatggaatattaaaactcagaaatggctctatagcatatgcaaaataagataataaaatttcatcacagtgagttttggctcacttgtagaaatcagatgagatcatgtgaaaatggacaagtgttataataaatttaagttaacactgctattcttacctgagagtagagaacatttacaaattaggtatagaaaattaggttatttcacttccgctcctgcccccacctctcatctgttatttatatctatatgtgtccaatattaagactctactagtgtctcctttgaaacactttcaacctgtagtcccagctactccggaggccgaggcaggagaactgcatgaaccctggaggcggaggttgcagtaagccgaggtcgcgccactgcactccagcctgggcgagagagggagactctgtctcaaaaataataataataataaaataaataaataaaataaaattcatcataagaatgaaattgaataataaaataaccttcacatcaaatgctctaccttttcactagacagagtctcgctctgtcgcccaggctggagtgcagtggcgcgatctcggctcactgcaagctccgcctcccaggttcacgccattctcctgcctcagcctcccaagtagctgggactacaggcgcccgccaccacgccctgctgattttttttttttttttttttagtagagatggggtttcaccgtgttagccaggatgatctcaatctcctgacctcgtgatccgccagcctcggcctcccaaagtgctgggatagcagccgggcgcggtggccgaaaccctgtctctactacaaaaaattagccaggcgtggtgatgtgcacctgcagtcccagttaccagggagcctgaggcaggggaatctcttgaacctgggaggcggaggttgcagccagccaagatcgcgccactgcactccagcctggcgacagagcaagactccatctcaaaaacaaaataaaaataaaaataaattgtcattcttaatttactatgagtttcaggccaacattaacatgagacaccaataaacttaaaggacactgaaaatcagaaggcaaatattatttcaaaattaaatttaaaaaattcaggtgacaggacatacatttatttttaccaagtgctagattatatatggctacatagaacttcagacattcagtttactaatattacctgtcaacattgattatttgtgttattagaaaattagattacacctaggaaactcaaacccctcagaattatgtatgcaatgattgaaaatatttcttccactttataggaaaaaaaagtaaagcaaaattaaacaaaaacaaattggtctgtttattcatttaaaaagtagaaataagttctaagtggaaaattttgttttatatttcagtgttacatttcttgttgaacattttcattttatttgtagtttcatcacacaattcttcaattacccctaaaatgcagttgtaaagtgaaaagttatattgtattctctacatttaaaacttttcaaaatgtcaaaatttagattttagagccaattcaattgcagtcattttcattgaaataaacaaatattgattacacaatatttcccattcataaactttttaaaactgtaaacggcagtacaaccaactctatatgtccttataaccttctatggtggaatgggtgaaaaaagcataagcttccctcaaaccctttttctaaaggcactactcccattcatgagggcagagtcctcatgaccgaatcacctctcagagaccccacctcctaatactatcacctgagggttaggtttcaatatattaattttagggggacacaaacattcagaccatagaattccatccttggctctacaaaatgtatgttcttcttgtatgcaaaatatgtttattccaccctgttagctcccgaagtcttaccttgttccttatttatatatgtaaattaccttattatatatgaaaaaatatattatatatgaataaatatatttatttatataaatatatttattccaccctgttagctccacaagtctacagtccaaattctcatctgaatatcagctaaatcagatatgcatgagtctcaagatatgatttattttgaggcaaattgccttacagctgtgagcctctgaaatcgagcaagttacgtgcttctgaaatgcagtagtacgacaagcatacaacagacattctattccaaaaggaggaaatcagaaggaagaaaggggtaactgaaaccaagtatatatgaaaaaaacttaaaggcagaatgaacaacttggattaaaaatcaaagtacatgaggggatggattcctcatttgccctgatgtgattattatgccttgtatgcctgtgtcaaaatatctcatataccccataaatacatatacccactacatactcataaaaattaaaaatttaaaaaatagacaattaaaaagaaaacctacagggcaaacaacattaaaccgtaagacttgagaataatcttctttggttccatggcccaccttccagacacagtggggcaagagttggacccctgaaggttccagccagccttgccactttggctttgctggaggcagttcatgtagcagctctgacacattaaagtcacatgtctgtagcgctcctgggctaaaatttcatactgcatattagcttctctaatgttctggggtctcaggagcagttctccctcttgaagctccttaggggattgctctagtgggtctgtctgtagcagcccccaaacctgtgggagttctctgttcggctccatggctctccagtgagtcctttgaaatataggtggaggcagccatttcttataattcatatactctctgcaccagtggagatggcaccacacatacattaccaaggtttacctctggcagccctggtgaggtagacactggcctggagtgcaccttggcccaatggagtcatacttgagttttgcctttcgtcatagttttgttccccaggccttggcattctggtcctgggaagggagtggcagctccgatgctctccaaaatgctattgtggtccctcttctattgtcctgattagtagcatcaggcttccacacaagcatactaatctttttatcaaaaggttgcttggccacacccttggtgttctctcctgaacatgcttttattcttcacaatatagccaggttgagaatatttcagatctctaagttctaattcttttttgattacaaattttatcaattcatttctcttctttctcattttacgataagcagtcaagagaagacatgccccatcttcaacattttgcttagattttttttggccaaatatcctaatttatcactcaagaatttctgctttccataaagcagtaggatacaaacacaattccaccaagttctttgccacttcataaaaaggatcacctttcctccagtttccaataatatgttccttatttttatctgagacctcatcaaaatggcctttaccatccatatttctatcaacgtcctattcacgacctcttagaaaagctttaagaagactgaggttttctctatagctcttcttttcttctgtaccctcaccagaagcacctttaatgctccattcactttaaaattcgtccagcctctatccaatacccagtttaacacattttgttatagcaaccaaaatggactaagatgccccttaaagagcttttgtgtccattagacaagagttagacacctaacatagtatctgggactaatattgtatttaataaataattgaacctgtgatttgatcatatcagggatttgcaaatctcattttgtatgtgtgtggtaaaatatatttaacataaaatgtatcattttagccattttaattatgcaattgagttgcattagtttgctcataatgttgtgtatctatctccacatcttttcagactttttcatcattccaaacagaaaccgtgtccattaaacaatgacttcccaatttctttttcccccaacattttgtaccctctattttactttttgtctctgaatttaccttctaggttcctcatataagtggaatcatacacacactagcttttcttttgtgactgcttatttcacttagtgtaatgtctttaaagatcatccgtgtcatggcatgcatcagaattctattcctattaaaggctgaataatattccattgtatgtatataccacattttgttttttcattcatccaatgaaggacatttgtcttgtatcaacctttttgcctattatgaataacactgctgtgtccatcgtcatacaagcatctgtttgtgcttctgcttttaatgaattgctggataatatgattattttatagttaattttggggggaacttccaaactgtttcccatagtggctgtgcctctgtaacattttgtattcccactatcaactcacaagtgttctaatttctattcctaataacacatgttatattctattttattttatattattttttaataatagccaagcttatgggtataaagtgggatctcactgtggttttgatttgctgtcccttagtgactaaagatgctgagcagcttttcatatgctgctgattatttacatatactctctgaagaaatgtctgttcaagtcctttgcccattctttaattgggttgtttattttgttattgttgagttataggttctttatatattctagataaaaattccttatgagatacataattgacaaatattttctccaattctctgggttgtttttcactttcttaatggtatcctttgatgcacagaagtttttaattttgataaaaaacaatttatctattttttttagttgtctatgctttgggtatcatatctgaaaaataattgacaaacccaaggttatgaagatagctttatatgttttcttctaagagttttatagttttagctttttttttcttaagcatccttttggtgaaaaaatgttttagctcttatgcttaggtatttaatacatttttagttaatttttgcatacgatataaagtacaggtccaacttcattatcttcgatgtggatattcaatttttttcaaaaccatttattgaaaagactgtcctttctctgaatggtcttggctaacttatcagaaacaaattgtgcatatgtgtaaagtttatttctatgctgtctattgtatattctattctgtaggtctgtacttaggacagtgccacactgtttttattactgtagccgtgcactgttttaaaaccagaaagcatgagtcttccaactttatttttctttttcaagattgttttggctattcaaagccgcttgagattccatgtgaattttttgatgtattttccagtttgtgggaaaaaaaaatccgtaggattttgataaggattgtactcaatctatagattgctgtgaaaagcattatcttcttaacaatattttcttccaatccatgaacacagatgtcttccatttacttatgtcacctttaatttcttttagcaatattttataattttagaaaataaggctttcatctccttggtgaaactatccctacgtattttattctttttgattgactagctcttttacaagtcttttactgcttaagtaatttctcaaaagtttgttaaataaaatgtagaatctgacataaatttctaagttgacagaatatactattaatcaacttttactaggttatgctgcaagataagaaactaaatgttacaataccaagtttatttgatactcacatttacatcagatgtgtgttgctgcaggagtgctggggtctgtgagattttcaagctgttccctatttcttctttctctagcagtcatgatgaaggacaaaactgttgggaacatgatgttctctactatcagaggacagcaccaagaaggcaaacagaaacaagcacaatttttctaatccttttcctagggattagcctactaattgtaccaaagttgtccatatttcacgggtcaaacaaaataaatcccatggccatgctaaagatcagtagggtaggaaaacaggacagtgagaaaaaagcaaaccaataattgtgaacaaataataagtttcattgcagttataagtaagcaataatctttcatagttatgaaaattcgtttttccaagatttatcacttgctgtgttatcttgacgctatcactagtcctgttttctttccttgagaaacagagaacaaaaattctctttccctcacatgttcaaataattagagtgtaattataaaataattggagcaaaggtgaataaaagtctatcaattttcagctcattttactcactgaaaagaatcaagattttttgtgttttaaaataacaaatatccatctaaaaatgccacagaaattagacagaaaggaaacaaaataagctttgataaaatttatgactgatacaataaagagaaaaaggttttttataaattaagattttaattcatgtgataattgtgtttattttttaattagatggtgttagctaaattaaatcactcatttgaacagctcagaaatatcaatatgctatattaacttccttaagtatcacagttcactgcaataatacattcatattttcactcaaatactcaagtggttgtaggattagcataatatgctaatttttgtagcttatctaacatatatttagcatattttgctcactgaagtacacacagtgttgtttaaatgttttcatttaagcttacctccttgctaaaggtaactccaggctcttatctaaaatttggtcaggggaaatggattagataattgagtaaagagatatgagcaagaccttgcctttctctatcatccatttagttcacagaacaagcaaagattcaaaactatgttacattttaaccattaatactgttcataatatcaaagtataaaggttcgtgaaaaaattgattgaaaattttaaaaaactctccatttatttcataagaataagatactttcatttgtcggtacgattaaatcattgattatggtagtgaagttgctggaggagaaatggagaaggaagattggttgagcttcatgaccttggcaggagttaagtgagccatgtagaaggtgagtatttatactttgaggaatttctcctcctaaaagatccacaggtgctgttgaggggtttggggcagcagtggaatgtggtcagattcacgtcttaaatagatcactctggtacctgaataaggatggctttgaagggaaaagattggagatacagagacagtactatagaggctgttgcatctgcttaggtgcaatggaataaaaaacctaattaaggatctaaattagaccaacaggaaaaggccaagtgacatgaaagttaagagcatgcctgagtttggctgtcaaattgatctggcttcactttgctccctagctctgctacttagtgctttgatactgtacaatattcttaatcactctaaatctcaattccttttcccatctttaaaatgagtatgataacaatacatttctcatagagtggctatatggatttgttgaaaaagacatacgcatttagcatcatgcatagcatataataaatatgccacaaatgagttaacattgttcaaacagacaaaatagagtctttccaacttcatacttttagaaagtggtatagcacaagcctacatctaggcctccttattcaaattttgtggactttttactctaccatgctgtttcatagaacatgtggagagaagagaaaacaattttagagaggcttagagccactccagtattaaagctgggaatatgctgaatgatctggccaattcatttcatttcatttcatttcaaacagtgtaataaatgctctcttggtataagaaattggttattatctgaactgtaattctgatagtatgtttctatataaacaagatataatatgcagtaactttaacttcttaagaacacagattgtttctcattcattttggtatttccaatgcctagtttaggaactgaaacgtaacagtctcttagtaaacatttagtgaatggatatattatgctatttttgagacacagctcatcaaacatagtataattgatttgaaataaaaatggcagatcaatgaaaatagcaatgagattatgatcagggagtgcaagcaagttttctcctttacttttctggtgatgtgttatggatggttttccttagaaattattttctttcaggatcagcctaagggaaagagtattacagaaagttttagcaacagtgtcatgaacttaaagttgtcagaggaaagccctgaggctccagcatcccatccatcctcatcactaacagatcttccttgtaaaaccctttggaacctggcttcaatacaaagtggaattaccgaaagccttaatattgttgctggtttgctcactaatgattattttgtttctctgtttcataatgccttgcctggaaaatcttttgcaagtgagtggccggaattataattcttgtaaggaagtgatttccacatgtggttaacgattttgctactgctcttctcaaccttcacaccccttcattcctgcccaactcatttggttatggatattaatcacaatcacagaacaggaaatgctttattttaatgtttaataagtttacaactctcgaaattgattcttgtagtatgaatgttggtaatcattacactttaatgccataggcatttcagaaaagactggggaaggaaggtctccactgatatcaaagatgaaatagcaaatatttttgcaaaaagacaaaatgtcctttctttgactttaaagaagattaatagttataattaaaaatcacccatcagtgtgtatcgccaaagacccagctgagttcagtgaatactgctcacaggccaaattcaactctgcatcttggtaaatgcttctgtgacgtcgccacagggagttggcatctctctacattgacagaaatgaggcggtaattagaagtgagtgacaaggtgcttttcatctttgataaggaaagattttttgtgtcaaaatatctcgccagaggagtaattttctctgtgtgcattttttgtcctgaacgcattttgcatgataatagaaaaggggaaattgtttctgaatgttgcttagtgacaaatagcagattcggtgcctttgcagttaacaagtgtctgaatgctgtcatattgtgatatcgacagatagggctcatcgtaagctggggatatttatattggaaaaataatttgtttttgatagaatagaatcaaagatattaaaatgtttttatggtattatgcctctaaaggtttaaaatgatctgacaagatttaatcacccaattctaaaatacattttaaggatttaatcacctgaaatttttagcacagtgaggagacaaataaccaatataatgtagttgctgttttacagaacctgccttgtcactcaacataggggctgctgtcagttcagaacactttcaaacaattcataattatgctggaaagtgaaatccattgactgtactaaattggaaaatttaaaaacaactattcatgaaatttaaatggtttgaaacagttttttttttaaagaaacattaaaagaaacctctgtaattatagctttgcctggcattagattctatgaatgtgaaaggaaaattctgccttgaagttggaattgataatgttaagagaacacagtgctttctttcattatttatttttgtgtgtagggagagcattttatgggatgcaatttagcatacaggtcagatatgatagcaggtggaaagaatgacagtgcttatttgaaagaatgaatctgatactcattgttatctgagtaacattggcatggaaaatgtagtaagatcagtaatttctaaagaagcaataagtaacattatccagctagctataggagaaaacttcagagtgtacctgatcacaagagaaagagggaggtaggatgggtggagagagagagaagatttaatgaatattggaattaaaagaagaaattgaatgaattaagaacaccagtacctagctatgaatatcataggctgtgactcatttgaggtaattagaagaaatgtgaaggtttcaaagagttcattgccataatacttagataacaaataatggacttggctttttgttaagcactttattaaggctatcccaattcctgaaatttaattttctgaatacctctgttaaattaaagctaatgatattctctgatagcagcttgcaatagacatttggaccttatctttcatctttcaagatcctattctctaagagattttgatgagactacaatccttgaaaaaactggaatcataataatattgttgcccaaatcagatggccacaaaactaattaaatttgttttcttccccccattttactattaccatattcccctttatcaattcatttagaataattgtaaaaatttaatttttattaggttattctagagtacccttgagtatgctactcagaactctcagacagaagataaaataaatccacattagttttagatgtacacagttattttaactttgagattatttggagtcccggtgtggtggtgctcacctgtaataccagcactttgaaaggctgaggcaggaggatcacttgagcccgggagtttgagaccagcctggacaacatagtgcaactcttgtcttaaattaaaaaaaaaaaaattgaaaatataagctttatcttcagtcctaaacaatcactcaatagaagatcatatactgacaattatttcataagctttattaaataagttaataatcagtgtttataacatattgaacactgtgtaggttgaggactttacacatataattatcgtaagactacagcatacatacttcctgttgtattagtcagaaaataagtgcttagaaggaaaacaacttgttctagttcccatggttactaaatttcttacatgggatttgtgttgccaaagcaaatagtgcaccagacataattaaacaggcgacgaagaattattcaaggctattgcaataggggagagagagtgaactcacatcgctgtaacaaaacgtaagagtttctaagcagtagggtgagttagtgcaaaaacactggagaatgtcagggaagagggtggggaagggaatgtgttcagcatgttaaattaatccacaattggcaaaagtttttgtctaagattaggccatctgtattttggcacccatggaagttagacccttccctgccacagagtctgagaaaaaggaatgctatcctgcttgctgattatatttcaaagacatgattccaagtcctccacaaagacgttcactgggtcataaaactgacaagaggctgggagaagaattatatatatataatatatataatataacatataatatatattatatataatatatatatatgtatttcaaaggagcagataaataaagtgcaattgcaaattttctaaaatatatgctctaaagtagatatacagtcaagaaggaacctttgtaacatttagttaagctgaaagtaatgttaaggccatcttggtcacagtccatgtctgtcagacacctttgtagtcactcttaaccctggcattacactgaatcctaattataccagttttccaacagtaattgggaatattaattgcttgtccatagaatggcagtttatttgctgataatatgttcttccaaacttgatataattgtaagatactctcaatgaatatgtatttgcctaatatattataaatataaaaatagatttaaaaatttggataaattatctcaaaatacagttgaaacatttgaaatttgcttattaaaatacaccaaagtaatggtagaaaggaggtaaaaattatcccagaatcccatagtccttattatttttccattatccaaaataggtggaagttgattattttattcagcaaatatttattgaatacttatatctgccaggcagtatgctaggtggtagaaatatattagtaaacaagagaatcaatatttcttttggaatttacaatctagaaagaagcagatatttactagctaatttaaaaaaaaattacaccagtgagctatgcaatgaagaaaaaagttaaaacttctgtgaggacagataacaggccaaagttatgtcattacatagtgtagattttcctgaggattcatctgggacctaaatctaccaggtggagaaaaaatcttgacaaagcagttgaaaaggtgttgaagagtttgattaaccaaacagaggaatttcatatgtgaaacaagataaaaactatattttagattatttggaggaatcaaaagatgtagcaaaatgaagaaagcctgagagtcaggaaagcttagctctgtcataaactatttctgtggaattgagaaggcttggtatcaattttcctgtacacaataggttatctttggattaattttctgaaatgtcaccattgcactaaatgtttttgaaaatcatcttttggattgatggagaaacattcaaggatcgcaagtttttaggtcgcaaagaaaaattttgtagtcacatttcaattgactaaattgctgaaattattcacatactgtaattgctatgcttgactcttaagaagtattgaacacttcccaaattccaaagtattgaacacgtaccttcaaaagataaagatttgctgctgttgagcaattcaagtgttcgtgctatattatagaaatgtcataaaaagttacaatatctttgaagttctttgtctttgtttaaatgtaatcacatttactaattgtcacatctaattatcatttggatcagagagttggcataaaattacagaaatggaatagataccctctagagccaggcatgagtgagggtgaaggatattgttgctactctctgtcacaatttacacataataattggtggttatatttggtcaggtccagtttgtaaaagactctcgtggtaaagctgaaatgagtttctgaactttggagaagactagaatattatgaaatttagataatggcaaaagataataaaagagtagtgcctgtgggtctttgtttccctactcattctcctacagtgtttgggagaagaagcctccagggtattcgtggcacttgatttccagcagctgtcagagaggcagggcgctgctccagatcgggaatagcttgctctgctcagggtaattggctctgcagcctctgttgaagagaggcagtctgactcatcaagtttctatttttgctcatttgtttgtttttatgagaaaggagatgcatgttttttataccacatatagatccttacctagtgaagaaatctttgttgaaagaggtaagaaaagttaactaataaagattaaagatattttaaagtaggtatcattctatattcaaattatatccatttttaatgtaaaaattttaaagattatagcataattatatacacacaacttaaaaatatatacatatactatatatatgaaataattatacataagtccctgaaataattatacatatgtgtacttgtgtgtataaaacatagcctatattgattcctaagattcactgcaacaagtgtactttgagtaatgactcatagtaagttagatctgagggtttattatataaataaaatgttgttactgttcagtgatcttacatgacttcagtaatctggagtaaggactagatgggctaatttcttagtggagaactaaaatagaattaaacgtatttgatggagttacagattaactttgatatccaatattaaggagaaaaaaaaatattactctgcttacagagatcagtctgtcagtgtcagactttttccaaattttagtttcaccttgagtaatttttattttagatcacaagctatttttaactttctttccaaatggttttagtttacatacatttaatataaaacacacaccccataccaaaagaaaaatgtataaggcatgaagcataatttctacaaccttcgatactgtcattttccctttagacagctaagtttaaacaggcttctgcccattttcgatggtgtgtgtttgtgtctttgagtatacaaatttatgtacacatggttaattgtgaagtacaaaatgctgtaagtgaggatgagaccctacagaattattgacaatacaagtggagcgaaagagaatccacataaggtagactagagaaaaatacatttctatttattgttatggaaaatggctgaaacaagcacagccttccatgcttatgaaaaactaatcttacagcatagcagttcacatcactgtttcacaaacttatgatacatcctattggagaacatttaatcaaaaagcttattcagttttgatctttatgtatgtgagtttccattttactatattttacccatttaaaacggttctgttttttctactttgatcaccgttacatcattattactgtgatcaaagagagcacacgtaaagaaacaaaaaaaagtggtaccatttaagctgtagtgcaaagaaaatgaaactactgttttagagtgtaacacacatgtcactgaatcacaaagtgtaactgaagtgatgctaaacatcaagacacagagtgttaaaacaatctaaaggaaggtagtgaatatgccatgtacctggcacaacggacaacctcttggagaggggaaaatctgggataattccccatctgtgtgaaaactcaccagtgatggccagcaggcttgccatttaagaccatgttgaaaatgtgaaaaaaaaaagcttggctggaaatcagtgcctaatgaagctatagaataggacgcactttttttctttattatatatcttgtgatgttctgatttaaaatgtctaattcatattgtacacacgctatgcctagatttacctacaaaatcctcaatcaaacagtttatctaatgttataaagcaaaaaattgcttacggcataaagtttttattttgttttgttttgttaccaattacttaaaagggaaatcaatgtccagtgttatggcatctgagagataaaccagttgaaataaaaattgacaatgagggctgggcccagtggctcacgcctataatcccagcactttgggaggcccaggtgggtggatcacctgaggtcaggagtttgagcccagactggccaacttggtaaaaccctgtctctactaaaactacaaaaattagcggggcatggtggcacatggctgtaatcccagctactcaggagggtgaggcaggagaactgcttgaaccctggaggccgaggttgcagtgagccgagatcgcaccattgcactccagccagggtgacaagaacgaaactccatctcatatagttcaggttataatttgaggttcttgtcctgaaaagcctaacaaatagagtacaaaactggatggactattgaaagcagaagataagagaagaaaataatgaagggtcaatagagaataagagtaggtggcccaaagggacatcttggaggctgattaccccatatcctatgctccatctttcatgtttccccatttttattcatttgaaattaaaaggccgggcgtggtggctcatgcctgtaatcccagcactttgggaggccgaggtgggtggatgacctgaggtcaggagttaaagaccagcttgaccaatatggagaaaccctgtctctactaaaaatacaaaattagctgggcgtggtgatgcatgcctgtgatcccagctacttgggaggctgaggcaggagaatcgcttgaacctgggaggtggaggttgtagtgagctgagatagcgccactgcattccagcctgggaaacgaggaaaactccgtctcaaaaaaaaaaaaaaaaaaaaaaattaactgatatttttcatcattcttaatttcagaaactaagcataaaaacaaaataatatatacaattatttcattaatatgtccatattttgttaacataataaaatataaatttttacattatgattacagtttttaaaattcacaaatacagttttatctttacaagcctcaggaatttaaccatatgcttcctctgaaacatgcaaaatattacatatcaaatcaaataacattagtattactttctaaattcaattttaactatcagtcatataatccagaagcatgaaaaagtaatatttgaggaagttatcgaaacatttcactgtttttcagaaccctttagaaatcagatcagaaggtcatttgcaattcgctaactggttaatgacacaattgaatttaatagactctaattctttttctctaatgaccaatagtcagaggtccaatttcagagttgaaaaatgtctgctattttcagcacatctatttctaacttcacatttgttttctctgcaagataatattaaatttaaaaataaaataaagtaaatcattttgactaaatgaacagcacaaagcctttggcatcagatacatcggaaccttggctcaaacatttattttccttgaagctattcactacttaattaacttcccttggtctcagtttttcaatgtatataaaaatgtaagatttgggaggccaaggccggcggatcacgaggtcaggagatcaagaccatcctggctaacacggtaaaaccccgtctctacaaaaatacaaaaaaaattagccaggcatggtggcaggtgcctgtagtcccagctactccagaggctgaggcaggagaatggcgtgaacccaggaggcggagcttacagcgagtccagatcgcgtcactgcactccagcctgggcgacagagtgagactcagtctcaaaaaataaaaaaaataaaaagtaagataatatggaacttaatgtctggtcggtgaggtaaaaaggaaatgagtgtaaaagagatatcatttgtgacctccagacttagatcatcatgtaaatattggtgccaccaaatgcaatagaaaactctgaaagaatgaagaaggccaaatgaatgtgttgatacacggtgaaggttttgatgggcaaatggccatggaacatccacgatactagcaggaaaatggttctggtgctcaacttttgttttcaggctggaaaagtaaagaagaggaatcaaaaggaaactagatctgaagaaaatggagagctaggccgggcgtgatggttcacgcctgtaatcccagccctttgggatgccaaggcgggtggatcacttgaggtcaggaattctagaccagcctggccaacatggtgaaactctgtctctactaaaaacacaaaaagtagctgggtgtggtagtacgtgcctgtgatcccagctactcgggaggctgaggcacgagaattgcttgaatccaggaggcaaaggttgcaatgaatgtagatcacgccacagcactccagcctgggtgacagagtgggagtctgtctcaaaaaaaaaaaaaaaaaaaaaaaaggagaaataaagtgatgaaagtataatagaaaatggaagaattaacagttacagcaggaggagtgaaatatttgatgtgaaattatcagggatagaagagtctagataataacaagttagagagtatagtcaggagctagtattgaggaatgaagcttaatgagatggagtttattaaagaacaataaatcaaagttcttggatgatatttttgttaatctattgttttgcaacaaatatccctaaatatagtgacttaaaaatacaacagtgatttacaaaattacaaatttacaaaattacaaaaatataagagtgacttcccatgtatctggaattctggaatttggggttggcttttgtctgagaaaccctgttttctccctccagtagtctatactagcttccttacactgcagttttagggcaatgttccatgttggtgaagtcagaagctgcaagacttcttgaggtctcaatcctagaaagcacacatagtcacttccaccatattctgttggtcacagtcaaaaggccagtttaaattaaaaagctgaattacttaataaaaaatattttaaaaattataaccatatttaatctaccacaaatggaatatcgacttggatcataaaattacctggattgcaactggatttgagttggaaaaaaataacaatgacccatttaccaaagatataatgaatatatcaaaagcaccaaaaaacttgcggatgatgcaaggaaaaagagatagtttcagcgaggtaggatgactcacaaaggaacaaatattattgtacgattataaaagttataatttggatattgcatatgaagaatattgacctcatgttccagtctcagtgtaccttttgttccagggacccaatgtatcaatgaccttctgctgacagaatcaacaatcccaaaatataaggggcttaaaacaatagacatgtatttcttgtttatgttaactgaggaccacaattcactgaggttctgctccaaaacatgatgaaggtgagatctgttccatgcatcttcttcttctaagaccaggttgaagggacactcctgtcagtgacgtggtattctcttggtagtgggaggtaaaagtgtttaaaactgaacattgaagttcagttttataaaattatacaggccaattataaaattgtccttgtagtttacttttgaaagcaagttatctcagatgtctaacaatgacaaagtctagtcaaggtatccttgacccactttatcagggattatctgcccatgttgtggtcagaatcctgtacttatgccaaatggcaggaagtgatttccagcacagtaaatagactttaccccagtcgcttacccctaatgtgagtacaaaggaggaagtaacataggtactgaactgagattgatgcccttattcgatgaatgttataaaaatagcacctggaatatggtaattaattcctacatttccaaatcagaacagaggcttccaacagttaaaaatcctttctattctcatgatgcacaatgacagcttgttttacatgatttagctagtagtgaacagaattcgatttattaactttttgcaggaagagagacaatacaccattgtgatctgtgcgctgtcttactaagaaagagttgaaatgtacttaacatggtgtttgggcttttgctgagtgatataaggaagggcttaagaaaggttgggagggtctgttttggattaaattctgtcaggaagcgggtcaattatccttttgaatatttatacttcttaattggaaactttaaaatgtttttggtctaggaggtgtgaggaatgaaacagagctagaattgtccttggtaaaaaagaaaaaaaagcagtagtctctcatattttgggggagtggagattttctaatagtattatagtatctttatatttttcttatattcgtatatctttatagagtggtcttgtttttgcttagtgtcatcatgtcacagaatgttttgccttattattgttaaaagtctatgaaattgtttatgtctggtagagaatgctgctgctgttttgttatttcttttgtatttatctttctcaaaggctttagttttttttaaatattgtttgtattgtcctatagtcgttattcttaacaagtcctaattggctttcttaattgtaactttttctatgaattagaaggcctcactttctatgatagacttattaattggtttcatcatttagacttcctttaaaacaatcgctgatattgacatatcgtaacttcatcgctactctcacaacctccatttacaaatatgagactacttggcagtaataactgtagtgctacatattatttcctctttaaaaaagtgtctggaggtacatctttggttcttctgaaaggcactgtgagagcagagatgtacagattagttcctcacttagtcttagagaagaccttgcaattttgccttttctctggctagctaatgaaaactaagttcttcacccaagtcctttacaccctttatgcagcacaactttaacactttaattttaacaagtcccatttcctcatttggtctcttgaaaatatctatgagaaaggaaaccttgctttgttcacatcacagttcatattgcaagatagtgagttcctagatggtttaaagataattttagggtgtataatcaacctaattatattatcttttggatacaaatctaagaacaaacattacatataacatgtctttggttttggaaattacataattttgtttcttactttacccttaaaatttgtgggaacactactcttaacaatgctttggactcgtggtcttctgaaatcttttgtcccactctaggctctgtttccagctgaacttccttgttaactcatttctattttcgtaaagctgtttcatgttagcatttcttcttacttagacattcatttgctagtcatcctacccacttttatttttcatcagctatatttctctaataataagaaaaaactagtagtcataactgtcaaactctgcattaggctattttccagtcagtatcactgtatatgttcaagtactgtattcacatgcactgtcttggccaatctcttatacaggaaaggcaagcattgaagattgggttttactagatgacctttgaatctaagttcaatgttgagactctatgattcaaaacacagtgatagaaaaatcataattttgcacagacttcatatatatactttaccaccctatccaagagccctttcttgattttcttatactaatcagcacctctagaaaggataagtaaaattggtgaatgtactctgtagtatggatgactatatgcatatgtagaaaatcactaggctaggtttaaaaaaaagtgagaaaggaaataatatctataggttcactgcaattaaatcatcctattaaaatagtttacaagaacatatacaaacagtatgatatacactgaacatattataatagttgcttttagataagaatatggcaatgggagagtgaataaatggaataaatacattaatgaaacaagataagagcaagacatatcaatgagatagtttgacatgaattcataagtctttttttagtcttctgcacatgatattcaataaaatacatacataaaatagcactcatctctatgcctattgcctatttaattttctagtctgtatttatggtttctaataaaaagttaattaatttattctttattatttgcctctgctaaccttttctgaccagcaagttactttcctaagaggagataattttgtttctttttttttttttactgttgtatcaccagtaccaaaaataatacctgacatctactaaatatgaaaatattaattatattaattaattaattatacgaataactatgatgaagttgattttttttatattatctctaacttaaaatttaaaagtaagaatctgtaatgggcttaagttattcatggtagtgggaagatattttaataacgatcagtgggtgattgatttctggttcaatacctttctcaattgaaatgacaaatcaaattagagttttacctcaagtgccatttgaaaatgaataaaatataatcgatatgacatgaaaggagatattcattattgaaagttgtattctgacccagagaaaacactaactgctatacccgtattactaacttccagcatgagctatttttaaagttttaataaactgaagagaatcatcttgcctcaaaaacatgtggaaaggtagaaaaaaatatgtgtattgttatatatatacacacatgcatatatgtgtatttatgcattctataattcagctcatggcccctccagtggggcagagatcctaaagctttggtgggtgacagaatctcttgcaaagctgcttaaaagtgaacattttggccaggaacagttattcatgcctgtaattccagcactttgggaggctgaggcatatgtatgtgtgtgaatacatatgtgccatataaaggtttaaatacacatatatgtgtatatatgtgtatatacacttatgtgccatatatgaggttcatatatacacatataatgtgtatatatgcgtgtgtgtgaatatagttatgtgtcccataacaatgttttggtcaacaacaaatcccgtatacaatggtggtctcataatggtgtgtctgtgtgtgtgtgtgtgtgtgtgtgtatggtgtgtgtgtgttaaataaatgctactcttgaaaaacataataaagtcagtattcctgtggccaagtaaccatttgaagaaatatttgtcctttgtttggtgcaaaggaccaaatgatgtttatactttttttcagagaatactacacactttacacatctcagcatgaaattagtatcacaaaatctttctatttatttacagttttatttaactgcctgatttgtccaaaatattctcaaagaagtgagcaaatagaaatgatagtgtttgttgtctataaaacctttttgtaaatgagcaatgatcattacactgtttctactattaacttaaacaagaacatttgtcagatttgttcattcaaatattgtttgtagctggggatggtggctcacgcctgtaatcccagcacttcgggaggctgaggtaggtggatcatctgaggtcagaagttggagagcagcctggcccacatggtgagaccctgtctctattacaaataaaaaattagctgggcgttgtggtgtgctcctgtaatcccagctactcatgaggcaaggctggagaatcacttgaacccgggaggtggaggttgcagtgagccaagatcacaccattgcactccagcctgggcaacaagactgaaactctatctcaaaaaaaaaaaaaaaaaagaaaagaaaaaagaaaagaaaaagaaacccacaaatactgtttttgaataccacctgaggaggaccagacccatgtatagatactggggttacatcagtgagaaccctgattattttgagtttcttatctgatgcagtggatttcaaacctgtttaaatattggaaacgtccaacggatttaagaagtaccaaaatctgagtcccattccaggccaaaaaaatagaaatatctggggataggactccaacatttgagtagttttaaaggatctccagatgatatcagtatggtgcccaagtttacaactgcttgtccaaaaagtgacatataccagcaaataaaaaaatttcttcagctgagctaagcctagggaaaaaaaaaacaaaccaaatttctaatcactgcggtaagtgctacaatataaaattccctggagccaacagggacaagaggatcattaggtgagggaatggggggaagagacatagtttcaaaagtcttctcacaggaaatatcaattaaactaggatctgaagaataaaagaagttggtgaaagtcaatggagatgatttattcagatttttttaagtatatgtaaagtccaggagttaaaagatagcatggcttattttaggatgtaatagtattttaatgcaattggcattgaacttgaaaaggacaaagaaatggctgtatgcagaaggccttataagccatgttaagaaaaatgaactccatcttaagagcaatggagaagaagaacttcataattttcaagattagtcagaagttgtcttttgcctttctcacagtactttttatatatttagaatggtcttttctacttaattttaatgtatgtggcatagtgtccctattatcagcagaaatgcacagtcaagtttcttgaataaaaactttctaggactcctattattaatgaatctaacaattttaatggttttcttagagctcatatttttagctttagggcagtggttctcaagcttttttcaggtccaacatgttagaagtaatgactaattatagcaattattttcaagaaaaggggcagaagaagggactaaacagctcacctgggtaatggtggctgctgtagcttgaaagtgatccacccatcttcatctgatgctcctcgagggctgagagaaaaatcgtagtctccctttaaaaacaaacaaacaaacaaatcaacacaaaaaactgcaagctcttgaaattagaattaggggtttaaaaattgccttcaaaatttacaaatgcctcagggaaaaatcatatttacatccttggtatgagagtacaataatcagcgaaacttggttcaagtgtcctatgcttgacctaatgaccttaaagccaggaaagataatagcatccttccagaacgtgttgctaaggctgagaaagaagttgtaccctagaggaagcatagatacaaacactgagaggactgaatggcacgcagcacccccacattttggcttctacagaaaataattatgacctagaagtgaaatctgctggacagaaattggctagacccaaactcatggggaagcacggacagatgcagacgcagagagaaaagtgaaaatatcattaaagaggcctttgttgttaaataaagattaagaactgccactctaccgcacaatttgacagcctccaatttaaaatgtgatttacagtcacaatagttcctattttctttcttgcattttgtgaccaaagaaaacaaatacctgtgtgtgcttttacgagacttatttgttctttttctccacatccactcgccctctcttgtatgatattatgaataatccagtgccatgacttgaactcctgagacttatgacacaatcagagacaggtgatctggaaatatcctatttggtttcttcactgtcctttaatgttttcttatgggaggagaggttcttccatttttgacagaactcagtaacacgtgtttcattcgcacacaagtcagaggagccaggcaaagcacatctcactagtgtctctaaataacttttttttttttttttttttttttttttttagacagagtctcgctctgtctcccaggctggagtgcagtagcctgatctcggctcactgcaacctccgcctcccaggttcaaacaattctcctgcctcagcctcctgagtagctgggactacagccgtccaccacgacggccagctaatttttgtatttttagtagagacagggtttcaccatattggccagcctggtcttgaactcctgaccttgtgatccgcctgccttggcctcccaaagtgctgggataacaggcaggagccaccacgcctggcctctaaataacttttatttcactaaatatattgttatgaaaatgaagtggctatcatttttatcagtagtctcttttgtatgtgaatatttaaagctctcaaagaaataggaagaaaagaccaaaagaaatgatgagttactagctttgtttctctgacagactggtcccatatgtctatggttatgtgatgaacagaagaaaaaggaaagaaatacaaaatattttagaaattggtttgctaatgatagcatgtactacacagaaaatattgagacatagactgtccctaatctctagttaagttgttggttgttttcagattctgagtgatcctctatatgaacagtgatgccatagtggcaagcaagttattaaagggactcgatacctgctcgtggttgatactcatttagttttcatatatttaggttgagaagctgcttttttttttttcttttggcattaaactcacataactatagaaattatgtttgtattctgaggagtacctataatttatttaaaatatttttgtaatttcccatggctattataatttttaaagtatgctattaagaaatgcttgtcttaacagggcagaagctgctttaccctgggtttttccacatggaggattatctgatgataatgacacatttcccacagtggcagggaagctactagagacacagaaggcctgcacagatgtcaggactgctgggtacagcactgccatggttgatgcactcagagtttaaagtctctttaaatttctttcacataaaagaagaaatttgaagttcagcctccaagaaagagtattaaaaagaccaggagggttttatccaagttccacgggtgataaaacacatcagtctgaaacattactagtgcgttgctgattccctagtcattcttccatttgctgtagctgaacaatgatagcactgttccatcaagggaaaatgatccctcctcctttcaaaaagctttttacaaggcaaagctataaagtgctagatttattaacaatttccatttcaagagagacactgtttgtacggccgtaaagctgtgctttaatgcaagcctgttttcctaatgccttcacaactcctgtaaataatgcatcccttggtggcatccttcacttttaaacaatttgggcaaactggttcaagttgtaaaaatacaaatatactttctgtaatataataatagttttgcaaacactctggaatttgccaatttacttttctagatctgattgatatttgattgccaaaatgggaaaaaaatgtacttaggtgaatttcacccccaaccgagggactcaggacaccagaaaagtgaagacatattccaggaaattttgagcaatgataaaactggtccgtggtgtttgttgacaagagaaaaagtgcatccaagttctataaactgaaagtgtcacgagaaacttctttatctcagttccctatgttggatctgtcaattcaaccaggttttattgaactattctaattatcttaaagaaacctgattaaactttattctattcttgaatagtccttcccctttactatatgtttgcttttaaaaaaattaattgacaaataataattgtatatatggaatacaatgtgatgttttgatatgtctactctgtggaatgattaaatcaagctaattaccatatctatcacctcccatacttaatttttgtggtgagaaaattcaaagtctacccccctaacacttttatataaattattattaatatgtttgccttttaaaaaatactattaaatggcaatgtattgattaaaaaataaaaatcattcaattctcaaagtgtttactattgggcagataataaatgtttgtttgtttgtttttgtaaagcaccagaaaattattttatggtaagctatgtaaaaggaaagtaagagtcttgaaaaatgtctttcctctagtagttatcattttgtagtgaaaaccttttgcattcactctcttagcattttttcaagaatacaaatattgttaactttagtcactgtgttgtgcaagagatctcccaaacttatttctctatctaactgaaaccttgcatcttttgatcaacatcaacgtcttctcaacccctgaaacacccccgccccacccctcactgccagtctcaaaagtaatgtaatccagcttggatttggtgatttggacttgaactggattgaaatcaccaatccagcttggattagtgatttggacttgaactgaggggaaattataggtgttatattttattcataaaccagtaattttatagtaatgtgttaacaaaggagaaaaataaatggtccagtgaaaaattgagttatggttagattgcataggaatgtaatcaataaagtatgacatagtagagagagaaaatttgtaagaaaaaggtcataatgcagaactcttgtatttagttaagtatcatttgaggctctttttgttgaaaatggcagacaaaccagtatacaatagcttaggcaataaagatgacttattggctcatataactggaagatccagaataagaaggagttttagctcaaggatgtcgtcagagatcccattttcccatctttccacagtgcatcctgtatatatggaattccatatatggattgtatatatggaattgtacatcctacaagatctttagacagtcttcctcatgttgtcaaaatgactacataaatttgaaaccccattcatagctatgcatttcctgtataactatttggaaagacttagagaaatttatgacctggagtcctcagtatatttcccttgggtgaaagttacgtggctgtccctaaagaaatctctgaagacaaagatcaacggcatatactgatctactcaagcccgtttttctgaaccaaattccaaattccatggagaaggagttaggattgctcttattggacttcactagagcagggcccacctccaacctgggtaatgtcaggttcccctgaagcacatctgttacaggaaaggggtcctgatccagacccaagagagggttcttggatctcacacaagaaagaattcaggatgagtccacagtgcaaagcaaaaacaaatttattaagaaagtaaaggaataaagaatggctactccatggacagagcagcccgagggctgcgggttgcccatttttatagttatttcttgaacatatgctaaacaaggagtggattattcatggctcctctttttagaccatctagagtaacttcctgacattgccatggcatttgtaaactgtcgtgacaccggtgggagtgtagcagtgaggatggccagaagtcactctcatggccatcttggtttcggtgggttttagccggcttctttaatgcaacctgttttatcaacaaggtctttatgacctgtatcttgtgctgacctcctatctcatcctgtgacttagaatgccttaaccatctgggaatgcagcccagtgggtctcaacctcattttacccagctcctattcaagatggagttgctctggttcacacacctctgacacttcagtagtgtggaaaaaggaaaaataattgaacaaaaatctcagcacttaggagccagatatagggaaacagaggatgactaagcaatcaacaaataacctccattctaaggcatttctcctcaagtttatatagtttttgccatttaaacaaaaaaacttttatttaaaatttattggatttgatttggccaattgtttctttgcattcatgtttttctagtttctggtgaaaatttcatttatttaatacttgttggtcattttataaaatgttaattactagtaaaatttttccaattagatatatgttatctcccagtccatatattttctttctaaccgcatattctctcctcatctaagctctgaatagcagggaggttaattaatagaggttgattttatatacatctatttgccataggaaacaccaaactcataagaaatggtaacaattaatcaatgctgtagttgtcccataaaaattctatccccccaaaatttcattttcccccagttaagaccaatatgttgccacattatctgttttcagtacatacgtagtcacacacccacagatatttcattttagttttgcaaagggaaattttgataccatactgaaatggtaggaaatttagttccaaatcactggagttaaatagatgataattccacaaatctcttttcattattaaacaccatttctactagctgtattttaacttttaaatgatttcaaaccatttattataagtaacaatatataatcgcctatagaaagttcatactatccagctagaacttgttcagctatcaacctgacacctagtaatcatgaaatgtccatccactcagtagaaataccctttccctaaccaaaggaagtttctgtctcctcttttttctggactcctgctactcagttgctgagcttcccctgccacaaggaccctctgactccatcttccacccttcctgctctcctctctttgaccttatgctgggatatttgtaggtatatagacatgtcaagccctttcaatccttggcttttaccatgctgttgccactttttagagtagtgagttgtttttaaccttggctgcacattggaatcagttacagaggattttacatctcagtggccaaccagcattcaagacaaatgaaatgaaagtatctgggggtgaggtccatgtatcaaaatttttttaagcctccagttgattccagtgtgcagccagaattgagaaccctctctctattcttacaactcctgattctcctacatatatttgtctaaatattatagcactctgcagagaaacttttattccctctgcagactaggtttggttttttgaaagatgctttcatggctggacgcgggggctcaaatctgtaatcctagcactttgggaggccgaggcgggcagatcacctgaggtcaggagtttgacaccagcctggccaacatggtgaaaccccatctctactaaaaatacaaaattagccgagcatggtggcacacacctgtaatcccagctacttgggaggctgaggcaggaaaattgtttgaaccaaggaagcagaggttgtagtgagccgagatcacaccattgcacttcagcctgggtgacagagcaaaacccggtctcaaaaaaaaaaaaaaaaacatgttttcacagctcctgtatttctcttcatggcactttgtacgcttgtaaactacttgaaagcagatatagtgccatgcgtatctttggtttctagaatgatatgcaatcaataaatcaacaaatatgaactgatttgtcttgcttaccaggacaagcccattgaaatcagactgctatcttaatgaaaccagtgtggaatctactgccacattgtaaacatgtacttaaatttctatgtcagtgaaagaaagaacacgaaactttttacacctgctactatacatacagatttgttcatagtccttagggctaaatctgcagttagaatcatttataaccatacaaacttgcccagttttcaaccactttctatgataggaacagatttatctcctaatctgcttacacacagacacagacacacatacacagtgcataatacccattgaaatgctctgggtactgtggaacacagaccagattgcctaggactaaaacaaagaagaaatatctttaactcaatttaagacacctaattctccagtccttattttattttattttattttattttattttattttattttattttattttattttattttttgagatggagttttgctcttgttgcccaggctggagtgcaatggcacaatcttggctcactgcaacctctgcctcccaggttcaagcaattctcctcccccagcctcccaagtagctgggattacaggcatgtgccaccatgcctagctaattttgtatttttagtagagacaagtttcaccatgttgactaggctggtcacaaattcctgacctcaggtgatccacctgtctcagccctgcaaagtgctgggattgcagacgtgagccaccgtgcctggcctccagtccttattttctatcccaggttaaacaccttttaaatgggatatgcaatggaaataactaaatctttaagaaaaattctacttgtacctgtattgtgtataatcaggttcacataatagctcaaaaggagcctgttctagatttttgagtcttataactttaactttgcagataatgcgtagtgctgattaacataaatgaatactttttccctttatagataagaatcagcatagtgtagaccttactttcatataactctgtcctacccacacaaacatgcacacaggcactcccaaatgtgcaaataaaactgtattttaaatcaggtggaataacatttggtaaaaaagtagcagaatgactaacagaattataaaatgtcgaaatataggcagatgcaaataagaagctggaattttccccaagtggtaggaataaaatctgattagagatttaaattaatttggaaacttatggtgaagggtttcatttagttatttcttaatgatttcttaattaataaaaatcacattaaccagaattggcctttcctttaatcgaatgtgaaagtgtgattacttttggaatcaagttaaaatttaatatttaagctagtttatcattctcaactctttgtccagtcctcaatatgagaatctaaagcatgctttaaatatctaattagttctaatgcatagcacaatgcctgacatatagtaggtatatgacattggtgaatgatttaatacttaaacaaaacaaaattcttgttctcaaataaaaaataaaataagccttttttttttgtcagggtctctgttgcccaggttcgagaacagtggcacaatcatagcttactgtaaccttgaatttctgagctcaagcaatcctactgcctcaaactactgagtagccaggactatgggcatgtaccactaagcccagctcatctgtttttatttttcatagagatgggggttgccatattgcccacactggtcttgaacccatggctcaaactatcctccagtctcagcctcctgaagcactgggaaaaacctttctctttaaaagaaagacatacttgttattcataagaaaaaagaaagattttaaaacaaatatatctttaccttataataagttgatgacatatataaagtatcttactaaaatgttatagtttgacacaaaacttaaaatagttggacttcagattcacaccatattatgttgagctcagaatttttatccatttgcgtacaaactaatgaaatatgaataattaaagaatagtttgtacattgtactaaattcaatgtctctaaaattttcctgtgttattcgttcttaaataaactgaaataagccaataaacttcgaacattcctggctacattttcagatttctaagatgtttctgaagtcatctttcctgatataattatattgtaataaagtacccatcatatcataaattgttattttaatgatactaacataggcatttaattattaagtaatcctaaagctgacattaaaattactatgaaattgttagtttcaaaatagtaaataaaacaacttttatattttttaatgtttttattatagtttctttgtaccagtaattattgaaatattctaataactcaaaaatgattttaactaaataacttcacttttaaaagaaatctaacaacttaattcaaccaaagtaaataacaccttttgtattattactcctagatgttgtttaagtctttaaaacaatttctaaaactccaagtttatttaattttttctacaatgtgaaaggtaaagtctcttatctaaaacctgtaaaaaacaagtttaatattggttttttaaaagccttactctcaaatctggttcttgaactgttaatcgtaaaaatagcatgactatgtgaaaatactagattgttcttttaattataactctgaactatattgtaaatccatttgttagctttcttcttctttgtcatctaattccatttctagcacttagcatagtgtggagagagttttaggtcgttagtaaacaaaagaatgagcaaactaatagatgggcatgaaaagcactaaatttatgtcttgctgctgtcatatagtagctaagattctgatctcatcacatatgtggacacacaagctttcgctaagatatatacagcattgtttggtttacaatattcttttacctatagtattgaagttgatgctcagaggagctatgtggaaatggccggaaggaaaattattatccacaattcataatatagaaaggtgaaggtagggcattaagcctcagttttatgttgaattgagatgatattatttatagctgaactgtggaaaggagtcagtaagaatttagtataagggtatttggtccaaaattgctttcttctgatcacataaaaacatttttgtataaatttttgtttccctgggatacccttgtcatattaggtataagggcacaagagtcagaatatttatgttaatcatatgctgattacctgcatgactttcccacctgtatactgtccctcaaagaaaatctcaagaagtaaaacagaattctaaggataaaatgaaacagcacaagaaaatgtcatgtaaagtaaaatactcacaatgctgaaatcatttttattatttgttttgtaacaaaataatgtggttcaaattcttagttaattgtctgtgaggtgtgtagaacttggactaccctaaggctcagttttataaaatttaaaaagatatttgcgtgactatttaaaaagtatgaaataatatgtaatgcttttagatcccatggcagtatttgtactcaataaataataaaataataaaaataaaaataaaaataaaaaactcaactataatagttattatacttacatataagtactagagtttttattgttgttactgtgctgaatggaagaggacaatagcaaaaataggagggagaaaaataccctctcctgtctcctatttaggttgataaaagtgccacccctccttcataggatttagatgaaattgaaaatacaaaatattacaagattaacaattctggttttcctgctggagtatctccagtattgacagataaggctaacttttcatccagcccatctgatgatattgactttcactaccatctgcattgccagtgattatgctcacctaaatgaattactttagatataattatcaggtccccaagacatcgaataaaacctccactggtgacatttcaaatgatgacagtgtgttttctcataatatatcaatccagagaccacctaaaaattatctttgtctttgggttaatggtaaaaagcaaataaataaacaagaacaattatactaaaaggttgccatgaattgttcacatttttcattttaaagggtaaatagtaaagaaagaataaagacatatttttaatccaattaatcattccatatctaatgttgtagaccaaacaacaggacatgcctaaacatttcaaagtagaaatagcatagttatattcaattcactataaaatgacaaacattcattgaacattggctttgaatagcatgtggaaataatggtataaggatgagtaagattgtctattggagaagacacatgtacaaatagaatatgacatctaatttaagtggtttaaaaacattttgctatagaaacccagagatgaaatattaaaattcaacaaaagccccactaataagtaacatgaggctaaatgtcaaaagaagggcagaaattgtccagaaataaaatctccaactggaaggaaagtgtactcagtagttaaagaaatagaaacggcacaaactcaggttacaggaagacataagaaattgggtgttgcagcaatatactggaaaagctggagaaaaaggagtatgttcaaagataaaacaagcatggattggagacagaaccagtaggttggtggtaaattaaagagtgttcatttgatccagaggtagtttgcaaaggcaaccatgttccaggccctaggataaatgtgttatgtttaatattgtttattctcacaactgtatatggtaggtagtgttgtcacctctttttcagatggagaaatcaaggcaaagggagctaagtaagttagtcaaagtcacacagcttgtagatagtggagttgggattcaaacctcagttttctaagactttaggctttttaactgtgtcctgttgcttttctctactgattgtccttttctgtcacttaccattcatttgttagcctttttactggcttctcattccccatcttatttgttccttaaatattatggttgtccagaattccatttttgtaaaactgaaaagaaacatatgagttctatagtaactttctttgaaattatacaagctttgtacttagaaacaaaacaatgtgggaaaaaaatttgaataccttcagagcatcatgatttgattagtgggcacacactaaattgtaagataaaatgcagaaaagtaggtaaatagcctataggtacacatcaaactgtttaattagtgagagaataaaatgattaaaaattaaaattacttaagcaagttctcaggcaaattctcatttctatttctttcttaacgagtctttaattagctgaaattacattagggaagtttcatgccttctatatttttgccaatatgtgaagtaccctctttattcacaaatgatgggtgtaagtggataatgaaacgtattcctcaggagaaagggaaattgcagtcaatttagtattattgaatatcaacttgtgtatatttttggctgaacaaaattaaagtcaacagccagcaagggaaaatttggttagaaatattttatgttatgtttgttttccacaatttcttacaaaatactttggagggagaaatataaaatgattttattataaagatttaatgtatctttgtaacattacaacaaacaaaagaattacctcaaactcacattaaaattttcaccctccaaactgtaaaataaacactagcttaaaattatggaataaattcatctttcatttcagaatcaacttatatgctagctttttcatggtttatgagaaactattatataattttctttttttaaaattatgttttattgccctttttaaaacttttattttaagttcgggggtataagtgcaggtttgttacataggtaaacttttgttatggggttttttgtacagattatttcatcacccaggtattaagcctagcacccattggttattctttctgatcgtttcctttctctcacccttcatcctctgaaaggtttcactttgtatagttcccctccatgtgctcatgtattctcattatttagtcccagttataagtgataacatgtggtattcggttttctgttccagtgttagtttgccaagaataatggcctccagctccatccatgtccctacaaaggacatgatctttttcttttttattgcatagtattctatggtgtatatggaccacattgtctttatcaagtctaacatcgatgggcattcaggttgattcactgtctttgctattgtgaatggtgctgcagtgaatatgcacatgtgtgtgactttataatagaacgatttatattcctttgggtatataccccataatgggattgctgggtagaatggtatctctatctttaggtctttgaggaatcacctcactgtcttccataatggtcaaactaatttatactcccactaacagtgtataagcattcctttttctccccaacctcacaagcatcttttatttttgacattttaacaatagccattccgactggtgtgagatggtatctcattgtggttttgatttgcatttctctaatgatcggtggtgtcgagctttttttatatgattgttggtcatatgtatgtcttcttttgagaagtgcctgttcatgtcctttactcatttttgaatggtattgtttgttggttttcttgtaaatttctttaagttccttatagatgctggacgctagacttttgttagatgtataatttgcaaaaatattctcccattctgtaagttgtctgtttattctgttgatagtttcttttgctgtgcagaagctttttagtttcattagatcctattagtcaatttttacttttggtgccattgcttttggtgtctttgtcatgaaatctttgcccattcctatgtccaggatggtactctgtaggttgtcttccagggtttttatagcttggggttttacatttaagtctttaatccatctcgagttgattttttgtatatgatgtaaggaaggggtccagcttcaaccttctgcatatgactagtcagttatcccagcactatttattgaataggtagtcttttccccattgcttgtttttgtcagcattgtcaaagaacgtatggtcttagatgtttggccttatttctgggctatctattctgttccattggtctatgtgtctgtttttgtaccagtaccatgctgttttggttaatgtaggcctgcagtatagtttgaagtcaggtagtgtggtgcctccagctttgttctttttgcttaggattgcctggtatatctgggctcttttttggttatatatgaattttaaaatggctttctctagttctgtgaaatatcaatggtagtttaataggaatggcattcaatctataaattactttggcagtatggccattttttaatgatattgactctttctatccatgatcatggaatgtttttttcatttgtttgtgtcaatgagataattttcaaagtattaattattttgtgctcattattaaatacgagcataatagaataggtcaatcttttctaaaataaaacttaaggaggaaataaaaatacccaaagtgcttgcaattcttaaagtaacttttgtttctaaataaaatatagagaaactctgtggtctaggttatctcaatatttgtcatttttacaagcataataaaaaattatgttatttatagttgtggttgtgtaaaacaggacctgtttttataaaccccagtcagtatccttaaaattttatgggttaataaatatagtacttgccttttaaatttaagtgtaaaacacttgaagttatgagaaaaaaagttatcactactatcataagagactgatatatatgaaaccaaagagtaagtagtgaaagaactaaaattctgaaaatatttttattataagaaagctgcttttgtcataaattaaatttgtatttagcggtactatagaaaacagccaaacagttaggagataagacatctttcatgttttattttaatatggaaaaagaaaagataaagtaagagctaatgatcaggaatgtgatgtcagcctttaacactttcaaatggattaaattcctggttgaatattaagtgagaaggaataaaacaagtatctagtgcatacgacattcaacacatttggtatgcctttaatatgcattatcccatttagtatgaacactttggcttaagaagtattgtcattccaactttatagatgagaaaatggagcatctcaaaaagtttgacaaattgcctaaaatctaatagataggaagatacaaagtcaacatttaacctcagaactctgatgccaatggccagtcctctaggttgtgacggttcctccatcttttctagatgctgataactttgataatttgagaaaaatcagtaaggtgttttgcagaatatctctgagttgatatttgtctgatgtttttccatggtaagagtaagggttacagatttttgggaggaagaacatagaggtaaagtacaattctcatcatatcaaaaatacttattatcaacaggacttattacagtttttgctgattttcatcaactggcagagatttttctatgtaactactcttttattctcccattctgtagtatactcttaggaagaaagtcattatgcacttaaggagtgggcagtaattatccacctccttaacaacagcatatctacacataaattatttggaattcttttgtacagatttttttcctccatttattatctatctatctacctatctatctaatgatttatttgtattagttggatactcattttaagcttttgattataattcattatactttattttgttgcttaaatatatccactttcatcattaagagctctttcagataaattctgtgccctattgaaatactctcatgtttgttttgcttgtttgtttgtttgtagaccacttcctttttttctggtattacaagatgtttcaggctcattttacatatttccttcctcagtcctaaaatcaaccatttctccaaggatccctggctacttttatcagaaaatggtattagaaacctagatctgggcatgaagtttgctcatttctaaggaatattgttgcttttatggtctcttagttgagagatcaagggaatatatgagtgtatactactgtgtgtgtatatacacgcctacaaatattgctgtatttcacatctatatctatattaagctaaacatgagttcatactgatgtctcccagtctaatctattatcacattgatattctacaacctcccattccaacagtgagacacctggctccgactgtcagccatccattgactttattccttaacgccagttacacatggattgtgatttcagaattgttagcccacacccactttggacaaactttaacaattatattacagagtgtttttttgttttgttttgtgttttgcctttagccttacagactcctttctttcaaaagtgacttagggtcaaaccgttttttctcacctcttttcctgaatttattctatacatttgtaatatatttctgttcgtctgtcctattctgcattccaacctcctgaatgaattatttgatttgcatacattaagatttactcttcatgctttaaattctatgcattttagcaaatgcttaatattttgtattcatcattactgtatcatacaggacagtttcaccaaccaccaaaaatcctctgtgcttccaatgttccagcctgttctcaaaacccctgggaatcacttaccatccctattttttgtttactttttccagaatatcatataattggaattatatagtacgtagcttttcagaatggctgtatttcatataatacatcttagagattcatccatgtctgttcaacacttgataattcatttattttccattcaaacaatattccattgtatggatgtcagtctgtttatcaatttttttactttaaagaccatctttggttgccttcagtttttggcgattatgaataaagctactctaaacagctgtgggcagctatgtgctgacaactcatatcacctctctccctcctacaagaatttcctttgccttttttgctctccttttgaaaatcacaccgtatctgctacaacctgccaccttcaccccacttaacaaactcctgcacatcctttctgtctcatatactcttcatgtcctctccaaattcttccccaacttctccagatagtagaggtctcttacttctgttatggttacagaaaaaccatatcactctgatagaattattcatctgagacagcatttaacatttaattgtatacatttccctgacaaattatggggctacataagcatttgtggaataaaaaaaactaaaatattaatgaaagaaaatgatataatacatatacttattcatatagatattgtctatacatataattgaataaactatcaagagcattaaggatatgtgacagtagtcaatgcagttctaaacttattagatttcagaacaaatttgaaaaattctaaattatgagatccttgttattcgataaaagggatttttggttgatcaagaaagtaactaaattattgagtaataaagaaatttatatttaattcacataaaaggaacattgagctatataataaacattattattaaaattaatttttaaagttttacaaaacatgtagaaatattctttatgactacctcacacattatctaaagataagagccgattatgtaataacacattctaattctttgtagttatatatgcaatggtatataaggcaaagggcttttttttttattaagtgttggtggaacagtggtggaaatatttttctcttaaaataactttatatgtccaataaccagaaaatacaccaaagattattgcttatctaaatattttttgaagattacactttggtttttttagttgttcaattataaaaaactttgattctctcagatatttgttattgtaagctttgttttgtttatttttatttttaatttctttggctttttttctataattttttatttttaatttttgtgggtacatagaaggtggatacatttatggagtacatgagatatttgatacaggcatgcaatgtgtaataatcacatcatggaaaatggagtatctatcccctcaagtatttctctttcatgttacaaacaatacaattatacttttagtaattgtacaatggtacttttagtacttttaaaacatacaatttactgtagtcacatccttgtgctatcaaatactaggccttatacattcattttaactctacttttgtacccattaaccatccccactttccttttacccctctaccacccactacccttcttagcctctgcttaccaatcttctactctctatctccaagggttcaatagttttgatttttaaatcccacaaataagtgagaacatgtagtgtttgtctttctgtgcctgctatttcgcttaacataatgaactccagttcattatgaacggaatgaacaatagaatggactgaagggtgagttctatttacgttgttgcttatcaaatggtgagaatttcattctttttttatggccaaatagtacttcattgtgtaggagtaccacattttctttatccaatcatctgttgatggacacttaggcttaatccaatcatctgttgatggcgattgtgaacagagctgcaacaaacatgggagtgcagatatctcttccacgaactgatttctgttatgggggatatagtcccagtggtggaattgctgggtcatatggtagctctatttttagtcttttgaggaccctccaaacccttctccaaagtgggtgtactattcactctctcaccaatagcatacaagggttgccttttctccacatcctcaccagcatttgttactgcctgtcttttggatataagccattttaactggggtgagatgatatctgattgtagtttgatttgcatttctctaatgatcagtgacgtagagcaccttttcatgtgttgctttgccatttttatgtattcgtttgagaaatgtatattcaaatgttttgcccattttaaaattagattattagatttttttcctatagagttgtttgagctccttatatactctagttattaatcctttgtcagatgggtagtttgaaaatatttacttccaacctgtgggttgtctgtttactttgttggttgtttcctttaccttgcaggagctttttaacttgatatgatcccatttgtctatttttgctttggttgtctgtgttttgggggtattactcaaaaaatcttttccagacagttgacctagagagcttccctaatgttttcttgtagtagtttaatagtttgaggtcttaaatttaagtctttgatccattttgatttgaattttgtatatggtcagagatagggatctagtttcattgttctgcatattgatatccagttcacctagcaccatttactgaagacactgtcttttccctaaggtatgttcttggtacctttgtcagaaatgaattcactgtaggtatgtggatttgttcatgggttctctattctgttccattgatgtatgtgtctgttttatgccagtacaatatcatgttattttggttactatacctctgtagtataatttgaagtcaggtaatgtgcttcatccagttttgttctttttgcttaggatagctttggttgttctgtacttttgtggttccatataaattttagaatttcaaaatatttctgtgaataatgtcatgggtgttttggtaggtactgcattgaatctgtagattgctgtgggtagtatggacattttaacaatattgattcttccaatccgtgaacatgagctatatttccgttgtggggtgtcctcttcaattctttcatcagtgttttatagttttcattatggaggtttttttccttctttagttaacttaatgcctagatgtttaactttacttgttgctactgtaaatggcactacttttttttcagtttactgttagcatatagaaattctattgatttttgtatattgattttctatcctgcaactttactgaatttgtttatgagttctaatagatttttggtggagtctgtaggttttttcacgtttaagattgtattatgtgcaaacaaggataatctgatttctttctttcaaatttggacgcactttatatatttcttttgtctggttgctctaactagggtgtccagtactgtagggaataacagtgatcatagtgaggattgttgtcatgttccagatcttagaagaaaggcttttagtatttccccattcagtatgatactagctgtaaatctgtcctatgtggcttttattatgttgaggtgtgttccttctatccccagttttttaagcatttttaacatgaagcgatattgaattttatcaaatgctttttatagtaccaattaaaatgatcatatggtttttgtcctacattctgttgatctgatgtattacattgattaatttgcatatgttgaactatgtttgcatcccaggggtaaattctgcttgatcataatgaacagtatctttaatgtattgttgaatttggtttgctaatattttgttaagggtttttgcatcaatattaatcagggatattgacctatagttttgttgttgtttttaaatttgtttttgtctcattatgatatcaggataatactgacatcgtagaatacttttgaagcattccctcctcctctagtttctggaatagtttgagtaggattggtattagttctttaaatgtttggtagaattcagcagtgaagccactggattctgagcttttctttactgggagactttattacagctctgatcttgttaattcttgtgggtctgttcgggttttggatttctctgtagttcaatttggtaggttgtatgtgtcaaggaatttgtccatttcttctagatttttcaatttattggcatatagttactcatagtagccactaatgatcctttgaattcctgtggtatcaactgtcatgtctcctgtttcatcactgattttatttattctaatctttccttttttttttctgtcttagtctggctaaaagtttgtctattttgttaaacttcttttttttttttttttgagatggagtcttgctctgtcacccaggctggagtgcagtggcgggattccagctcactgcaagctccacctcccgggttcacgccattctcctgccttagcctcccaagtagctgggactacaggcgcctaccaccatgcctggctaattttttgtagtagagatggggtctcaccatgttagccaggatggtctcaatctcctgacctcgtgatctgcctgcctcaaccttccaaactgctgggattacaggcataagccaccacgcctggcttgtttaactttcgataagccaactttttgattcattgatcttttgtattattttcatttatttctgttctcattttatcattttttttcttctacaaattttgggtgggtttactcttccttatctaatactttaagatgcattgggagattgttatttgaagtttttctcctttttgatgtgagcacttacagcttttaaattacctcttattgctgcttttgctctgtcccataggttttgttatgtttggtttccattatcatttgtttcaaaaaatttttcaattttctccttaatttctttatggacccactagtcgttcaggagcatattgtttaatttccatatagtcctatagttttcaaaattcctcttgttattgatttctagttttattccatagtagttagagaagatccttaatattatttcaattttttgaatgttttaagacttgttttgtgacttaacatatgggctgtccttgatgatgatccatgtgctgaggagaataatgtgtattctgcagttcttggatgaaaagttttataagtatctattatgtccattttgtctatagtcaagattaagtctgatgtttctttgttgattttctgtctagaagatttgtccaatgctaaaagtggggtgtttaagtctccaactatcattgtattggagtctatctctgtatttagctctaaaaatattggctttatatacctgggtgctctagtatcgggtgcatatatatttaaaatttttatatcctcttgctgaattgatcccttaatcattatatagggaccttcttagtgtcttcttatataatttgtcttgaaatctattttgtgttgcattagtatagctgtttctgcttttttttggtttctattgtcatggaatttattttttcatccgtttattttcagactatgtgtgtatttataagttaagtttatttcttataggcaacagatcaatggtttttttttttctttattcagcttttgatagaaaaatttagtccatttacattcaatgttaattttgataggtaggtaaggacctactcctacaattttgttttttgttttctggttgttttgtggtcttctctttttttgttctttgttttctgtatttcttttagtgaaggtgattttctttggtgctatgacttagtttcttgctttttatttttttctgtatccattatatattttttggtttcaggttaccatgaggctttcaaacactatcttataacccattatttaagttaataacaacttaacactatttgcataaaggaacaagctaaaacaaggctagtaaagactgtatgccttaacttcatccttgtgctttttaactttttgttactatttacatcttattgtactgtctgtcttaaaacgttgtcatagtttttattttttattggtcaccacagttacaatgtcatagtgttctgtggttttttgagatacttactattaccagtgagttttgtaccttcagatgatttcttattgctcattaatgttcttctctctcttattgaagtactccctttagcatttcttataggacaggtctggtgttgatgaaatccttcagctcttgtttgtctaggaaagcctttatgtctctctcatgtttgaaggataatttcaccgaatatactattctaaggtaaaactttttttttcctttagaactttaaatatgtgatgccactctctcctagcctgtaaggtttccactgaaaagcctgctaccagatgtattggagctccattgtctgtcatttgtttcttttctcttgctgctttaaggatcatttctttattcttgacctttgggattttaattattaaatttcttgaggtaggcttctttgagttaaatctgcttggtgttttataaccttgcacttgactattggtatctctagatttaggaagttattatccctttgactaacattctatccctctttttctaccttctctttgaagacagtaactcttaggtttgcctttttgaggttattttctagatcctatagctgtgcttcattgttttagttatttattcttatctctcttctttgtgtattttcaagcaacctcttcaagctcactaattctttcttctgcttgatcgtttcttctattaaaggactctgatatattcttcagtatgccaattgcatttttcacctacaggatttctgcttgatttttaaaaattatttcaatctctttgttaaatttacctgatagaattctgaattcctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccggctactcgggaggctgaggcaggagaatggcgtgaacccgggaagcggagcttgcagtgagccgagattgcgccactgcagtccgcagtccggcctgggcaacagagcgagactccgtctcaaaaaaaaaaaaaaaaaaaaaaaaaaaaaaaaaaaaagaattctgaattcctttggtgtgttatctcgaatggcttggagtttcctcaacacagctattttgaattctcggtgtggaagctcacatatctctgtttctctaggattggtccctagtcctttatttagttcacttggtgaggttatgttttcctggcttgtcttgatacttctagatgtttacctgtttctacgcattggagagttagatatatattgtagtattcacaatctgggcttatttgcactcatccttcctgggaaggcctaccagatattcaaaaaggcttgggaattgtgatctaatctgtatctgcttgaaggggcaccccaagcccaataatgctgtggttcttatagactcatagaggtaccaccttgatggtcttggataagagccagaagaattctctggattaccaaacagacattcttgttcttttcccatactttgtcccaaacagagtctctctctctctctctctgttctgagccatctggagctaggggttgagtgacacaagctcccctgtggccactgctcctaggactgcactgggtcagatcttaagccagcacggtattgagtctcacccaaggcttgctgcaactactccctaactactgcctatgctcattcaaagccctggggctctacaatcagcgggtggccaagccagccagtcctatgtccttccctttaaaaggtgagttctcccaggacttggacaggtccagaggtgctatctgggagccagggactatagccaaaaaccttagaagtttacctggtgttctgttgtactgcagctgatctagcattcagatcataagacacagcttttttccgctcttctctcccattttcaaaggcagaggagcttcatactgtgaccactgccacatcagactcatcgggagtactgccagaatactgcagatattcccttatggcccaagggctctttattcagcttgaggtctgtctagcctgggactcacccttcagggaagtgggctcacctctggcccaaggtaggtccaaaaatgccatccaatagccatgtcctagaatcgggaaccccaagagcctgtttggtgttctatccccctgtggccaagcgagtacctaacatgaaagaaaaagtccactttacttttttccctctgattttctcgagcaatagtagttttgccccatagccaccacatctgggaatgtgctgattcccatctgaaaccggcaaatctcagagtctcatgaaaagccctaaacatagttatctgggtattactgctggttattcagggcccaagggctcttcagttagaaactgatgaatcctgacaggcctagtgcttctattcaaatcagcgggttcccttctggctcagggtgtgtctagaaatgtcatctgcgatctagggcctggaaaagggatgtcacagctctgactagtgccctgtcctgctgtggctgagctggtatccaagatgcaaggcaaagtccttccactcttctgtctcctctcctaaagtggaaggaaggggtctctttcggagccgtgagctgtgcagtttgaggttaggagaggggtgagacaagtactcccttagccatcccagctggtgtctcagtaggtcatgtccctctatcccccaactcaactggctcttggtccagttcagcactaggactcacctaggtgttacagttcttgtggcctaaactgcctttcaaggttatctggggccccagtggcctttagcttgtagtggcaaggcttgtgggaattcaagttctgactgttagaatctgtaactcccccctcactaggactcatttgagtgctctctttatgggcaggcatcaggggagtttggtctagttttgctttcttctataacaagggcagcactgagttcagtgcctcataatcactgactctccatctccatagggcacaaaaatactctctgcatcatgcttccactacccagggattggagaagtgtgacatcggtgattcggaactgttttttctacctgttcagtgcctctttcagtgatatgaagttaaaaccaggtattgtgagtgctcaccttatttttggttcttacaaaggtgcttttttctgtagatagtcattaaattagtgtccttggcagggcaggtggggagcaatatttgttggacccttctattccaccaccatcttgctgcagccctccttttaatttcactggcgtttttgcaggcttcttttttaaaaagtatcattgttattattattagatacaagagactgtgtattactctgttgcccaggctggagtgcagtggtgcgatcatagctcactgcagcctggaacttccacctcagccttctgagtggctaggactaccagcacatgccactacaccaggctaccaaaaaaaaaaaaaaaagaaagaaagaaagaaagaagagagagaaagaaaggaaggaaagaaaaagaaagaaagaaagaaagagaaagaaagaaagaaagaaagaaagaaagaaagaaagaaagaaagaaagaaagaaagttagttcatagaaattggagtctcaatatgttgcctgggctgacctcaaaatcctgaccgcaaggcatcctcctgcctcggcctcccaaagtgctgagattaatgcaggcttctttatatgtgtaaacatcccttttaaattataaatgtaaatatttagaaaacattatcttgccccataaattaataagtttatacactttttcagatttaacctccaaaaaaataaaaatctgtatcttaaatgaacttggccacccaattaaatttgagtcagagcctgcctactttaattaacaaagaaaaatatactgtgtagttttacataaaacaatggttgactgaataataataggtaatctttaactattttgggcatgaccatctgttgttaagatcattttaaatcatgtattcttataataatctgcaaaataaatcccaagtcaactttctctcttggtgaaacatcatttgtgattttcaacagtcagcctgttttgtgattctgtttattggaatttctgattctaatagtagtgaattagtttgttgtaagtaatctaattatgtggccattcttacttgttgaaataatgtagttgatatttctaataattttaattactttagttcaaaaaagagttattagtcactatctttaaaaggcactgccggccaggcacgatggctcaggcccgtaatcccagcactttgggaggccatggtgggtggatcacgaggtcaggagatcgagaccatccaagctaacacggtgaaaccgcatctctactaaaaatacaaaagaaaaattaaccaggcatggtggcaggcgcctgtggtcccagctactcaggaggatgagaaaggagaatggcgtgaacccgggagatggagcttgcagcaagcaaagcccgtgctactgcactccagcctgggcgacaacagagcgagattccgtctcaaaaataaaaaaataaataaataaaggcactgacaaaaatgtttttattctgatacaaaactttttgagaggttaaagatcatctgtaaacagataaaaataaatcatgaattaatacgttggtgatttttgttgagaagtggtgatgatgaagaaacaaaggctttgtgaaatatgcaagactgggtaaaacaaggagagaaaaatagtatagcaatagttattagaatgatggaaccgagtgaactcgttgaattgcttagaggtcattgcagccatcaagtgtgggttgcattttactagtatggcaaaatgacctaataattgaaccaaaaattgaagttaatttgtaagaattatgtgactacttagtagaagaaaaaggatgtgatattgggaaaggaaagcttaataataaattgtcattaagacacaaagtcaactatcatttattgttactatattccaatttctgtgctaggcacttacacttaccatcgcaagttgctctcaggttattcatttatccaacatgcaataagtttctgggagttataaggtgttttgccagggatatgataattaatatcataaccttgttggaggcttagtttgcaaaacatatttataagatgattatcaaaaaaagaatgattaatgacttgatagaagagtacaaatagtggtgaattataggaaaaagaaatacactccgtttagcttgtattttagtttcctagctagaaaatgaaagagctaaaatttaagttcaatacacaagctatgcagccttgttttctttatctcaatttataaaattataagaaggtcctttgcaatttgtagaagaactgacacggttaaggaaataggtgaaaacaaggacaagaattaacttacaggagaaaaatgcacatacctttccttgttttcataaaagactggcaagctagatccatattgccagagccatgaaagactgttctaaataacatgctagatgcctgatgtgagtccaaactgtggaacaaaaggtttctaaatgtattttttttgcaagtatttattcttgatgattaaagggacccaaaaccagagaagaagagagagagagagaaatagctaaacagctgtaaatttatccagaaagtactactcaaattctccttgattttccctgggcaacaatcagcaaacttttcattagaaggaactttaaaaggtttgctgatttgcaaaacatggcatgaataatgtgtacattacttgcataattggttttgtgcgtacatatggcacatgctattttggaaatgtaccccctctgtgttcattatagctgttgctcactctattccctgataatcatttatagttacttgtcacagtttattattagaaaattaatgaatcagcagttttgtgcactctcctttaacaacctaatcttagaagtttccaaaccacagtatacagtaatagaaagcaagtagatttcccaaatttatttgcgtatattgagctgcgcattttacagagattatctgaactttcataaataaaactttcattattctttatgaattgttctattacattcacagaaaacattttatgaaataaagttaatcaataaatctatattggtaacatgtttattttcacatattttctaatttttacatagcttaagtttttcccttgtctgttgaaatttccacaatatataattacaatttttcagttgaggaagccagaaatcagacagaaaagagggccaagagcagtagctcacacctgcaatcccagcactttgggaggccacagacagattgcttgagcccaggagaccagcctgggcaacatggtgaaaccccatatccacaaaaaaatatgaaaattatatgggtgtggtggtgcccacctgtagtcccagctatttgggagactgaggaaggaggatggcttaagcctgggaaatggaggttgcagcaagccaagatcatgctattgtattccagcctggatgacagaatgagaccttgtctcaaaaataaataaataaatacaaaaaatttttttaaaaaaattagaaagaagctctttttatcacagctcttagggttttatgtggcttggagatgagcccaaggagaacttccacccaggagactcttaatttgactgtttctacttcaaattactcctatttgtagcctagagcccaaggaaatagaatagcatttgcccttgccagcaaagatctggattatcagacaaggattttaagccatgcactatttgtttaaaaatttctaaacttagcactaaagtcactgtataaacccatggaactccagtttcatttcttacatatggttgattggtaaaacaacctgtagactccacatagactaacggaataaataacacatgcaatcctattttgaatgtttcataagacatttatctcccacatatagacccttaactatgggccagacaagatatattactttgaattactttgacaaactaagaagcataccagaataaaaataaagaaatggggaaatgaagcttttaaataatattattcaaaattatctcaaattatattgtattaagatgtatcatagatatgtaacatttccttgtatgatttttatatagaagaaatatattatttgaactttcttaagaaggcaaatgacaaagttttcagagtttatagaatattgtagtataattctaagtaagatactgtactgtacattggtgagggacagggaaaacaaaggtgaatagatagtttcttatcctcaaaatccattcaatattttttgaatatgttctttataccagccacaaatgtgccaattctagggaatatatataaagatcccaacttcaagttaatcaaaatctgtagtttccaagtcttcatactaatagctaattgggaaggctgttcaaacaatgaatactatttatcactgtatcaatttcaccatctcattgctatcctcacctccatcatcatcatcatcgtcatcattggacatgttatatttagtactatgcaccagctactctgttaataattgttgatatttattacacataatcttcacaataattctaggaaatagatgccactttaatcctgtttcacagagaaggaaacagccttgaagaaataatataaaattcccgaggtcgccatgccacactcattgtgaactcaattctagcttttcaccacaacgttatagtgcattctttatcacttgctctctttatggaagagtttgtattgtattattgtttcaacccataaatgaggctgtatttttgttgcccttttctgtagatgaattagtaagtttaaatttgaattagaagatcaccctgcatcaatcagagcagggtgaatataactaatttaattgttttattaccagagtacatcaccaagcagacatcaacaacaaattgcacatttgactttatgactttattataaactgcagcagcatgtggattctacgaccaatgacacagcttatctctttgcaccttgttaaccttttatttcactgttctttaaagtgagaactcagaagtcagagcagcatctgtctctgccatatctttgcaggcaaattaatctacatcaaagcaccctgaaaaaaatacttagagtcaagtattaacggggaaggtataatgttaaagagagcaaggaagaggaagattaactagaacaggcaataaacacaaaagcaagggacttagtctgaaatatcttgatatgtcaatgggcaactaacagtgtgacaagttatcattaaagaattcagcagggctgggcacaggggctcaggcctgtaatcccagcactttgggaggctgagatgggcagattacttgaggtcaggggtttgagaccagcctagcctacatggtgaaacactgtctctactaaaaatacaaaaattagccaggtgtggtggtgggcacctgtaattccagctacttgggaggctgacgcatgagaattgcttgaatccaggaggcagaggttgcagtgagctgagatcatgccacttcactccaacgtgggcaacagagaggaactccatctcaaaaaacaaaacaaaacaaaacaaaaacaaaaaaacaaaaacaaaaaagatttcaccagaaataacaaatcagtaatcttgtttcaaaattcgtttttttctcagaagtctttgttgtaatgacacttgaaactacatacaattcatgactctcttataggtgtttataaagttgggaaaagtaacacagtaagagacttcaccatctgcaagtgaaaaaaatccttttatttataatctcaactattctgccaaaaccagtgctttctgtctagaataaattgatttttgcttatgcataaattaaatgtcaacacatctttcacaaatctacttatggccagccaaaaaccaagctgttgagctagaaaacaaatttaatacagataactagatattctatttgttcaacaaatagatacaaaagaaaggagcttcagtgatcccaagttgtcagtgttaattagttgatatttgaagaaaattcctgcctcttcctcctaaaccactgtggatcaggaaacctgttatatattatatttctgtccaactatgtcttataacgcattagttccagctgaacaaacgctgagaaaataacaaaaatatacatttccatattgcaatattgatatcactgtgttaacacgtttaatttaaattctagaaagttttgagctgggtgtgttggtgatgctctttctctgccccatggaaaggggatgtatgtgtatagttgtgcacacatggatatttaataagtgcctgctgagtgccagaaactcttttaagcactatgacctggagatacagcagaaaattatatacatatgtgtgtatgtatgcagaatatatatagaatatatatgtataagaatatatatatacattcttaactttacaaagaagttcagcaatgaacaaatacatatacagtatgtcatgaggtcaggctaggcagaaaaatagagctatataatcagggcagatagtgataggggtatgggagggatgttttgagaagttctctctgttaaaatgacatctgagcaggacctgaattatgggagagactaagatgtgtggatatctgggggaaattatttcaagcacagagaagagtgcccaaaatcctgagactaaaataatcttgctattctggaagaatggcaagaaagtctttgtgtctgtcgtgagtgacagaggagagaatggcagacaatcaaacgggtggtcagagtaaggatactgaatatagtttaacaaggaaggaaagcattttgaggatagaattttctgtgctttttagttgcctttggcttcctgttataaatatctgaactattttattttttaagaaaactccagtaaaacaggcaactcaatattgtaattcttgaagtatttgttctcatggattatttcaacaaggcatgctaaaacacactctttggaattataggcgtgaaaatgtgtgatatcttttcttacccatcatccatcataagggtcgtggtgagcattcctataaacaaaaaggaggttaacaggagcaaagcacaacagatttatttaatcaaagttttacacaacacgttgaaccttcagattgaataacctaaaggtacatgggaagccatctgattttcttctgaggtttaatgaagcagggacagtgagtagaaatgtgactggataaaaaaaaaatgtgtgatctaatagtagtctaatagtgtgaggaagaaaacccagcaaggcttgtctgttcagcttcttcttggcctctctgtgaggcattctctccttccttctgggtatggggcagggcctctctggaatgtgggtcttataacctataccaggtaaatcagaaaatttatttatggccagctgttatgcagaaaagagggggaaagttaaagtaatactttcaggttttatggctgtctttgacgaaagggagttctggtttctatgactcacattgtgggtgggggattctagttgtttctatggctagcctctggagaaactgaggggagagcaggagagtgtcaaagataaactttgcttctgaggccttcactttgtgatatcattttctgggccccaataagacctagcaccaccaaaatgtgaactaattaacagatagtcgtgcaatcattcctttccattaacgtaacttgcatagctcttcaacactttagaatggtagagggggcatcaatattatgaagaaggaaattgagttccacagaagttgaatgatttaatccgaactcaaagagtcaattaattctgctcttgatttttccagtgtttatttatttcaaaaacctaagttaagttacacaaaaccgaacaatataagtagcctcaaaatagtgcactgtagtcagcttgtacctgattttccatttgtatgtgcatttcttcccaacttcaagttcagtggcagctcactggcagcttggagttagccttggtgggagtatttagaccatgaatattagcaaatgctatataattcagggttttatttacttatttattggtgtttcttggacagcctaattaccagcatactggaaattacaagtatgcagggtattttttcaacatatattatctaaacttttacataaaaaaggagcattctaatgcctttttttttgagacaaggttttgttctgtcacccaggctgactgagtacagtggctcaatgacagttcaggggagcctcaaactcctgggctcaagtaatcctcctgccatagcctccccagtagctaggactacaggcaagcatcaccatgcctggctaatttatttttattttcatgttggtgagatgggttctcagtatgttacccaggctggtctcaaattcctggcttcaagcaaacctcctgcttaatctcccaaactgctgagattacaagcataagccatcatgcccagtctctaatactactgtcacaggtgcaagtatctggggccggtgtcatgggtggtaaaggaatttaccaagacagttgtaggtaaagaaagatagattacagggaaagtacattgcaaggtagcaacgggcatcataacagagaaggggctgtctgcaaggaggcagaggctggagggaagttttatagggttgtgctggaaggggctatgtgcaaaacaaggtatttgggaaggggagattatgccagtgaattgtttgtaaatagctgtgtcttagaacaattgttctctcccacttgggagctcttccttgttgttacttactcatatcaggactccacaactacttctactttgcacttgtacattttactgaaagtatctgcttatgaggctttaaactccaagaggcagagactgacctatttttctgtgtatccaaactagaattgaacaacaaacgcaaattgactttaaaatcaatgaccttcacagataaagtgtcaatgaattattttttaaaattaatttttaaattactgttcaatcaagttaaaaaaacccaacttggtctaacttgtcaaatagcagcgtgaatacattttatatctttctattatttttcaataagttatttttatattaggtagtcttggtccaatattagtgtgataatatgtagattaaacacactcattggtttgacaggcaaagcttgatttgtcaaaaatacacggattattaaaacacatttttaattagacagtggttatctcagggaagaaattgctaagtataaaataatgacataagtgaatatgttaatctacacttagtatacaacaaaacactattcacaatgtaccgtcaacttggtgtgaatgttaagtttttgctagaaatgcacaaaagatgtttcattaagagtttgatttcactttatttgtaaatgtgtcttaatagactttattatagccattgtgttgagttgaagtgctcaattattcctactattttatgttaaattgtactattatctaggaaaataaaaggctgagttgaagaatctaatgcttattcaattgtaagtattgtcccatgaaagcagagactcttcatttccattcttttgtaaattcatggtgtcacaagtaggatttttatttattacttttaatcttcaataaacacaaattataaatcacattctttggatactaaaaccattactagctattgttagacttaatagactttattgtccccattttggtgagttgaagcattcagttgagtgcaatgagatgtattcaattgtggtaacattagaaaagtttcatgtttaaacggtgatctctgagaagttactcttgtaaatttaagttatgctgacttggacaactcttttcagatttatgaatatatagccttggtcacagaagtaatttaaactgctcaaggtttttaaagtatctaatgcacttctcttttatttctgctggttacaatactgctagaaaagtcagccttgctaaggttaatccaagattacacttgcaatttctgtgtaacttcaatcaaaatagtagagaagaatattgggataatttcatgactacattgctaaaaataaattacttctagtttttaaatggaaaaacaaaaaaatttaaagaaccaacatgaaaacaacaactttaaaaaaaaggtatgagttattcttactctatgtggaaaataaattatgtgaataatttttgcttgttttggcacatttctttaactagatccataggcaagaaaagacagtaaaactcaagttgacatcaagccattaaagacctggaaagaagagggtgttaaaagcgctcaagttcagataacatgtccaaagggataattgatgctgcaaatttttaattggatttaattggatccaagaacatttaattggattatttgatctttagctaaaattacttttctttttggaagttttcggtacagacaatgatttctgattattgagactaacctgatgcacttcattttggaaaccatttcaactgtcattaaaaagacttgtttggggtttctttcttcccatggctctaatgtaattgacaagtgccttttcagtaaattacactcattacctgttctacttactcttgctagttatttttcttaagtatctgtcgaatcatgtcgtgatcctgaattaaactcctcatgatgcctccaaataaagtccatgtcctactttatgtcatacaagccttttaatcattctaaagttacctgtgtgaattgtggaaaagttcaagctttggagacagatgaattgtatgggataacatatgctttgccacttagctagctatggcagtttgctatgccttctaatactcagtgtcctcaactataaaatgggaggattatgcatgataaggaatgtcaagtttctacataatacagtgcctgccactaagcaagtgccaaagtaaacaaacagcaaagtttatgaccacttccccatattctaattcttagaaaatgtcatcaactatgcagagggcagagatcttgccaccatcatcacctacctgagcacaacagcactgcacagcctcagggatggtattcaaactgcagtcaatgtgaattgcaccctctggagatgtaaatagaccagtcactgtatgtgatgactttactcattttctagagcttgggatatgcttgtcggtttgttgaatggataatgaaactaagtgaatttctaagaagttgagaggtttgttttatattaaaaaaaatttgtcttacaaattattgtaattatttatttctgggttaagtggttgcttctgttttaatcctctaacaagctgaatgaatgttgaaaccatgctgtgccaagaagggctaattggttgttttagcttattagggctggaagtgttaaaaacagagcctgacagcaatgaaattagtgacaatactaagccagagttatatggactgtagctaatgaagggcatgtatcattcccaatttttaaatagtatcttttacttacagtagattgagttgttcagtagggctggagtggggggaggggtgtggctggagaaagttatgtaaatttctgatgaaatacaaattggcagtggattggcaatatttgtttcacagtctttctattgtggtattttcttacaaattattgttattgttatatcccaattaatgacttctccctgtaactcaacagaggtcttttaattaatttcattaattcaaaaaatgttcagcaaacaccatgtatctagcatggtggtcttcaccaaatgtatgatagtgaaaaaaaggagtctccgtctgcaaggcattcagtttaaggaaggagacagaaaattaaataaagtaggagaagtgctatagtcaaggtaaatccaaggtgctggggaaacagacatgtctagtgttaaaaaattgttagaggtgatttagtgcagccctctatttacttataaattccccggatacaaggctgcagaaccgtgactccattgactggtacggtggtttggttcaaatgctctttttggtgaaacttgaacaattagtcatctggtctcctttgacagaaaggaaattacttcaaagaaaagtattttgaaaaaacgtaagtcaaaaaaaatctgggaaaaaggttatccccaaaatgatgtatcaactgcatgtcataatttagataaatattaattttcatgcagtgtgcatgcaagccctgggattttagaaattttagcttaaagtgaaaaacaagatatttcagtgttaatggtagcacataataagaattttcatacataatgtcacactcaaaaaattttttaaaaacctctagtgttgtcataaaaagagcaagcttctacagctcaaattctggccatttcagaacttgaacaacatgtagagccttcctaattgtcagaatcctagtctgaaaagggccatgataatgcttacataattgagttgtggaaaggattaaataagattacgatgaaaaagtaccttgttgaatgcctgataaattgaaagcagtcaatcaaaggcagctgaaaagaaatggctgcttcactggttaactgtcaggtcttgtggttacataagaaaatatgggcaagatagacattttctctcttgggttgaaataaaattttgatatatttcctatttcctacttgaattttactttcatgaggacagagaacctgggaattctcagtattcctgccctttgctgtccatgtgaaggcagcactgctcccaattgcactgttacagaatcacagcttctcggaagcatggatagcagggcccttctttcaggcatcttcttctcattctttcctagctctcttccttattgcctggaaattataattgtgtctttcatcagaaagagcatgcaaagctgaataagaagaacttttgtttacacttagggggagatccaagctctgtattattcattgaggttttttttttttttccgcctaataaatattcatagagtacctactgtgtgctagacactgctataagctcaggggatacatgggcggacaacatacctcagattcctttacagagtttatggtattgtggaagagaggtgaaacaaacaaatatatagaagataacttctactagtgaagaattttgacaataattcaatgaccagtgctctaatttcactctaaagaggctacccagagaactgggaagaagaatgggctctgtacatccttgttgtagaaggaagctataggaataagaacagaattcaggattaaaatcatttgctcttcgtcgctgttgcaagcagctttgttaaaaactccccaattgaaactaatttcatatcaagaaattatagcacctttggatttttaatgggctttatgtagcatgacattgacttatgacaatcttgatgtttgaaaacaatttgccattttatgacttttttgcatttctggatgacaccgcattgcatgtttcaaaatattatgagctttataaatatacatttaggggtaatttctgcaatattttcttagtccagttaagttagatcagagtgttgtttgctttgtaagtttaatttagaaatttgagtaaatgttttggtttctctgaatccaattcactgcctattaactttgcctttggaaatatggcttttactaggaaaaaaaaaatagctgtcttacaaatcttgcaaataaatcaaaaacaacttatcatagattttacatgcatcacaaattttcagagtcaaattttgtggtaatgtcaacctgaaaagaactgcagctgtctattcaggtgtgttcaatctctacttgataggaataattaccttctaccctcactaggtaattgccttttgattgaggtcatcagagcaatcaagtcagtgagaggcggaaatctagagtaggaaaggagacaaagggaagaatcatgaacagaactttgaaaggagaacaagaaagaagaggtttaatttgtttttaacatttaactgttcagtaataatttaaatagtggcagtcataaaatcatcataatatgcaacctgggttaattagcttgatatttttgttttttgaagtgaaaagcttgatatttttgttttttaagcatttgattagtatcattacacattcctatgaatgacaactcactctctaatttagtctccaaatagtctttgcatacacattatatcaggggaatcgtttaggtactgggacaggtagaggtgggaacaaaataaagaaaatgtatgtcctaacagggtttacatcctgattattgaaaaacaaaagcgattcatgttactttatatttttatatatatatatatatatatatatatatatatatatatatatctgtattttaattatactttaagttctagggtacatgtgcacaacgtgcaggtttgttacgtatgtaaaacaaagagagtgtagaagcaaagggaatagagagggttttttattaatgaaacagggaagaataaatatttgataaattgacagtcttcttaagtgagacatcctggggatgagtttgcaggaagacaaaacagtagtgtaaaatgtttggaatgttcaaagaacttaaaggaagccagtgtggctaagagtagtttgaacaaggggtaagtttgagatttttgcagactaataagtgcatcttctaaacttccaatttaagacttgcagatgttggggaaatataattaaaaacaaaatcttctcctaacccagaaatcctctctacaaagataatagaggaagaaaacattttcgttattgaataagcatgtaaatagaatgtgatgcaatcacaggaaatacactaagagactgcaggtacagcaaaatacggcagagagagaaatcccacctttacgtagagccaagcagatacatatcattacatatgtcttttcaagatgaacaataagtagtcctaaagaggacttgacaggactatttgtcacatatacttcattttaactttacctggtgattggagtgactatctgtgttagctatggtctttactcagaggaaaaagcagcttctatctttatgacaggagttagtcttgcagtttgcagcaaggtgcccactgaagtgaggcttccaccctcgagcagaaactgagagataggaaccttattttccatgatgtttacatttcaaagagatggctccttggtcgttgagaaagacattccttggtcataaagctgacaaaagctttatttagtttctaaaaatattcatatacatttcaaagaaacagaaaaagtacttacattttcaggtttctaaggtaaacttactaacaaaatgggaacggaggaaaatctatttcctattttcaacagtgagaattaagcctcttatttttaatctgtattttttctcattctagtaatacctacattagtgcttctcaaactttaatgtgcataggaattgcttggtgatccatttaaaatgcagattctgttttgatgactgtgaagtgagatctgaatctctgaattcacaacaggttccctggtgatgccaatgccatttgtccacagtacaggctttgagtgacaaggttagataaggagctgagagagaggcagcataagactagtgatttcgactagggtgggtatggggtgggggagcggtggtgtatgatcaagtattataaggccttgtagaccatttaaaggacgtttaggtttgaatgatattaaaaccttagagtataacagttcccttttatttgtgggtcataagttccaagaaccccattaggtgtctgaaactttggcaaatatctaacactgtggacacagtaagtactgtgttttttcctatacgtacatacatacatacatatgatacagcttaatttataaattaggcacagtaaaagatgtataacaataacctaataataaaatagaacaattttaacaatatggcaacatcaatactcttgtactttggtgccattattaagtataataaggattacctgaagacaagcactacaatctaaacagtgggtctgataaccaagacctctacaagtgactaatgggtgggtagcataagtggaaatgcaggacaaagtgtcgtgggatctgggggttgtcgctttcccagctggaaacctctgtggctggtggcacccagcatgctgcactcagctcatgctgccggcctcaacctcacgcctgcgaagggtgagccaggtgtggagcggcaaggggtgtgtaaatgatcactgggtctggccactgaacacagccaggcatgccagctaaggcaggcaggcagctcctggcactggcacagtcacgagctccatgtgaggctgcagctgggccagacgtaatgtaagtggcatgcactgtgagcactggggaacatggtggtgcccacaagcttggagatgccaggaatggcagagccccaaagagggtgtcacagccctggctcagggagctcctatgtctgggctgccagaaggactgcagctcttctcttattttcatcgcccacaacatggtaagcagggacatgtttcagccctgtttgtgttacagctctttcagtcgggccattcaatgggtcctgagttcttgttctatgtccaggaagaatgaggtacgtggacaactggagggtgagcaaggcagagagaagcgtcactgagacagaacagctcagaggaaactcaaagtgggttgctcctttccacaggcaggttgtcctgatgagtgtacaactcttagcagagaggaaacccatagtgggtagctcctttctatgggcaggttatcctgatgaatgtccagctgtccacatagaggagacctgtagcaggtagctccgtcccacagctggtaatcccaatgtctctgtgagtctggctgagtctggggtttttatgagctcctaagggaaaaattgtgtgctgattggtccatgggtggccataggcagacctggaaaaacaaccatctgattggccaaacagtcatcaatgaagtcctcactccaggccagggacttcacccagaactggcagcccggccctcaggcttcaggctgtttttgttttggaggtagggtttcactgaggaccctccgctttccttccaggaacctgtctgtctcctgccatcaacatgccatccatggcgccaaggttgttcgtgctgagagatgcctgcaggcccaggccaagacacccacaccaccccttgcctctctgctgtgctatgtggtgcccaaagtttgtagagggacaaggtggtggggtgggggtagggggctggcataacagcaccaccccaaatgtgtgcacactccctggtttgcaacagtgcacacgcccagccacaactttgctgtgcactggagcaggtgccaggagcagagaaagaggccagagagtgggagcagacacttaggagctttcaagggcaggggttgcttcctgagcctctgagaatgcagggatgccgaggtctgcagccatggctgggtggctgcaactgcaccctggagtgtggggctcctgccagctcagtaggggcatggtttccacctgttcctcacctctgccagatccatggggcacatagccctggctactcctcccccactgcagccagtgtcttcacagcgctgctccagaaaggtcactgctgccatcacaaccatggttagagatggaattgacaaggaaatttggttatttatgtggcaaacagcaatctaacataattataattactactgataacatatactaagaaataacagaatcacaggaacctcatacaattttgcaacacatattaatagcatatttataaaaatataatctaaaaagaattaaacaccatttcatatttgacaatgcttcctgtatgattttattataccaaaaatctgactatttctcttttggacttcagggggcctcatatcaaaaaaattgatgaagtcaaaaagactgaatttacaatttggtttttgccagtttgccaaataacagaggtttaaaacacttgatatcacaaaataggatcacaggtaactgtaaaataagtcattcatttatccaaagtggtaatacaaatatttccaaaaaaagggcaaaaactctgactcttttagaaaggagactcactttcataaacaatgagacctaataaagacatcatgaggccagctaaatatgtttctcaattcttataaacaaatctattaaattttaatcatcttgaccataagacagaattttcgtaagcctttttataatcttttacaatttttttaattaaagagtggttaaagctgccagaaaacttcgttaatctgacacactggcacaaatgctggtcttgtatcagtgcctttgatatgaatgtttaatttatcgaaaaatactgaactaattttctctgaaaattagcccttacagtctcctgcgtccacgtcttccatgttagtccttgggcctggaggatttgaatagttctaatttgtggccttgtatctcatgaatgcaaattattttgattgtcatattctaccaggtctgaagataaggctactgtaagtgtttatgatttagaaggagttggtgtcctttttagactcaggaatcatagccctgtaacttaacagtacagggactctaaaagcaatacagaaaattacatggatataataatcttgtatttttaaatctcagttttactaagcaaatcagaaacttaataacaatggcatagaaattatttcgataaaacataaaatctgtttcttaggccagttaccgaaaggcagaaaaacaaaaacaaaaaccttctgcagtgaggttgctttcctctgttaggggtccatttacataacctgcaagtcaaaactattgaaaagagtacatgaattatttaatcagacataggaaaagtgtgtcctgaatcgtaagtgaaggttttcagtttcatagaacaatttagatatattaagaaaagccaagagtacagaatgttacatcagaagaaaacattttctttagatcttgaagataaaatatttttagcattaggccacaacaacagttagaacctgaggggggaaataattacaaaaactgatgaaaaacttgaaggaaagagttattatctcaggccttctcaaaggggagagaaagccggaaacagcaagacataatagaagttaagcttttggattaaaagtgaaaatttcttgggcctggcgcggtggctcacgcctgttatcccagcactttgggaggccgaggcgggcggatcatgaggtcaggagattgagaccatcttggctaacacggtaaaaccctgtctctactaaaaatacaaaaaattagctgggcatggtggcacacacctgtagtcccaggtacttgggaggctgaggaaggagaatcacttgaacccgggaggcagaagttgcagtgagatgagatcctgtcactgcactccagcctgggtgacacagcaagactcagtctcaaaaaaaaaaaaaaaaaaaaaaaaaaagttaaaatttcttataattctattaagaacaaatgaatactttaaggaaattttggttttttaaacaattattttgtgtatcagtgtatttttaatatcaaacccaatctctagaaagactattattaataatttccttttaattttagccaacttaatcacgtaaaacttttccatacattttctttttacaaaccttattaagacttatagaaatttgtgagatgcttagacttcctcttttagcctaattattcctctttcttaaataaacagtcattttatttcaggccaataatttactgtacaaaatttgttctcatagaaaattattttccttttaacttaccaaaattacctctttataactttctttacaactgccttatttactacttccttttaccttgttttataaacaacctttgaattaaacaaaaattatttttcttttaataacttttttaagaaaaaaaaggctttacagctgaatacagtggctcacgtttttaatcccagcacttcggagggccaaggtgggtggatcacttgagctcaggagttgaagaccagcccgggcaatatggtgaaacctcatctctacaaaaacatacaaaaattagctgggcttcgtggcatgtccctgtagtcccacctatttgggaggttaaggtgagagatctcttgaacttgggaggaggaggctttggtgagccaagattgtgtcactcccctccagcctggacaagagagtgagaccctgtctcaaaaaaaaaaaaaaaaaaggaaaaaaaagatgtttctttaatatatgtatatatctttaattgaaaataacccagatatttaatgaatatctattatctaacataatataacttcaagattctaaattatatgtttatgtataagcatttattccattacatttccctaatttactatttttaatagtttatttagattacttagaaaaactgcagtattagacaaagctagtcatcatttaaagttattttcctgttaacaattgtttttagcctgtgaatgtctagttgtttatctaaacaagaactttaaggttcaataaatcagttttttgccaataacccaggatttagcaattttcattaaatcagtaatacaaaatgccttatttataaaaaaattacacaaagataattctgttttgagctgcatttatagcattaaaatcttcatgccaaattttgacagcttataatatctagcagatataattataaaacctctggaaaaataaatctaatgtataataatgtatgtgtataattctgaggacatttctaattttattttaccaataattctaaagccaccttatttattaaagatttgcttaagtcatgtgaacttgaaaaagcatttgggcttaaagttttttttctgatatagtatttaagtgcttttttatttaagccaattaattagagctcttttatatatttttgatagtgagacattatatatatgacacataaatacatacaggtatagacacatagacagaagtagatctgatagactcataagacttttattccacccctactttaaacttcacttttcttgataatctacttcattaccctaggcaattgtcagagagccctaaatttgcatactaaaggaacaattcttaggtgaaaatcagatagcaaaatacacatctcaaaggacagcaaaagggagagagagagagtctgagtgtgttagaggaaggttaaaaatggataccatgccaaacattaaattgtagaaatctaccgtaccataggattttttttaaggagtacaattttacttataaaggcagttttaaatttaggctctatcttttaactggacctctgagcacggggcagagtctacacttaatcctggttctccaaaaaggagagatcatgggaataggccatataatatttttacagtacactttgttactaaggcatttctctaagtgtttaaactgtaccctttcttattttaaacacactgagagtagcccccgcccccatagtaacaactatttactgtaagcagctgccatttagccatctctaaaagcatattacctagctgtcacacagaccatggtaaaaaaaaaagttatcatcatgcaaaataatatttgataccctcaaaagctaagaatatcaagtaactaaatgcaaggaagctgagctttagacctgagaagaattcaccaatgactcttgaaactccacagagaaagcagaagacctcaaaagaggggtgtgtggcacctttatgctgtgacttttaaggggtgtgagttattagactccttctcaagatgttttttcacttgataccaaagatggtaaaggggaaaggaggaatagggtagaagaaaagtaaattaaataatgatttttaagaaagaaatggaacagagaaattaagcacgtgttttcttttttgtttaaaaaaacgaaaggtttcagtaaactaaaaaaaattccgaaaagcaagatccgaaaagagaagtgtaaaatcatatatatatatatgtgtgcacgcatgtgtgtatatacatatacatatacacatatataaaggcattatatacataagaactttaaatatatttataaggcctttatatatatataagagatttatatatatttatatatttatagctctcttttctctctctatatatatatagcttgaataccaccttttaattaagctgattttaaccatgggcctcctaatgtatactatatatgtatatacagacacacacatatgtatatacacacatggagagagagcaagagagagggtagctatctatatagagagaaagagcttggatatcagcttttaattaagctgattttaaccataggcctccaaaacaaaaggttgggggggcggggagaaaaagacaaggaagaaagaaaaataaaagaaatcccttcaaatctcctactacataaatatcaaaccaaacccaggctgccttagtgaaaagggcagaatcttatctaccgaactacggtgtgaggtggctgtcattgctgtttctggaagaaaaactggaggtagcttggttagtaaaaggtggccttgctgtagatgaaacccatcaagtagccaaaaaaaaatttttggatcctttttcctggctgtttttttttttttttcctctcatttctttttgcaactgcagagtatttcagcaattttaaaaggccttgttaggcataactcggaactctcattcggatttgaccaagtcaggtagagttggtcaaatctgatgggagaaagactgaaacagcaacaacaacaatgaaaatacagttatttagagctctgatggtaaggagaaattaagaccagcttgttgtcagtctttacttttagtcattaaggaaaactttccaagacaaaactccaaattcatgtacttaatatagaaacggggcccagactgaagactgctttctaccaacatagaaggaggaaaaagctcatacttaccctccctgttgaaagccagctgaaactccggaaaggagctgctagccatccaccatcctggaagcaggaaaactcacttttttaatggaaatgagtaaaattctagaaaaggaattgtacatcaaaataaaccttagatctcaatgaaatttggggagatcaggaattccttggaggggggaaactcccagatctcagcaaattgtcatgttggtttgggcattgtagatagcccaggctagtactaagaaccaataggagttttgtcatgggtcagggtcatctccagtcagagtcccttccattggtcaccaattggtaaaaacaaaaagtatctgagacaggaggtcttaatcaatttgaagtttattttgccagcgttaatgacatgcctaaaaaaaggaacagcaatccacaggaacaatctgtgatccatgcctttttccaaagataattttgaggacttgagtatttaaagcagaaacgggctggagggtcaagagggagggcatggtcactttactcaatccacatgtgaggacttgagtatttaaagcagaaacaggggctggagggtcaagagggagggtatggtcacaatactcagtccacatgtttcaagacgaaaggagcaggtggggggatagtcaaatatgtattcctctccagtaagtccgcactttaggtgagagtagctgcctttggagatattctagctcttaatctgcaactatttgcttaggaataaaagggaaggcagttttttgcatgactcagctttcagcttaatatatcccttttgtgatactcaattgcgggcctaagattttattttcttttcacaaccaccatgttttgggtctcagaaactgaaaactacatgtgtcattcacttacatgagaaaaacagagggcaggggcaaatttggaggagacaattaagagatataaattgaggttataggatttgggatttctattttgtttccagataccgtcaactgcacagatacaaaaaaagtaactacgtagaagatttaaccagagttggggctctgtttctttcttttcttttccttttctttccttttcttttcttttcttttctttccttttcttttcttttcttttcttttcttttctttcttttctttctctctctctgtctttgtttcttttttaggggcgaatggggtagtatattgagaacatgtcaggaagtgtttatacaaacagtcataatatctctcttgggtgaggaaagagtgagagcagttcagggcaagtgagagcgaaaagctgctagggtctatatagtaaaagtctttgctggaatgaagatattagaatgagtgagccagaaaatagaagatgaaattggagagatgtgtctgtaaaattactgtaatgaaagggatgagattgtgggtgatgccatgatgctatatatatggagtggctggcggaagtatgatgggtggctgaattattagcgtgaaggctgttatggaactgagatgcaagagtactagaatgttcaccacattgaaactgataccaccaagaaagtacacactgtgagaggaaggaggcagtagctagatggtaaatactgaaagaatgagcgttgtgactccatgaatataaatgattaccaggaaaaaaaaaaaaaaaggtttagtggactgtgtagattgatggcctaaccttcaaagctggaacttttcagaggatggaaatctgaaattttgaaagcagcctgaggaacaaagaggacatttacctcacttcccagcccagtgctctgaattgtgctgtagagaaaacatgactgcttgagagtacagcagagaaagcaaggtcctctggggagaacccaatcttgtttagaagaagggaaggtttagaaaagatgttgaaaatataagtaattttgctactgactgactgatttcagagagaacagagaaaaaactgtaatcataattttccttgtagtttatctggtaaaaaaaaaatgtgtgtgtgtgtgtgtgtgtgtgtgtgtgtctttgtgtgtgtgtgtgtgtctatgttatagttaaacttttaggttttatttttatgataaacatatcagttactgtaaatcaaaatttgttcacatttctagtaaggtgcctagtattaaagatatttattattttcttttaattcatgaagggtatccttgtgtttatttctaatcttctctgataggtattcagttaaagtattgccgaatacatcaagctttgaccttcaatgaataccattatgaaacagagtgattcaataatattcaagacattgagaagacacttttctaacttgtacaattcttaagatcagaaaatagtgtgaagtcaattcaatcaatacaggatagttgatgaagctaaaagatgttatttattaaatgtaaatctcttgaaagttttttaaagagggaatcaaaatttaaacagtgattataaatccctctacgtttgatgacacagggatacagctgctttcctagtcacctaaggcaggtggtgctttactgtgttttacagagctaaaagaaatgaacatttttctttgagaaagcggaaaagcagatcagaaaaagacttgtcagaagatacagtgattattactactgtttcttatatattcagggacactgtgctcagtgccatacctacaatgaagatcacagttccaggccccaatataatcttcggctgaaaaacaggtggtctaatttgttttattatttaattatctcattaaagaaagaagcaagattaagactatgtgatgtattatttggcaccacagccttaatttcctcttcaatattgtggaaaaatatattttgatgcaatttccatgtcatgcagcatgtttctgaaaaaacagtagataatatacattcttttggaaatattttgccatttctaaaatgatgtatgaaaattagcaatattccatgcttgagttagcagagaaaattgactgacttgagattcggaggtttttgttttatgaaacaatgtacaacattatattatatattgtaggtaaagctaaatcatttaaataatttcctctagttccatgcaacagcaagtaagatgcatagcttttaattttctttgctatgcccagaagtctttaccataatccaattttctcacaacttttgaagtctgtgttaagcaataacatacggcaagtttattccaacgtaggacacagcttctcaaatcagagccgttttaataattattaccaataggaactttgaaatctactgatagtagctgaagagataaagtgatttgtctttaacagatgtgtttcttttaaattattcattttcagaagcatatttctgtataacaggtgcccaaaaattgctgtggaaatatgaatatatttagaagactcctatttatgctaggcatgttgttttgacaattcaagagaaatttctgaattaaaatgaacatcatacttctcaatttctcagaaaaggtagtaatcaagagtatttggtacgtatgatttaagatttaatcttgcatccaattttaggatcaaattttgttaatatatttctcagcaaagagtataatcatcaaccatttagtcaaaacacttgaggatgatgtgacttaagtctagataaatgtattgatatataattctcatatcagtcttttagtatcaatgccatttttaaagtgtgaaataatgctcctgaaatgtaatatcacaacatgatattgggaggacaaatatattcttcttttcattatataaagggcaatttgacaattctcctgtcaaattgtcatctttttgtagatgagaagtacatttttcaagacatcatacttatgccatcttaagaaacaatgtccatatcttagtcaatactttttaaaaacagtttatttcttgctcaagaatattctgcagctgtccaggtgacatatcagctgttgcccatgaggtgattcagggattaagtcttctggaattttttggccttgctatctcaacaggggttctacacactagcagtgacagggagagctcacactgaaactcacacctactccctctctgctgtagacagaaatgacatacgtcttcagttcataatactctaaccacatctggttacatgcatctacttaacagcaaatggggcttgaaatgtaggtgaaaataggaaatatttggtgagcattacttactctgccaaagagggatacactaagtcttaaatatgccaaataacttgtttatagggtacaactaaaaatatccagtacttgatattgggactagttctgtctataaccaaacctacactatttcttgcatagtgacctaccatcatttattggagaatcgtatacatagacaagcttcaattaggttgtcatttattctcatatttgtggcatggccatgtaggccatgaaattatatatgaggaagtatatggggaagatggtaacaaattgtagttctggtctgtaacagatatattcagaattacagtgcaaggttttataattattttaaaaaggtcgtattcaactttgaaatgactcataattttatcaaattttcatagacatttcaaggttgaaatgttctctaagttcatgcagtactactaatgcatgatctcatattacaacgctaccaaagatcttaaatgttctaaaggagtaaaagcagatcatgatcatttggagtgagagacacctgatttgaattccaattgactgtagtggtggcagtgatgtcaattactacatattgagtgctgtcttgggcactgtcattagcacgttacaaacgttattttaattactcctatggagaatcctatgagatagaatttcataggatgccaccataattctctccatttcacatatgaataaatggaggatcagagagattaaatcatttatgctcagatccacaatgagactactgtgcatcatgttatcgtctctaactctgctttattgtcctaaccactacatagcttccttacatctttcacagcatacgtttgaatcttactcactttatatttgtttaggatgttctgtttaaggtacagtttccccatcttgtatctattctttcaaagtaattggtgttcatctcaagatcgtgtttatgacggacagacatcatcttgttagatttagctcatctgataggtaaatccaaaaaactttactatcacctccagattacttctgacaatatgcccctttcatatctaatgaggacaataataatatgttacatttacaaaatactcaaaaattcaacattttattatctcctcacaataattctcatagcggttcctttgatgtccacactattttctttgccatttaactagtcattctttcttgatcataagatctccttcatacactcaacatcgagatatttgagtacctgaaagcttcatcctggttccctttcatctttatttataataacctctccctaaaaggttttctctaccttcatgatgttaattctgttgataagctgaacacttccaaatttgcatctttagcactggtcttttcagtgaactccaactgtctatgtccagcttcttactcagcctaataggcatctcacgtataaatgttcaaaagtgagccctgatttccacctccaaaggtttcaccaaatctcaaagtaaagaattgaaaatgaaatttgtaaaatgttatgtaggcccagagacctagtactttacgtggcaaagagcggtcgcttacaccatgccagatgtattgagatgatcttcaattataaaaatacctgatgttatgttaaagtcacacaactaggaatggctactggtatgagaattaaaagtggttttgccgctttatgtttctaagatgctcctttctttacgtaatcatctataatttgacttcatacattattattcttaataaatatatattttatgataaagttaattgtagagactaagaaagtctgattaaagtataattttaaggtcaatagcagaaaacacttaaacaatatttcccgttgtatacatctttttcgtttttaagctagtcataaaatatattaaaagtgattaatttgggctgggtgttgcggctcatgcctgtaatcccagcactttgggaggctgaggcgggtggatcacctgaggtcaggagtttgagaccagcctgaccaatatgatgaaaccccatcgctactaaaaatacaaaaattagccgggtggcatgcgcctgtaatcccagctactcaggaggctgagacaggagaatcgcctgaacctgagaggcagaggttgcagtgagctgagatcgcacacttgcaatccagcctgggcaaaaaagcgaaacaacatctcaaaacaaacaaacaaacaaaaaaagtaattaatttgaaagggtaaaaactccacagaaaataaaacttcccaaattttcaccaccatagggcaatcaccattacaatgctaatgtattttccatatattaaaaatgttttctagatgagattctgttccatgtacaatatggtattctgtttctgtcagttagttagtataagaatgtttatatatcattaaatgcttgtaaactatcattttagtgcaacatttaacacatgagtaaaggtttattcatgctagaagcttaataataaaataatgaattattctagattcccttaagatgtacttcaactttacaaattctgattgagtcaataaatacttaataaagcatgatgaaagtgccaaatcataatttatttacatgcatatttcaggaatctttttttaaaataaagatttttgaatagtaatttagaacatttattgatgagtctactataaggaactattcgtcttatctctattttaccagccaagatgttcaagtgatgactatatgtcacatatttcatgtcttacagccagtaattgttggacaagaattgaaacctggcagtcagacttcagaaactggtctcttacacaattttaggtcacctaaaaatatctttctgccttctttattttccttcatattcttattttctcctatctctttatctcttcatatctctctctctctcatacacacacaatatataactttttctaattcatatcatttatttaatttataaatatatttatgttagcaaaacataaaaattatctaaagaggacactgtatacagtgatgtgttttcctccaaagctctaatttttcactcattgaggatcccccactcatgtcacagttaactattcagtaatgtttgtgcatcaatccagagtttttttatacatatgtaagttcataaaaatacatatatacctctggcactgttttccagcaaatcaactttacacattaaatggcctgcttcaggaccaagttaactctcagcacttacacacaaagtcaaaatacagtgtgcaagtcttcgatgatgttgtgacgctatagaactggtgatatgtagtgaacaaaataagcaaaatcacacataagttaaataatttctgattttaatgaacactatgaaataaaaatagaagaaaatgggttataaagtaatatgtgccatttatcttttcgatagagtgacctaaatgatgaggattacacatataagcatttgtataaaaaatgcccatgggagagaaataagctcatattaaaaggccaaaggcaaaaacaaattctatgtaatcaaggaacttaatgtccagtacggctatagcacagactgttggaggagagcagagaaggaatcaggaggcatgttaatgagctagttcatttagatgtgtagatctctgtgtgtgtgtgtgcgtgtgtgtgtatatatatttaagattttagagaggaaatatgcactgtgaatctaaaaaaataacgttaaaaataaacttgtacacaaatgggctaaatacttagcatttagaaatacatagacaggcgcggtggctcacgcctgtaatcccaacactttgggaggctgaggtggccggatcacctgaggtcaggagttcaacaccagcctggccaacatggtgaaaccccgtctctactgaaaatacaaaaattagcctggcgtggtggtgtgcacctggaatcccagctattcaggaggctgaggcaggagaatcgcttgaacccggaaggcggaggttgcagtgagccaagattgcgccactgcaccccagcctgggtgacagagcaagactctgtctcaaaaaaaaaaaaaaaaaagaaaaagaaaaaaagaaatatcacaaatttgtatctaaatctagatatatatttataagtatttttagataagatacatgcatcttgccgctgtccaacaattaagattcacaaatcaatttatgcaatgaaatacattagtatttggtaatggagaggaaatagtatttaaaatatacataaaacatttagatcaatgcagatgtggttgtaataaaagacaaaatgtagaaaacaatatggatcattcgaataaatcagaaaaaatggtaaatgttaaagcattaagatgattgaataccataatgaatgcattagtatttctgtggttatactgaggatttaattcactctagaacagtttcttctgttaaaacagaaaacattccttcacatttttttctataactttcaataaatgaggataattacatttagaagtgatttatcttagtcagtactcttataaattataccagctaatttttagtgaattaagtttattgggatactgctgagttaaaagggatatattttgctgttgaaattttcttattaagttaatgacttcttgtacacctaaaatgacaactggaattattactaacatttaaaatctgaactgtttggtttgaacataaaatacaatttcttgtttatttgatttgacctcctataatttaaaaaattatatatataaaaatattattaagggaatatttgtataccattatacctaacacaaatagtcaacttaggttgtctaatccactgtgctttctgcaaagactttcagaattatttgtaggttacctgttcagatagataatcactagttgggcaagattgttaaaacctacacaagattgttggactttggttctctgatgactttgtccatagccttgtgtaacatttcttcttcattcttttccattcttacataacttttttttttctggatgcttaatatttggcaacatgaattgatgatcttaaaatgtcagcaaaaggggaagcattatgaaggagcaagttttgaagtgcatagatatgtccaggcttggaagtcatattctgttggtgaaaatgtaatcccgtgatcatcacactaaattgcaagggaagctgggatacgtaattagctgtgtgttcagtaagaagagcacactaattacggtgaactgattgcaatctcctacactctagatgatatcataacagagctggtaagacaatactttggtttttaaaatttttattattaacattatttagagatgagggtcttgctatgttgtccaggttggtctgaaacacatagcctcaaggagtcctgccactcctgcctcccaagtagctgggattacaggtatgagccaccccacctggaaatactttgtatttgatattttaaggttgaagttgtgtgagccttgcattttctctttagcaatcaattaacaaatcatgccttaactctctctaaagagcgtcaaaatattgagaataatttctgattagtataatatttagtctagttacctcatcttaacctcttttaaacaattacatatgggattcccttttgtattgcttttaatcttaactactttatacaaacaataaaataatcttgaacattcaaattctcctctgccctaatttttgtctagatctttcctagaactttctaacatatgttagaaacacccccacgttaatatactagcatctaaaactgtctcagccccttgcactgaacatgtgaataatgttctggcatagcctatatttcctccaatgtgaaactgcaaaattctcagctcttgtttgaggggcagcctcaaactagcatctccttcttccctttttcattgatgattggatttggttgcaccaaagtaacttatgagaggttgactcaaaataggaattgatgcattcagattgttttctcaaaaattaaaattgtaaaattaggagtgaattaagcatgtggatattaagagtcttggccatattagtaactctaaaacagtttggtaatcttacagcttggctcagaactctttttttttaaatgcattgttatgaaaaggctaaagtcttcaaagtcatttttaatatattttgagatgtgactccatgcgtttccatcagtgtccagcccatctggactattggattgagatctggggttctctgcctccgtactattgataagaatgagaagtgaattccaggaaaataccctgtgttatctctccattaaatcctgagttgtaatctcctccaggatgtttccctgatcatcctaagcagaattgctctgctaccttttttatggcattttcacatttgttgtagttatttgagtgcatgccttgctaactttgttccatggaaagtactggactcatttagctacccatagctatgagggctatatatattttttttttaagatggagtcttgctctcttgcccaggctggagtgctgcgtgaccttggctcaccgcaacctccacctcccgggttctagcgattctccctcctcagactcccgagtagctgggattacaggcatgtgccaccatgcccagctaatttttgtatttttagtagagaccgggtttcaccacattggccaggctggtcttgaactcctgaccttaggtgatccacccaccttggcctcccaaagtgctgggattacaggtgtgaggcactgcacctggctttgagggctgttgtttaagtatacctgtgttaatcaaagagacagagtttttgtggaaattatggggacagagctctagtgtttttctatcagcgtgttttattttaatcttgattatttggtgtgactctattcgtctatgtatgcttgtgaatacgcatgaatatgtctgtgactcctgcaataaaggctagaacaaagacatataaaaccagtttcttgaatttgtaaaatccatgctttagtttctttcccaaatcctgcactttaaacctctatggtaaaagaaaaaggaagcagagatgatattataaccagtaatgagaaatctgtggcctgttccaagtctgtgaacgaagtgatacaaaacatgactactgagaatagttggaaattgatgctgtgggaagggtaacattcctggtaggaagcggatccatgtggatggcactgtgattggccagacttatacatgtctccttgcctatattgatattaagactttccaaatttttcttactttatgatgtctagcactgtgttatttatttagtaagtattcaaaaatagttgaataaagtgataaaataattcacaaaagaattaatatttgagtgtgaaagtgctttgaaaatgaaaaaaataaacagacaaagatactggatagaagaaagaaaaacaaggattgaagtcactagcgacttgttgaataaaagactgtctggatctacctatcaaaatgctcagacaaatgaaaacatggaaatattttctttgatcctaaaacaggtggatctgaattacaagccatccaagaatggttagctcctgccctttttcctttttatctatgtgtaattgtgaattattcagaaggatgctgcatggtcccaaatgaattgttgttattgatgttttattatgtaaatatttaaatattgatttttcagaaatagtgggtagcctgtgtacattttcatggtgttttgacaaaacgttgcaataagtgtcatgagtcagtttttgctgacagtccaaaccagaacgccatgaaaaatgcaaactgatgtcacttctcatttgtaaaaggcttcaaaattatgaattcataaatatttaatagcaatggctcaaatagaaatttgctctgttagagtatacgactgcttgtgcatgcagcatatagagctatgctttcctgagacagtgctacctagattacaaattagaaataagatagtatcaggtggttttctaggaagtgggtcattggctggtgacctaaatattgtacttaaaatacttgtttatgggtcattaattttaccagtctgaaacagataggaatgccagtggtgttaaagcttttatgatttggaacacaaagaagcaggactatttttgaatcttttctattgagactttcagtaactttattgaaaatataggtgggtgccgtggctcacgcgtgtaatcccagcactttgggaggccaaggcagctgtatcatctgaggtcaggacttcgagaccagcctggccaacatggtgaaaccctgtcactactaaaaatacaaaaattagctgggtgtggtggtgggcgcctgtagtcccagctcttcgggagggttgaggtacgagaatcacttgaacccagggggtggaggttgcagtgagccgagatcgccccactgcactctccccttgctgacagagcaaaactctgtctcaaaaagaaagagagagagagagaaagagagagagagaaagaaaatatatcatttgttaattaactaccaataatttcctgaaaagtcatattaagtcagaggttatttgtcagaagatagtactgaaaatgaaggaaagaataaagaaacaaaatacacaggcttctgtgacattgtgatgtttaacaaacaagcaaatatcctagttaaaaatgatggcatatgtgtgtaaaatagtgaagagctaaaatgcccaatctcactatgtttacactttctgtgcacgttagtgagaaaaaaagtgtaataacacctaacatacatttcttcaatgattatctatcctttattcttgtataagcagatacaaaatctactgcttacttgccaacattacttcagagggacagaaacttcagtgtgcctatttaatcatatcaccttaatcttcttttatctgaataaatacttcaaaagtttgagtgtagtatagatatacttacatacatatatgtatacatatatatttggcctgtgtgtatatatgcatctatatatgcaaatatattgcctaactagctaatctttatatttttaagatcatttatatgtacacatagtcaaatctagtcccacctcttttcctacaggtatccataaataaagaatatcaccatgttgatactagagagttaatacagtttttgttttaaattttatgtatgtgcctgaatactcatatgatcaaaatttaatcgggaaacaattagttaatttgctttatagtttgtggttttccaccttatgggataatactatatttatgtgtgtgtatttatatatatttatatatacatttatatatttatatatacacaattatatttatatttgtatatttatatatgtatatttatatgcatgtgtataagtgtccctatttaatcatatatatagcttatatataaataatatatgggtgtggtgtgtgtatgtgtgtgagtgtggtgtgtttgcatacatatatgtatgtatatatcctccttttatttttattcttaagagttccatttcacctcagctaatgaggtagagtgttagtcacattggtggcaataagtaagtttataataaatactactttttatttcactagaaacttttcagagcatttatggtgcctgaatacacaatacttgtttaataacagttaatttccttcatttctcaatgaataaattctctgttcaaatggcgcctccagtttcttgattgtgtatcatattgtttgtagcaaacatttattcacacttacttagtgctgggcatgtatgtacatctttactaacattaatttatctttcccatatgtaaaagacaatttttcttgcattctttacattggatttactctctttttattctatcctcaaagagtcaggatgttgctggatggaagaataagagatgttaactaaggaaatggacagcgtcctctatcttccattcactcaaccattttcttttttatatttcagaggacgtaacattatttaatatgtggttcatagaagttcccctctcttttaaagtacttccttagggccgggcgcggtgactcacacctgtaatcccagcactttgggaggccgaggcaggcggatcacctgaggtcaggagttcgagactagcctgacaaacatggtgaaactctgtctctactaaaaatacaaaaattagccaggcgtggtggcaggctcctgtaatcccagctattcgggaggctgaggcaggagaatcgcttgaacctaggaggcggaggttgcagtgagccaaggtcgcaccacggcactccagcctgggggagaagagcgagactttgtcattaaaaaaaaaaaaaaaacaaccaaacttccttggatttgtagaatcctcatcctcatgttcttgattactgtggctgcatcttatcttagtttccctctgcctctcagattgctcttatacagtttcctttgttgatttctcttattgctggattttagctgtggacatttttgaagccttggtgcacattattttctttctgtgacattttatcttaagatctcaactttggagaatgtgctattgatcacaaattataatttagattctgtcttttcttctgggtctggacaaatgttcttaactatcatttatattttcacttggttagttcagtatcacctcagttttaataaatttaccactgattttattatgacttttacctgcaaatttttttcttccaatccttctatttcagtcagtaaagttattggcctgcaaataataaagatgtaaagttagccttgaaataaccttgtttttattattatctttcacttttatgtttagtcagctaatctggtctgtatgctaaatgaatgtgcatttgaaaagtgatttatagaagcaaggttttatccgaatgaatacaatttattttgcctgtagtcttctttacattgatatttctgccaccaaagatctcttgcctattaactcaataggctatgtactctcttagctgactttcctccttaaatatagtcaatacaatttaggctagtcctcctcataaggttgaatggacttcattcccaacctcagtaatttctagtacccttccctacttcttagcctggctttcaaagactggtttattcagaatgtctccccctatttttctgggcttacttggtctggctcttgtatttataagctttttcatgttttgaggcgaagggaagtctaagcctctttgccccaagcctactgttgttcatagtctattttctgggctgtaacaaagggagaagactttctaagccaaacaaacataagcttagacatcagcattatcacttactgacagactgattagccttgataaattacttaaactctgaacttcaatttcttcatttcttaaaaagtgataattatatctacctcagagaagctatgtagggattgacattcatgtatattaaaaatatgctgctgtttagaatgtttgctataattattctctactgcacaacttcagagtaaacttaatgttttgttttaggcacacgatttttcatatttattaagcacttcttgccagtttgtctcactgaccctttaaacttaaaaaaacagtatcttaactatcctcttctatcattgtgagcatttatcacaattctgaaaatataagaagataatagaaatcaagttagctgatttcaacttctagatttactacttaacagccatacaacttaatgaagttataaaaattccctatgccagtttctttatttgtaaaacagaagtaaattttgtaactcaagggttattgtacatattaaagtaatcaatatgtgtaaagtatttataaaagttctagttatggccaggtgcagtggctaacgcctgtaatcccagcactttggtaggccgaggtgggcagatcacgaggtcaggagttcgagaccagcctggccaacatggtgaaatcccatctctactaaaaatacaaaaactagctgggtgtcgtggtgggttcctgtagtcccagctacttgggaggctgaggcaggagaattgtttgaacccaggaggcagaagttgcagtaagccaagatcgtgccattgcactcctgcctgggtaacagggcgagactccgtctaaaaataaaataaaataaaaaagtactagttatgtggaaattgcacctcataaatgtcaattcattattgtagagaaaatctctaaaattagcatgatttgcttgaataaattattttataattacattatacatttattgtagagttatataatagtaagttaacattatatatatctatatatttgaatttcatcaaatttatcgctaaatgtgttacagaaacactaaacatgcaaaggataagagggctttcaaaagtcatccattgttggaaaaatataactgagaagcatcatgcagaattctacaatgaataatatgaaagacccacaaaataataaataaaattcttgtgtatagtacctacagaaaagcagaaatttgtttgactacattaataagtttacttgacataaaaaccatgggaggctaaaaactgtcaatacattctgctgctattagctaatgagtatatcatgcatatgcactattaatcattagtttttcaaggaacttgtggagaaaagtaataaaataaatagaaaccaagaacagtttagaaacctttcgattttataaacattacattatttatctagttaaagataattatgttgaaaaaggtaaaactgcaattttttgtgactatcaagagtaaatccctaccctaggaacctgcatttttcagtttcatgaaattctgcacctgaaaatgcctagggtaaagatttactcttgttgtattatagatgtggaaattgaggctcaaaaagttgcataatttgcctaaaattgtacaattgtttttattttattttattttattttattttattttattttattttattttattttattttatttttgagacagggtcatcttttgttgcccaggctggagagtggtggtgtgatcatggctcattgcagcctctgtctcctgctggactcaagtgatcctctcaccccagcctcccgagtagctgggactacagatgcataccaccatgcctggctaatttttgtgttttttatagagatgggatttctttccatgttgcccaggctggtctggaactactgagctcaagcgattcgcctgtcttggtctccaaagtgctgtgtttacaggtgtgagccactgcacccagtctacaaatgttttatataacaattctcaactacctagcatgagcttaccattgtgttagcaaacagaaagaggaataaaaaactactcgtttctttaaggaacttccaattgttcaataaactttttaactcgttttcagaagtatgttgaacatgtgtgaatttttctaacttcacagaaagttcatggataatgatcttgaacattattttaatgctgacttaaataaaagccattagctaaatagatattgagttttaatcttcctctgcaatctgtttccctgtggaaaaaaaatgaaaatgttaaagaactttaattgctttctcaaaacttatatttgtatggtttgaaaattactcacaatatttaaaatgtcctttctaatatgaacaaataatacttaaggagtttgccaaatttgtgtgccattactcatttcagttagcctttcctaaataagaaaccatctcaccttactgccttgtaaaaataatttattatttctcatgattctgtggattagtggaggttcttctgctgttcctacatggactcactgatgttggtagcctttagatggagggtcagctgggaactggttcaacttggacagctggtatgtgtgggtctctctttatctctcaaggtggccccaccaggttttctcttgtggtggcagcaaaatctcagaagacaattccccaagcgcttataaaacctctattggtctactggtatcacttaggtggatgtccatttgactaaagcaagtctgttggcaaagcccagaatcagtgtgggaagggtctatggtcatggatgtattttttgctctacattattctactgaccaaattaagagatttttaaaataacaattctggaagggacagtaaaaacccttaatatttttttgatcgacaaactgatgcacagaaaaaggtaattgcccaatattaaagtcaaattaccagacagctagatttaatattaggccagttacaaaggctaaaacacttttagtgttattccccagtgtttggggaaaaagagttactgaaaagagctcatcatattactttagttaagaaaatgaagatttttcagtaatatttgaagaaactcagagaataaatatttctcactatttggcaaaaagtattgctggtagaaatatatatatatatatatatatatatatgtttgtgtatgtatgtatatgtatacacatatattgtgtatgtacatatgtgtgtatatgtatgtatattgtatagactgtctgtcctcattatgcccagtaatgttctataaagactgtgatgtccccacaaacactgaattagcaaatactaagccattgtccttaggggaagaactatgtatatagttacatgtaaaagatgataatcttaaatcttaaaaacaactcatcctagtagattctatttccttaaaagaaaacaaagtttaaatgtgttcagtcatttgcctgaggccaccccactaacaatgaaagagttagaattcaaaccctgcctaactaaacccagtccagaccttattgcactatattgtactgccatctccatcccctggtcatctcagtatgagagctgaaacaagaaggcaagttttgttctgtttaacctcagttagataggtgctcttgcattgaagcaagttttttttttttttttttttttgctcttctgcacatgtctgaaagggaaagggctttgagtattgatttttagggctccacataaatattagcaactaggccaatttgcaaatacagaatctgggaataatgaagattgactatatctaaataataagaattattctaatattaatgtactcaatggagcaaagataagatgtgtaaaaggaatatgataggggagtcttaagcttaccccatttgtgatatatccgacacagtttcagacatttgtctctgtttttcatacctaatcaaagtagggttaatttatggaatgggttgcttctagggaaaggagtaaacagattgtactcagtgagacctgagattatagcttaaagtcaagagaaaggatggaaaattttaaaattaggtaaattactatctaatagcaataacctggaatcgtttcttattgcaaatagttgttttcatcccaatattttcttagaataacattgagcctgagcagagtattcacactgatgaccccatgttacattatacaaaagttatgagatgaaattcacattagccgattctaagaactagggaggggcaaaaaaatatacaaatagtacatcaaaatattacaaatggaatgttattgggctacacaatgaaaaatgtttctatttcaaaattccttttaagtgtattctgaaatctcagaagtttcaaataatgttatcaaatggaaaatatgtagtattcactacaaatgagatttgatgagtgacagagttttcttactgatagtggaaattatttttatatgttagaaagcatcataagagcagaattatttttttgccgtgtctgaaggattaggcggtagacataagaaataaaattatccttacagttgatgtaagatatttatgaataatattttatttatcttttaaacatagtacctagataaaagcctaacatgctgtatacacactttctttttattggaactaaattagttttggacacataatcttcttatgttttaatcagtccgtggaatgaattttgcatttgaatgacacattgttcttttaagtcacaagactcttcacaattaccttgaaagagtaattcaataaatggtgccctaatggagaaacaattaatttccttctaaccattacatttatttgttcgcagaaattgctccgaagtacaaattgctatgtgttcaaacttcacagtaaagttctaatataattttataaaattaaatatcaatttttcatagaactttagaaccccaaagtaccttagagattacataattcaaaattccttgaatttcaaatgatgaagccaaagagcaaagacgtttgctgacttaattcattgatatggtatatattagaaaataaatgtatactgtaaaatactgtatacaattgaagtaatataattattagttttgaaattcatccaaatagtgtctcgtcagcactaatatatatgttagctcccagtccaaagtccttagttctatgacagtctgaattttctcagctaaagaaaaaattgaagtttatatctaaacacaggtgttttttttttttttttttgggacggagtctggttctgtcacctaggctggagtgcagtggctccatcttggctcatagcaaactctgcctcccgagttcacgccattctcctgcctcagcctctcaagtagctgggactacaggtgcccgccaccacacccggctaattttttgcatttttagtagagacgaggtttcactgtgttagccaggatggtcttgatctcctgaccttgtgatctgcccgcccttggcctcccaaagtgctgggattacaggtgtgagccaccgcgcctggcctaggttttaaaataatcaccagtttgtagaatgtccttaagtattgtggtagattattatagttctatgtacgaataagtcatttccatagcagtatctgaatcaagaaaatgattattatgggaaaattacaaataaaaagactgggtcaaaatcttaaattatcaggtacatactttatgccaggtagcatagctaaagaaaagtccatatattttctcatctaattcataaaacaatcatgagaaatatttagtaattttcctcatcttataaacaaaaataagaaatatcatataacgttgccaatgtaaaaaagctaagaagtggcagcacctgggttcaaaaccggtgtgctgtgctgttagtcactttgtaaggcatttctcagattcaaaatattttacctgtaatgttttattttcatatttcggttagaacctgtaaaagtagcactaaaaagtactctagatatagtaaatataagccatgaaattaggcccatgtttgattaagatattgatgaatcatattttattcatttttttagacatagtagttagagagaagcctaattatgctgtacatactcaatttttactaatcgtataacaattgaggagaggaaagcgttggagaaagggaaaaaacttgtagagaaagttgagaacagtgaatgagaaaatacctgaagcattttctttaattcataactgaaaccatttgctgtgaatttccaatggtagagaaaactcattaccagatgaatatttgctttagggaatggaagagtgaatcatcaatacaagatttcttttgtctaacagcttttgtaaatagcaaaaacaaccaaaagataaaaacaagtaattttaataagagtaaccaaatgcaattatagcctaaacttaatacaataattttcaaaatttatgagcgatgaaaaaactaaagatcttcaaatgaagcaacaaaaccttgaaaattatttttgctaccctgaacctgaagataagttaactgagtttgtgtccttaggttcctttttatataatggagcaaaatgggaatgtatatctgttaggaagaaattagaaaaatagggaaaatgtgcaaagggaatgactgccttcgatataagccaagactgcagggttgcccaattatttgaataggtcttgcatatctcctttgggaatgggatgcatcttcaagtagtatgggttgcagtatagaaatactaagaacttctaagaagagggaaaaaagcacaattattcaattaaatgacatatatttcttcagttgatttagtattccaatcttcactcaggccttagaaagataaataaaatatgaaatacccagctctaaaatttattctaaattgctaagattaatagataacaaaagaaattgcccacagtgtatttgccccaaagaaatgtctgaacaatttctgaagacagcataatgaacagaaaaaatatatgaatagtcaaaatataccaataaaggaggggaggagaaaaacaaaagttgaatataacaagggagaaagatactcagctataaaataataaaatagataaagggtaatgatatagttgggctttgtgttcccacccaaatcttatcttgaattgtaatccgtataattcccgtaatccacatgggtcaagggtgggaccaagtggagataattgaatcataggcccagttttccccatgctgttctcataatagtgagtgagttctcatgagatctgatggttttataagggtctcttcctccttcgctcggcacttcttcctgctgccttgtgaagaaggtgccttgcttccccttgcccttccaccatgattgttaagtttcctcttgatcagtagtccaacgctttacctccgacctatagcccctcctcatgattgtaagtttcctgaggcctccccagccatgctgaactgtgagtcaattaaacctctttcctttataaattacccagtcccagacaattctttatagcagtgtgaaaacagactaatacaggtaattatctcagttgttttgctgtgtagaaatacctgataacattataaatttttaaaaatgtaacaaaattggtactgtatggattggctatgaaggatactgtggaacaaagttatatcttgtataaatcacagtctatctgtgctctgataggaaatctagtagcctcccagcaaacaaacagaaaatagttgacacagaagagtagtaagcattgagccaacacaaagccattggtttgtttggttggttggttttggaaagaaaatgcactgcatatagaatctaaaccttggcaagggatgagtggtttttcttaacctgagacctcaaggtaggccagtaacctgaaaggtgctcagatagtcacaggttaataggattatttggctcagggagaagcaaatgcaaatcctctctgcagaaaactaactccaaagttggccctcaagatgctcacacacaaagatgaactaaatatgatcttaaagtgaaagatcacgtggttctcaaataaattagctacaatgagtgacagttggcagaaactacattcagaagttttagtgtccaatcccaaataattttagatattgggataaccattaacagtatataaaattttgacattcagtgggcaactagaaataaaagaaatttaggagagaagaatgtatgagtgataaagatttcattttcctgaaaaatatgtagtttttttttttaaaaaaaacataagaattatttcaaaaagaaggaataaacaagtatgcctggggcagatattgaggaataatcagaagagtatgctgttgtcgaaatcaaattctaagaggaaagttgtggtcaatagtgtcacggagtaaaaactcaaacacaggcaggccaccaaattcaatactgaagtcactttaatcttcctttcttgtctgaatgctctgtgcagaggttcccgtacctgccaaccaaagcagccgcagtaggaattgtatgagaatggggaattactgaattttcctttccaaaattactgatagtaagaagaaaagggaaaaaaagcatgaaaaattatatatattattccaagccattagaggaaattttgatgtcatttaggcgtaatattgctttgctctgtaaatgtgtgatctttattcgttagtcctatagcatcttttcaagcccagtatcttttacttttattcccaaaggatagttgtggctctacctattgcccataagtagttgccaaaacaaccaggagctctgtcaacacaggtctttctgtttcagaagtcaatttaaggcagaaagtcaataccatagtttctaaagacaattttcattgaattgcccattgctgacgtttttcttttcaacctcttttcattcggatcgatttttaaactcttttttatttcaaaactctcgaaatgaaataattgcattaaattggatgcaaacttttctaaaactgaaaggaaaataaatatgaaaagtcaactgagagttcatttaaaaggatcatcaacccaccgacagaactgacatttctcagagaaaacgtgagaatgttttaggtggttctttaggtggttcaccctgacaaaaattgaggaaaaatatatattgctaatccattacctttggatatcatttctggagtatgaatgaatgttaaatatcgaaaagtaaaacacattttaaatattaaggacatcttgtagagaattactgagagaataaatttttcccttatgtgcagtgttatctaaatcaatctccaggactaaactgtcatgtttctaagcaagggattcaggagatctaaaatgacagctttaatttaacattgtgacagaagagttcatctcaaaaaaactgtagacttttcttgggcctacatttttctatgctgcctttccaactatttgttcttttaacatttgagattgcagggctaagttttgttttaatacctactgaacaacgacaacaacagaaagcttccatggtactaaaccacatcagataaatgactgaatatgcctaattattaatatatagcaatatcacctctgaagtacatattatcattttaaagttgcaagaactaaattttagggcacattctcaaagaatatgactagatattttaatttaaatattttaatgaaagtagtacttgactcattttgtgtattgaacaaatgtttgagtatattctgtgtgtcaggcaacgtgatagatgcttctgataaaataaaaaagaagaccagcaaggcccttgccctaacagaatttaaactctaatcaattatgaattaagaaattttctgcaggtttccaaagttatttggaatcggtagataatagtgagagaatgaatgaacataggtgtatataaatatatattcaggtaatgaagagtcattattccaccaatttgaaaatattatctgtctttagtatttagctacaatctacaatctatttacagttagctggtggacaaatatttatgtaacctccctcataatgaaaaggaaactgtactaagtgctacaggaactattaaaaggaagaaagatgcagctctcaggggacagaaatagatattatattatgcatgaataatacaagtagtagctgtcaatagaatttaaaggaggaagctgttgttttagctgggatgatcagagcagttttaaaaaaagaaataggatttgatgtgtctccttaagaatgggtagaatttcagtacttggagagaaaaacaatagctgtatgtggataaaaagaaggatagaaaggtattatttcccctaaaagttttatattttgtggatgagacaaaaattaaacacaaatttttaacaggaattttgtaaaattacatgtttccttgagtatgtttaaattgaaatatgtttttaattatcagtttaaatagcgttaagatgtataatttttaaagattcttaatattgatattattaaattagattgttatattatttttataaatatggccaatggaattcaaatgcattagcaacttggtaatcacttttatgtattttttttaaatggtcatgtttaacagtcagaaattataaattatttttctccatgaactcaaattttcacttcacttcccgctgcaggattttagattaatgtaacgtatttcattcttgaaattcttttgttgacatcctacattttcatggttctcagtaattctttagaatttactttgaccattggactccaaatcttaatacttctgaattatataatcattatgagtacacaactgatcaaaactatatacatttatatttaaattgtgacaaattaataacaaagtattatttgtattgcatctgttaatgagataaatgaggcttatttagctaatttcagtaccatggatcaatattaactattgttaagaaaagatatgtatcagtgttaattctatccttatttttttataaatgtgagtgctgagaaaaattatttacacaaataagtaagtgaacataaaaagtgttttaaaatagcaatgccacttaactttttgaaatccttcagtgttacatgttaaaatttgatagagatttatcatcaaaagtcatttttagtaatcaatcagattacactcagggctcacacatgagaattgcgctataaaaagactcaagatgttgagaggtaatgcatttcttctataaaatataaaaacaatatttgtaagagaaagttaattgggaattgggaaacggtaaaggaaaaatctatatatctattatggatttgttatcatatagactaattttaggaaaaaataactgtccactgatgctctgaaaaccgatttccttaaagctattcgtgccaatacataaagtccttgaaatgcctttctgaacccaagcgaatgcccatacttgagtttgaagcccataagaagaacatactatggaaccatatagccttggtatagtgagtcatttcaagagaatgttagtgaaggaaaaacctgaagtctggggaactgagcaaataaagtttgaattaggaggaagagtaattctcaagacagcagtgattgccttggaggtctagtagatgagcaagaaccttatgtactgtaagaaggaattgcaagaagttttgtgccatctgaagtagagtgtgtaagacagagggcgttgaataatgaacctagagagctgtttggaaacaaacgaagtcagctttgtaagttaggccatgaaatacagacttacctgtggacagtggtaaactactaaaatgtttttgacagagttagttattttgtttttgtctttttaagaccttcttggggcaataaggaaaatatatcccaggggaatatgtgataccaggaagatcttttagcaggtgcttggggtgaaaaagaaagaaatgatagtttcttgaaatgagctgatggcaaagaagatggaaacaattaagtttgaggactatgaaggacataaaattgcccaacatgaaaattaatagtggggagtgaggaaaatgaatttttttctaggtattattgagaagtcaaaatgagaccagatatggagctttggatttaagttgaatgaatagtgactctcttccctaaatatttggaaacatttgaaattttttaagtagtaagactaatatgatagaaatggcattttatgagcattaacattattagaatatgccattacaatggaagagtctggaggaagtgagtatatctttaactgagactagcatgaactatgctgcatgcaaggaataaaaaggacagttttgattcagtgggtgttacaaaataaagcatgaaatgatatgaactcaagacttcaggaatatatttttttctattttaattatgtgctggtcactgcctttgcacagagcaacgaacaagacacctctgtaacctaatgaagcttaaggtctggtggataagaaagcaatgaaatatatatgtgcatatatttacaatggcaatgtgtcttatgagagaaatattaatactagttgtcatgagaactggtaacaaaagggcttaaatcttttggagaagtgagaagggcaattaaagaagtaaaagaatgagatatctggagtgagacataggctcaaatatgccttaagtcataacaaaaatagaaggagctagtattactagacacatggaaattaggagcagagattattttaaaggaaaaaaaactgggtgatttagttttgttctgtatgaagtgatattagtgggtcaacatagaaatatgcattagatagttggacatggaggactagagcttaaaaatagatggaatgcgggtgtcttccaaataaagaatgtcgtgctaaaccaggacatgcaaacatcagaaaaaaatataaaacttttaatgtaaagcaatagaaattatttaaaaattatttcttaaatagaaattatctcttaaatagaaatttttaaagaaatatttaagaaattatttaagaaatatttaagaaatattaattatttaagaaattatttaagaaataattttccagtaaaatagatacattgtagtagaaagcacatttctcatgagttaagaagtactgttaactttgttttatgtgtccaaacattgtatttttccattattttcaggaaagacatatttactctctttaaatatcagaaatattgcagtaaacaaacacataaggaatactacaaggaataattcatttttttacaaagtttaaactttaaatcaggaaattagatacatcttgtgaagcttaagatattgagaaagaagaattagaaggtaaagtaaaagacatcctctggccaacacgtattaactgactggacttaccctcctgcctaaagcgatttttaaaaactttacgaatataagaaccagtgattttcagatactgaaaatcaggaaacttgaaacagtgaatcctgaaagagggaaaagtcgaattctcgtaccttgctagtgagagtttaaagtgatatagtcactttggaatcacgttatcaatttcttacatagtaaaatacatatacctcccaaacgatccatccattccaatcataagtcttcattcaagaaaaaatctttaaaatgcccatatgaagatttgttgaaaattattcattataacaagtttatttgtaaaggccaaaaattggaaaacacctaaaagctcatcaacaggtgaatgggtaaataaattgtatccacacaacagaatattactcagcaataaagttgatgccctcaaaacatatatgaatcttaataattatctgagtaaaataaaccaagaaaaagtggacatattgttggctttatttataaaaattattttaaaatgtagatgatatatagtaacagaaagcagatcagtagttgactgggattcggggaaggtataagtaggtagaaacagaagggcaaattctaggcaattgtcaaggtgtatgtttttgatgtgctactgacattttggcaggataattctttcttatgcaggtaagaactgccgtaggtttgtcgtttctggttttctcctactaaacatcaatgttgtcattcacttataactaaaataaatatttttctctatattttcaaatgccccaagagatcgcctatgaagaccaacaaggatgtgaggagaaagtacagcctaattcacctaaaaaaaatctgtagaatacccttggaattccttgaaaaatttgaaatgttttttgcaagaatttgtttaataattagaaataaacatttactaagaaagcattgatattgcttagttccttgggatgttcaatatagtagtaaatttctgactggagctgagcctgtcaaaagttgtattctagtattctaatcctagacgcagcattgtttgattagcatttttttttctgattccagtttcacaaagtataaactcttttccatgtctgaatattctgctaaagtgctaacactttcaagaatgtgctaccctctttaaaatgtgcaacttttttttaaaatgtagaatttaaaatagaattgtgttacaatatcagattatgtatttatcatgatcataaagtaaatgtgttttcttcaaaattattttttgttttgaggcatttttaaattgatgcctaaaacttcaaagcatgttctatttatgctattcaatacaataacccactagtgattagtagccattgagtactggaatagtggctatttttactgagaacctaaatatttagtttcatttaaataactcagtgtggtttgtggctaccatattatacagcgcagttctagagtgactgggaaggtataacataaccattgagatttacatgatcactctctgtattaattctactaaaccactgactctatttttaaaataccctagacacattgaaattaggggaattgataaaagtttgtattttgtattttattcagggagaaagagaaagaaacaagaaacaatggcaggaaaaaatgtgtagattgtcctttttctttcttttttttctttttttcttttcttttcttttttttttttttttacatttttcaacatactccacaagttggcaaaaatttctagagagacttcttcaattgtttaagtgtcatgaatgagcattatattgatgtgccctggaagaaatattagctcaacaggtgttcactactgtaagttgattcttaactagtcccaaccagtatggtgattaataatgtataaatatttgaagttaattcatctttttgaaaaacaagaccgtaataatgcctttgtcactcagcaaagactggagttaacatcctccaaaagagtccggtagtactgaatacgcccgctcccttgctaacacctgaaacctatactgtaattgtcacttactggctgctacctcattggtgaattactgatttgtagattaggactgcaggagtaggggaggaaatttcaactagaaaatgcaatagcttcggcacgacggctcatgcctgtaatccctgtactttgtgacgctgaggcaggtggatcatttgaggttaggagttcgagaccagccggataaacacggtgaaaccccgtctctactaaaaatacaaaaacaaaacaaaacaaacaaaaaaaattagccgggtgcggtggcacatgcctgtagtcccagctacttggaaggctgaggcaggagaattgcttgaacacaggaggcggaggttgcagtgagcagatatcacgccactgcactccagcctgggctagagagcaagactccatctcaaaataaataaataaataaataaataaataaataaataaaagtaaaaaagtccaggcgcggtgactcatgcctgtaatcccagcactttgggaggccgaggcgggtagatcacgaggtcaggagatcgagaccatcctggctaacacggtgaaaccccatctctactaaaaatacaaaaaattagctgggcgtggtggcgggcgcctgtagtcccagctactcgggaggctgaggcgggagaatggcgtgaacccgggaggcggagcttacagtgagccgagatcgcgccactgcactccaacctgggcaacagagcgagactctgtctcaaaaagaaaaaaaaaaaaaaaacaatagaagaatgaatgaaaaatccaactttcagtgaagaattgaactcattatacttaaaaaatgtctgctattccaagctagtactgtataatgtctatactgtataatgtctgctattccaagctagtactgtagctatgtaatgagcatagagaatctgagacagaatcagtcatttatagctataaagaaggaaaaatagaaccatttaatatattatagattcctttgcatgatttgtaatatttgtttgactaaaagtacctatggcatctgaaatgaaaaatgcaaacttatttctgatactacaaattaattaaattctgtaaataagtatgtatgtgtaaagacagaataatcaaggaaataattttatgcttcctctattcagaagctcgtcttatatagtgaaatattttaaatagcagtttttaaactaaaagaagattattgatttttctgaatataaaaatgatccttctcactaaaatgtgatcaaataaaaagtaaaactataccctatactgcaaaattataatattatgatgatcatagtgaatttttgaagctctctttactaatttctttaactgggtttgtaattttcctccatattatagcagacagatgcagctgttgaaagaagacttggagaacacattgtggcttatccagcataagtgtgctaagtgttccttggactctattagtgatttccatattcagcatgtaactttggggagtatcttatgctgcctttgaacgtaatcacaattttttgaagtgtgctcaatttataaaattaaacagctgttccatccaggggaattggggataaatgagcacatgttatcattggaagtggatgatatagccctagatatcattttcctaaagagatgcaaactttcattttaaatcatgaatccagcaatcaaacaatttcattgatgatctagtttgaaggtattcagtatgaacatatttgtgaaagctggcaaatagttttaaatatatttataggtgatgagtataaaaaaagaagatgtctaagtttctaagtattatggctatgacttcttggtcccttgaaatataacaggaaaaggtgtctgtttctttatgttataagcattgaaattgaattacatactcagagtattttggaatcttgaccaaagttatttatgcagttttactattgggaacctacagattcaattggttgaagttgaaactgtatacatttggattaatttgaggttgttggattagaatatgcagtgtttttcccccaaacaaaacaaataataacctataggaaatatgttataatatgtatatatttacataaaaatagtttaatcaattgttaccactggagattggtaaccaactcatttcacctcaaaattcacaacttgtgggtaacaactgtagttagtttactattttattatcataaattagcatttacagagcattttgctttattttttatttggaatattttggaataaacacagggccatatgcaagataaccaaatattctgctaggagttatttctaaaagttaatgattcagcttgagaacggaaatcatgcagaaaaatgtatgcaagagaaagttaatagtgtatgttaggaagacaaataatgcttttgagtaaagtagagtagtcccttctaaaagtagtaaatgtgtgggtcaggttggaaactggctaataaatacttcacctatttgtttcccttctcattactgatctgtgttcttcagttgatttagccccccacagcttcctttcgttgctccaacactgtggtcaactttcattgtcttttactgggcttaaattgtttttatttaaagcaacaaatatttttctaaaccctatgaaataatacagtgatatcaaacacttctagcccttgcactttctatgcattatacatatatttaatgtttacatattaagtaaaaatatatttaatctagtttcattatagtttctataatgtattataacatcatttctagaatttagacaatatgtgttttccataggcctcattctcttgtgttcagtgctacacaccagcttctagaatattacttggtatatagtaggaaatcagtatatatatttattaaattaatgaataaattaattttttttagataagctgtattggtctgttcttagatagctaaaaagaaatacctgagatggggtaatttataaagaaaagaggtttagttggcttatggtgccgcaggctgcacaggaagcatggctgaggaggcctctggagacttaaaattgtggtggaaggcaaagggggaagcaggcatgtcttacgtggccggaacaggaggaagagagagaaggggaaggtgccacacaccttttttttttttttttttttcctttgagacggagtctcgctctgtcgcccaggctggagtgcagtggtgcgatctcggctcactgcaagctccgcctcctgggttcacgccattctcctgcctcagcctcccgagtagctgggactacaggtgtccgccaccatgccctgctcaattttttgtatttttagtagaggtggggtttcaccgtgttagccaggatggcctcgatctcctgacctcgtgatccacccgccttggcctcccaaagtgctgggattacaggcttgagccactgtgcccggctgatgtcacttttaaacaaccatatcacatgagaactcactcacttctacgagaacagcaagggggaaatctttcctcatgacccaatcaatcacctcttaccagtcccctcttccaacattgggtattacaattcgacatgagatttgggaggggacacaaatccaaaccatatcatgtaccattcctaaaaccttctgggatttttattattctaaaaaattcactttaccttctcgatatctttgatattcttttttcagaaccccatgttgtgttttactttgatgtggtcaatctttctttgatttttatatggtttcttatatagtttcctgataaagactgcaaagagaggcaaaactttttataaattttttattagagtaggcaaggctactgtgtaataacacatctctaagtcttaaacattaaaatgaaatttaattgttttaattaatgaaatattagactgctgtagtctaactcaagaggggattaggggactttagggctctgttccagtcattaggagacttaagctccccctatctatgacactgaaaccttcagcacatcacctccaaagccactactgagcgggaagagagggtttggctgatcacataaggacatttttattttgatttttttttaaatacggatttcatatttagacagagaagtgacatgtacataattgccagcacattctattggccggaagtcaatcacctagccttactcaactgcaaggagaaatgggagatacagatttcctatgtgcctagagaaaaatgaatgtatttactgaatgcatagtgttatctctgccacatcatggatatctgacaatgtctttattctttcctcacttgagtaatactttgactatagaattttagttcagaaatcatttttccacagaattttgaagataatttcattttctctgaagagacacagtgtttttttatgtttaaaacataaaaacaaactgatataaaacaaaactttaatatagttatatccaaatgatttttgttctatatttgcgcttttttgggtctttcttgggaacttttacctgttaaaatgtgatgaaaatgctatcctgcagtttttactatttactttataattttccccttatatttaggactttcattcatttggaatttacccttatacatggtgtaagattagaatccaatttaacttttctcctatggtgctagttacatgagtaacgtcttctaaacaactttctttttttgtttaatcactaatttgtcataccgctttatcatgaatgtctgatccttgtataaatcgtcttctcatctgctcggttaactcatccttcaattttattgatctctttgttcttgccccaatattagtctttttcaaaattttaattactctagctttgttacacatccttttactaaaaaagagagccccacaacactatcttaactttatgctttttctgcaggattgggcaggctcttgatcctttcatttataatacttaactaaagttaattattttctcaatagtcaccagtttatatttaaatgttgctgtttctttcttgctcaaattatctgattacctttctttttatttaactatattaatgtgcttatatcttaccatattttcatttcttctcaagctgtttccttcttctagctttttgctgatatttttaggtggtattgagattgggaaacataagattctaaaatttcctcttcattcctgttatatatatttcagagatcatatttaccccttgagtcttcaaaataatgtgccatgcatgctcttagtgttgagatatcttaaataattattttattattaattttatcttttagcatttattattaggtgagctctatctgaatccagctgtagatacataaaagaagagagtgaattgtctttagctgtgtttattatgcatgttgggtgaactccctcagatatactgctgacaaaaacgaatatgcacagctattaattccctttctagtgtctgataagtatacatgtctccattctgtgagtacttagactcatgtaggatcatcttctgtcccatatcctaatatctggtactctgaaccaatggagtatatagcatagtatcaacacaaactatgtgctaccacctttcctgtctctatcagaaccaagaacattgcttatgaggacttaaatcggagaatgtaatgaattactcctaaattttctctcacccccaacaatccctgttgtacttcaacaatgtgaactctagctgccgccaacagccttacatacactggtctatatgatggatggttaggcaatgtagcctgcagagtcattgcaatgtttgcttagcttctttccactcaaattctttccatcttccaagttatatgttaagattaacatataagtgtgagttttcaccttttttttttttggaattttcatggatgttttcagtggagatttcaaagaggctgcattgatgtttattgttagaaactttttttttttttttttctgagaaggagtttccctcttgttgcccaggctggagtgcaatgttgcgatcttggctcactgcaacctccatctcccaggttcaagcgattctcctgtctcaggaaactttttcatataaatgctttctactagttttaggaatagatttatacatgttaatagcatctatttgtgaaactaggattaacggaaaaagaaatatgtgaaattcaaaattacctgtgcttatttttgatatttactccttggccttcacagcattaattccatgctatttacataagatttagaaagtttaaaattagcttttattttgctagtaagatactgtagtactggtaaaagaaaagagctgtaagttaaatgtagtatttgttttaaattcccatattcccattgtaagatagaaatgaccatatttaaaatcttagtattatcaataagcaattcattatgttcaaaatagcgaatttctatggagtcaatgaatacgaaatttgacatattcccaattaattgagcaattaataattgcatgattagagacttagctttcatccattcatggtataaactattctacagttttatttctatcctgtttcaaaattatctatttcttacagtccgtagagattgtatataaaactactacaaatatatcagtatttattattttaaaagttgaattattcatggttctctttcttgttttatttttaattgttcattatttctaaattcccacttaacttactgtataatattgatctatgttgggataatattttatagctctgattttcccattccccacaaagtagtttaaacagagtatgcacgttgtatgcatactattgagtttaaactcaataataatttatttcaatgaggataaataaatggaaagaaattaaattcctgatgcttttctttgtagtgctagttttgtctgtctatggttttatttataatactgataaatttttaaatttttttttggcttttgatttggagttgcacctaaatatctatgtacctttaagcaaatctcaaaatatttatgaaattcaattactcttactggaagtgataaggttaaataagctaatttctagtctctaaagtttctcctacttttctttatgaataataatcatcatcataagaactacaatttaatgagtgtcagtcatatactaggcattagtacttaaaacagacctattcatttagtagaagaagaaactgaggttcaaagagttagagcagcctgtccaagacagcacatccatgaggtggtgaattcagaattgtaacctgggcaggctacgtgatagctgcttcaagtgttctctgtcagttcgttagagtttgtgaggccatattctctcatttcattcttgctttagttatgaatcagttatttcattgatatttcaatttagtttatgtcctccactgaatctttgccaaattcttttattcctccaatcatacctgcccaagtctgagtcctactctcataaaatcagaatgatagaagcctcaggtctcaacatttaaacatatttaactgtattttcatacttatactctttcttgttcctacacaaataaaaataatgttcattttctttccaaagtgattattttgtattctaataattctagtaattcatccaagttcatttatatatttactttgtaatgaagtgagagaataaaaatgaaataagtcttcaatttagttcattttcttcccctttctctacactggttctatactggttcatttttcaagtagaaaatctgaaaataatttttatttattacctgatataatatgtatttgatgatatgtaccttatttcctcatccacaaataatacacacctaacttttttgccccaaagaggcatcaaacttgatttacaaaaaaggaaatgttccaattatgaacattattctgaagaggatacccaatatataagctcagtcttggaaatgtgcctaaatttttaatttacaattaaaatatagaaggaaaatcacaaatttatttttttttatcattatagctatattctgattaagtttgcagttggatgctttgacatactttcacaagtatagattcatggcagaatgtgaagtaagtaaaaagttaggtagatcttatttattcctgtaagtcttcattagtcaaggactgctgtcatccccaaaataactgtcattgacactttcaggtctgggttcaaaataatatctgaactgattctgaacctgaggcagtcaagctgaaattgcagagagcacctagtcccatttcacaaactttccagatatatttttggaatcacaagtacattttatatttaaagtaatgttgctaaaaaaaaaaacaaattttctaataaacattttccttaaacagcaataaaaggtaacacaataataactcacaatattttatacccccataaagtagccatctgcttccagaatataaaatatcttccaaacccaatcaaacaatataagtaatctttatatctagaacttggaatcacaggtatgttttaatattagaaatgaagtcagtttttactctcatgtactttctggatcatattttcacctcccacttttgcttggcctgatactacctgtccttaaggtttctccaggaagctcctttcctggtctaaatttgtcattccatcagtgaagagacaggttagctagcgattaagagcacagattattcttaacccctactttgcaatttaaaagctgtgccatcttgagaaagttgtgaaacatctctgtacctcactccttcatctgtaaattggagatgagatacttacttcatgtgttttttttttcctgaggattatactatttaagtcatgaaaagcatgtggaaacagtggctgacatatagtaagtacccaagatgggccatgcattggtaataagttttgtgttcttcaatagcattttgtacattccctatcatgatagtaaccactctgtaattatgcttcttagttgtcccttttcccagaaagattataatgtccaatcactcagaaattatatctctgtttgtcacagtacctcaatacctatcatgatgcctaagacatagtaaacacttaatctgcatttattgaatgaattaagtttctatatgtcacagggaccaagatacatattttatgtatattatctgcttaaaatttaatcataaccaaggaataaaatagtagtatataggtaaggaaactgaacctcagttttcatggttatcagacaaaccccaagttaatcaacctacacatcaaagtttctccgctacttcccgatgatttcccctgcaagtctccatcgaggcacaaagtcaaagtagtcaaaagaaaagtaaaatttggaaattaagtctgtagtatgagtctgtgaatttgctaaaattatggctggctcatcattttccaggaatgaagattgctttgaaaatgctgaaataatcacccctagattctgattttgtacatgagcagtttatcataatgacacctcctttatctcatctttgtaccttcttttcttggcatttacttcatttactgcaaattttgtgtagtctgtttcacatcattgtaaacttgcctcaaatcacctgatgctatgtttctatgattatgccaagttttgcactatgcttagttcattcttttgtaattagtttttctgtctgtttgttcaacacttactgttgtgcgtgaatacttcctgtgaagttttctttgtcagtgatcaagtttacattgaaaatttgcagccaagcgacattgatgtattggaaatggaaacatacatgcattagcatatttctttccttctttcttttttttcttttcttgagatggagtctcactcggttgcccaggctgaagtgcagtggtatgatctcagcccactgcaacctctacctcctgagttcaagcgattcttattcctcaccctccccaggtgcacaccacatgtgcacacattacaaaacaattatgaacgataacaaacattttggttcaagttcatctctagaaaatcattttctatggcaccttatccttctgtgattgtttcatcaaattgagcttcttgatagcttaaatcttatgagttaatcattttgttccctctctgacagcgaccaacaaatatgtctgacacctactataaatattcgaattaattaatgctgccagaagaagtgattctgacacatctctttgcttagagtatacatatttattttgtctgttctataaacattccactgtaaaaagaaagggctagttcttatactagaatgaattatttttctcatgtagacaaattatttttactatttcttatttatacttgctttgctttttagcaacaaccttggaaaatcttttgatacttgaaatgaaggctattaggatggattttctttccttggtatctgtagactaattttgattttcacttttaaacatatatctacttgtcaaagcttctaaacacaagtaaaacatataataataatgctagaattaaaatatagcttaaagcattatattccttttgcaaatactacagaagtaatttataaccctttgagatcagagtttgcaaattttggctttctcatataacaagaataatttgcatttgaaatatagtgtatgtttaaattctcttctatgggagttagatgttgaaatctttactgaagtgattttttttttcctgcgaacacttacaagattcctgttctcaacttaaagattgagatttatgtgtccaacactttaaatttttttttaaatttttacacatttctcagtgaaacccacttgttgtctttgacttagagactctataattaaagtaaaagcacatttcaatttaaactctaattcacagatagtttcttagttagtctttattatatcaaataattgcagcaacatttaaaactattatatttaaaatataatatatatgaaactgctaaagtaaacatttacattctagaattctttataaaccatagacagtaaatatatttgaaataatcagcttgccacactggctagagtgtcaaagtagccatagtgctactggtttttaagtccactgctgagtttggccagggctactactttttacataaaatggctttaaaaaactactaagaatacttgtttacatggtgagtagtaatatactctttattgcaccaaaacaattttcttaaatgggagtacttgcttacattgtgaactgaaaaatatctccagtctataatatgcctgattccaagtaattcaagtgtaagattctaatttatatataaaaaatactgtattgtaataagaagttctagggattttttaataattacataatattttggatatttctttgttgattttgatatttattttggattatgatctgctggagctcaaaattttcctaaaaccatcaaaaaaatacccatcctctgcgtcttcttccccactgatttgaaatcctaactttacattttaaagtctctttcatatagaatttgtttactgagctttctatcatctgtcataattctgtatgcccttgttcacatattataccattaattattattaccattatcattgaaattacatagcatatttaaattctaataaaaaaagcccatttcgttgtctttttaaaatttgacaatttattttatttatttttgcagatgaaacagaataatcaagattgaaggaaaaatcaatttttgtttttacccaaaaggtgtctctataatttaatttatggagaacacccaactttgcagtatttaatctttcagggacatattttttattcaatttttaatgtcactatattttttgagcgttttcaaataaatcttaaaagtttctaattaaatctatttttaggtttccacatttggttttcaccattaatacactctttctagcaccccctgccatggctagctaatgtttccggaataaaacaatatttgtttgataactcattaattcttattatttctagtagttttttctcttagatgtctactatcatttgaatgttcctccaaaactcacgttgaaatgtaactgtcattgtaacagttttaagaggtgggtcttataagaagtgactagaccatgtaagatccaccctcatgaatgtgggattagaccatgtaagatccaccctcatgaatgtgggattagaccatgtaagatccaccctcatgaatgtgggattagaccatgtaagatccaccctcatgaatgtgggattagaccatgtaagatccaccctccctctttactgtgggagtgaattaattatcactatagtgggttccttataagatggatgagtttggcacaatttcgtctccatgtctcatggcttgcctgccatctgccctgtcataacacagcacaaaggcccacatcagatgccagaactatgctcttgaatatcccagcctctagaactgtacaaaataaatctttattctttaaaaattactcagttccaggtattctgttacagtagcagaaaatgaaataggaaaactaccaacataggccatcatattatctgaaaacagtcatttatttattcaataaatagctgcagagtacttgttatctctgttatatagcttacactgtattatacttttgtcctctttctaaaattatttccttctcttatcttattctctgatttaaacttcctggaaatattaataattttgattatgccataaaccttgtcttttttaagcctgtaatggaaatacctctagtatgacatcattaaatattatattggtttttatttgtaaataaatgattttattgcatttaagtttctaattctaataatttttaaaataataaatggaagagttttgtctaatgctttttttttcgtttttggatggtttctatttccctctttaacatgacaaaatgatgcttgaaattaagttcccaatgtttaaatcatatttgatggctgaaacaaattcttagtcttggaatctctctccccttcttttcctcttttccttcacgtggaactttattctgccaccaggcttcatctgatctttgcttaatgcaaattcctgtgagcatctggcctaacatatcattgacaaacagcctctaatatttcttcataatattttattctcttgctctctttctcttttttcccccaaagaaaggatggaattgagtgaatttgttgtcattcatgtcctggcacaattccccaaatttattttatatttatttttctttgatttatttttaaatattgctatgacattaaaattatcacaagataagataattatcacttgaggctaaaaatcatatatgtgtttatcaatctattaatatttatctactttctcattttattacaatttagagcattctttggctctgtttctcattttaacatcttactaaatttcaaaatttcacactttcattacttagaattttctttaatggaaatacatttctattcctaatgtaataaaatataattcaccatatggaatatgttaagcaatgatcttttaaaaaattacttcatgagttatgatgcatatcacgtagatttgtgataggaaattatagtgcacaaaatatgatacgtactttgtgttacctaaacattctggtcaacttcttatagaacttagtctttaaagctaattggcatatgtagcaataagcattcataattatgaactgatttcttcaatgagtggtcagattggggcccaagtttcccagtttattttgtttgttcactgctgctatagctcaaattatttccttcttagtagattctgaattcattctgattaaaatctctgacatattaaggattttagcagctgaagtatgatagctcatgtttaatcaactgatcctttcaaagggttgtagatatcctcaaccaacaagtgaatggctaattacaatccgaacttttattgagtttctattgttttgttatctcttcccgtttcctaagtgagatacatatatagatgccaccctatgcttgtgtttacctttacttatttttgtggttttgcttttttcttaccatctctccagtcagactttctttaaaaaaaatttatccatttttatttctctcttagcatcattttcatagatctaattactttgcatgcactatatattgaatttatttaatttgaaaaaatatttagttaatatccttaaatgaatatataattaagatataaattgaagaagcatacagttttaatatttgatagttgttttgtttaggaaaagattattaatattacacaattgagactcttttaaaaaataatttagtacccctacataagatgcagttctctgcattttctgtatagttattttctaattttcacaaagaaaattttgtttttgtagggatcttgtattctgtgatgaatctagtattttcttcattgtataactaaactctgagtctctttccatttatttcattattttattacatgaacacttttatttcaatatttttcttctggctttcaccatatttttaattattctaaccctaaatagtaataaagttgataaaatttcacatatatagagacagaaatggtatatgcgtttatagacaaacatacatataaagggaaagagagaaacttagaaaactatagttagaagtataccaaagcaaaatttaacaaaaataaaaataataacccttcaaggaagatcaggggccgggtgcagtggctcacacctgtaatcctagctctttgggaagccaagggaggaggattgcctgaggccaggaattcaagaccaacctggccaatatagtgagaccccatctctaaaaaaaaaaaaaggtaattatttcctttaaaaaaataaaaagaagctgaatattttatcttacataaagttggaaatactttaaaattgctaaatattggaggtacaatataattagtaagtgaaaaactgaaaaaatcctgctgttgtagaatcagaatgtgaatattatagagacacattgcagaggtttagttggagatgatttttttctttgcctcaagaaaaattgtgaagttaagtcttttttaactaatgagtatttcaaatatcttttctttatttattatctattgtgctgtaacacattttcacaaacttagtggcttaaaacaatgcatatttattatctcacagattatgtgggtagagtctgggcatggctgggctgtgccttcctccagtctctcacaagactgcaatgaaggtgtcagctaaaactggggttttatctgaagactcagttggaaagggctcactttcaagcttacttccatggctgttgggaggattcagtttcttttgggttgctggactgagggtctttggctgggggcccaccctcagtttcttgccatgtggatctctctaccttggtaacagcaaaatagagtatctactaacaaaatgggttaaaatctcttttaaccaattcacagaagtaggatcctattatgtctgttgtattattttgcctagaaataagtttctaggcctacccacactcaaaggatggagattacaaaagggtgtgagtatcaggaggaggggatctttgagggccatcttggcattggctactacaattccttttctctttccccctctccaaataggctctttcaacaatgtggatatatggatttttttttgagatggttgttaaaccaagataacatgtaaaatgcatggtgaaggtagccaaaatattttgaaaattcaaaatcattactaacttgtttgaaaataaaccattttaagaatgctacatgacttcagctatagagtgatgtttcctacttttaaaaatatacatgtgcattttattgattctatttaatagatatatttctattacacagagcaaatgatttaatctatacattaatgtccatttaacctgaaaatattttgtagctaatgttttagattctttttggtttgttttaaattgtgtttgggatttcttttagcccctaaacactaaattgtttgaatgaatatagaaataaaatagaccccattcatcaaaatgaacactaatgcaaatagcatatattaaaatgtaaaacaatggattaaaattcatatggcttttctggttcttggtggaaatagagcataaagaaatcaactggtcatcctcttctagtttcattaattcttatttttaagaactatttgtttgtttaagactgtgaatattgataacactggaaaccaataacttttaatctatcaggttcagaatgcccttcacacttttttttttactattttataagaaaatgttatttattatgaaagataatttaatttaaattttactgctatccatttactagttctatatgcagcataaaagtcatttaatacagttctgaaaaaaagaaaccctttgactggttttacttaattcatgtcattctaggtaatatagagcagggctttaaaacccttgtaaacactgtaaatgcaggaaactagataatttttcttgggaacaaattttgaaggtagatgaaacttaaataatctaattataaataagcaatgatcatacttttcttacctttgcattttaaatctagaaatacatcataccaagccatttggcataaagctaaaataccacttttaatgggttaaatgttttgaaatcttctcttaaagtttttaagtgatggaacaggctccggttctctaaatatgtgtaataatactctacttaattaaatttaaaaaacaaaattttattaattttcacctccagcaacagatgtatatgttttgaggtaaagaaaaaaaaacattttataaatggtctgatgaaaattttagttggctgacacatttaattttcacagctgtttatttttttttgtccagtttagtttatttttcttatcagaactggataaagacctattagaccaaatttattcccaatggcataaaaagaaagaaaaaaagctaaaccctttattacaagacaaaacagtttcattggctaaaagtagagatacaaaatatagataacagatggcatttaaggttgttgctattcaactttaatcagattggtgatatctttgatgctggttgtaagtaagcatgattttttctggtacatattaactatatgatggagtgttagttgtctgtggaagtacacctattaatataaaatatgctctacaacaaattaaatacttgttctctccttttattatcttctccatgcctttcctatgccagttttgcttcttgaaatgataaactttctctcctgtggaactgccagtaagtagccaacatttggtcaggtaaagagtataggctctggtgtcggacagctgtttcactggctttcaatggcatctttggcaggatatttgatctctggggacctgtttccttatctgtaaaactgggacatcagaattatcaaattcataagattattgtaaggcttaaatgactaaatatctgtagaacatatggaacaatggctggaataattatgaacatcatataaacatttgctattaattttacctgattcttgaatgtttgcatattcttgagattcactatatgtttattctacaatctttgctttacaacctgtttcctaacatctagagtgtatctatgtaacttctgttactattgaaattcataacttctaatatgtatagtcattttttttgttttgttttttctacctgtgaactagcccctagtgtctatccaactcacattaggacctgatatgttacaggccatgaggtatttctgtggcttacctaactaatgatcaacagtcctcattcaacatcagggcatcttttaccctactaagttctaaaagaatgttctatggaaagaagaggatggttttcgattcaatgagaattcattggggatattgtgtatctaagataaccacgaaattcacttgcatatgtccttgaaacttttgagaagaatgtgcacctactctcactcagcttactgcagtctatagtgatgagactgggttgaaaattatgcctataccatcctatatctcagttccacagaggattggcatttaaaaaaaaaagaatattgcaaggattgttttagttcctactggatatctgcattcaaaggttcttgccactgggtcttcagtaagcagtaattctagtgcctttttaaaattttcatctttggaatattacttttctttatctcaggatattttctcacaattatctacatcatatcatgctaattaaagcctgacaccattaatatcaaaatatttgtctttttaatatgttcttaagcaaccaaatcttacacaaaatatattagagtgctctattttctgagcctctaataattttgtttttgttctgtttttctccaatcatagtccttttcccttattcactgttgtatccctagcatcctgcactggtgatcagtaaaatacattgacttttaatgaatatatttgctgattatgtgagaaatcttttaaaatacaaagctgatgctgttattccactgagtaaaatattaaaacaacttaatcactcagtattacctacaaattcattatcacggaataaaagactcttcaggagttggccctgcttattgcttcaagctcccccgtgatttccttctctaagtgttgacaaccaccttacttccccacctgaatgaatacatttggttttcaagactcagtctaaatacttatctttttaattcctccaagagctaattattttctcccctgtgccagaagtatattctgtagctaagcctaccatagtcaagattctctgtactgcaattatactgttatatttctatatctccttggaggtgattgtttagggaagagatgatattttcttaaattttgtgtaataagaacataatcagcacacaataaatgttataagaatgatttaagaattaatgaataaattgataccttgctaaggttcaacatccctaacataatattttgagtctgaaattcccagtgattgcatataaaggaaaaggtaaattttgagggttttaaggggaataaaaattcaataaaaatgcattattaatctccctatgaactgaacatatgaattagtacgctatacctttccctttcagatactgagcaaagggatgcaatgaaagatgattcctattaagtatgtaaccaaacaagttaggcaaaatgctacttttaataaaaattattattttcccatagacaagatacacatttttgaaagctgcaaagaacagaaaggtaattctacattgctttaaatgataaagaaattatagtgcaaactttagtgttagcttctcaactagtatcattttagcatttgtatctatgttggatctgtaacagttgaataataagttatatttaaacttaaatttcaaaaacccagaagagttacttttgtatgtaacttgtgaatttagtcagttgctttttgttcttaatgttttcaaatgtgaaatgtgacttttcagtaaatggaaatattgcatttactttttaaatatttaataaaatcaattgttttcttgaaataaaaaccgaaatcgcttttcaaaataggtcatagacctaaatgcaaaatcccaaactataaaaatcctagaagataacgtaggagaaaacctagaagaacttgggtatggcaccaacttatttagacagaacaccaaaggcatgttccatgaaagaaataattaatacccggaacttcactaaaattaaaatcttttactctgtgaaagataatgtcaaaaaatgagaagtcaagactgggattaaatatttgcaaaaaaacacgtatgctaaacgactcctatccaaaatacaaaaataactcttaaaactcaaatactgaggcgggtggatcactagatcaagagaccgaggccatcttggccaatatggttaaagcctgtctctactaaaaatacaaaaattagctgggcgtggggtggcccgtgccagtagtcccagctactggggaggctgaggcaggagaatggcgtgaacccgggaggtggagcttgcagtgagccgagatcgcgccactgcactccagcctggcaacagagtgagactccttctcaaaaaaaaaaaaaaaaaaaaaaaaaaaagttttagaacagaaacaaaaggaagtaaagtgcacttggaagagggccaagctggcaacttgagaaattcaagcacacagtttgacctttgacttggggttttatacattgccattcttcgtgcgcagtggcctgctagtacttgagaggggtctcatgcacagtgtcaacaatgtgtttactggagttgtgcgcatgctcacttgaggcatttttcccttaccagttgagtgctcctagaagaaggtcctataccagttaaactccacgattttgtctcttagtgcacattcttgagcccactcacccaactccggagattttattgggaagctgctgctcaccattttcaggtgtttgtatctattaggagcctccctggtgccagctgtgaccaattattattttagtgagacagcgtagcaaccacctgaccatcacctgatggtctcctgacacttctggttggccagggttgtggggttgcgggggtgtgctctaatgacattttccacagaaatagaaaaaaaagaagctaaaattagtatagaagcataaaaggtgacaaatagtcaaagcaagagtaccaagaacataaactgggctaagcacagtctcttcagtaaatggtgctaaaagtagatatccatatgcagaagaattaaactagatccctgccttctcaccctatacaaaaattaactcaaaataaataaaaggcctaaatataagaccccaaactgtaaaactagtagaagaaaacacacgtgaaatgctttaggacattagtctgaaaaaagatttgatgataagacctcaaagcacaggcaacaaaagcaaaaataaacaaatgggactatatctaactaaaaaacgtctacacaacaaaggaaacggtcaatagaatgaaataacaatgatctgacgaggattaatacccagaatatacaaagaactcaaaaagctcaaaagcaaaaaataaaaacaaaaaaacacaatacaatttaaaaagtatgagttatctgaatatacatttcttaagatatacaaatggccaacaaatatatgaaaaaaaagctcaacaacaccagtcatcagggaaatgcaaatcaaaaccacaatgaggtatcatctcacccctactagaatagcatttatccaaaagacaaaaaataacaaacgctggtgaggatgtggagagaaggaaactctcatacactgttgatgggaatgtaaactactacagccactacggagaatagcatgaaaattcctcagaaaaactataaacagtgttaccatttgatctagcaatgccactactgggtatttattcaaaggaaagtaatcagtacatccaaaagacatctacagctctatgtttattatggtattattcacaacaacccatttatgttcattattagacaaccaaggtgtccaacaatggatgaatgaataaggaaaatgttgtgtattacaccatagaatactagtcagctacaaaaaaaaaaggtgaaataatcattctctgttacacgaatggaactgaagacattatgaagaaataagcctggaacagaaagttaaacaccacctgttctcattcacattcatatgtggaagcaaaaacacatacaaacaacaacaacaaaacactttatctcatagaagtaaaaagtagaacagaggatactagagattgggaagggccggggagaggggagcattgggagagatttgttaaaggatacacaagatatttgttacagctagataggaggaataggttagtgtcctgtagctctgtaggatgactatagttaacaataatacatagtttcaaatagctagaaggaggatattgaatgctcccaacataaagaaatggtaaatatttgatggatatgctaattattctgatctgatcactagacattacatttatttcaacatcgccattgaccccataaatatgtacattatgagtcaatgaaacatttttgaaaattaaaaaagcaaaaaccccccaaaattgtttaaaaaaaaaagggaagtgatttccatggattagtggggagagagagataaataggcagagcacaaaggattttaggggaatagaactattctatatgttactaaagtggtaactatgtgtcattatatatttttcaaaagccacagaatgtacaatactaaaagtgaactgtaatgtaaataatgatctttggacataatgatttgtcagtataggctcatcaattgtaacatatgtaccattgtgttttgggatgttgacaatacagaaggttgtacatgtgtgaggacaggggacataaaggaactctctaaactctgtaattaattttactgtgaacctaaaaatgctctaaagtttattgattaataaaagcatcctgcggaataaaaatatatactaggataaaatgagattttctctgtttaatcagaatgatttaaacttgaaaatgcaaacagacaaaaaaaacccctgaatttctgtcttaatattattatgtccaatttatagtttggacatctttacaaccatgaaatttctcacagtattctttatttccactctaaaattacggagaggtaatgagtataatactcaatgtattcattcatagtaggcaatcaagcaattggttttcatttacttggtttggaaaagctataaaaacctttctttgtaatcatggactaataattacaaaaattgttttgtctctgtttctatacaatacgcttacaattaatatgaatcttctgggctcagttatcctgctgttgaattctacaatttttgcctattttctctttcccagagagtttatttttactgtataatacgttgaggaagtattttagttcattcttataatttatttggtcttttctgcttttatgagtacaattcagttaatagtatttgtttaaaatgcctgctttaatctttttcagatatgtctagaccaagttgatgtctttcatagagcatatcaacttttaataaactaatttagatactctgacttgctgccatgattatataataatatttccattatgcattatacttttgtctatgcttatgtctctacctggaaaagtaagctttgaaaagctcatactgtgtattgtttattccctaaatctttgtatccaagcatagtgcataacaaataatgggttcccagaaatttgtttagataatagtcagtatattattccattttagaacagttaaatttgtttagataatagtcagtatattattccattttagaacaatttatttaatgtaaattagtgtgagtaaatgatggtttaatatgaattaaagtgatgattatttttcagttaactgtaaaattgaaatataaaacacaaaagaactcagtgaaaataaaacctaaaaatgtagtttagattttcaagagttttagaaactatttctttcaaatgcaaaaactggactgttgatttttgcattgttgttgttgtcatcttaacttcaaaagcattactttgatcaatattggcttttgaaacagagtgcagaggttaaccataagttataaagtgggaaaggaatgatgacatagatctattttcttactacacaaaagagattagaaaaattttttattggctataaaatgatgggaaataaggcttatagacagtgagctatattatacaatccccaaataaggtaatttaaggggacataggaactgcatctgtcttttcctctggtatttttggaagagtcagcctgaaagaacacactgcaacaacatggttggccatattagagtaaaagtgccaagtaaatagatgttggcagagagaaggtcgagaaagtacctaagttctacataggttctgacagatcacagaagacatttagtttggttctgcatgttaaagtggagaactgagtgttaccatcacgtgtccaccacgttttaaggtgaagtgactatacagcaaggctgacacattaattaaagggtaggatgtaagtgtgaacctgaagaccatcagaagaaggatccagtatgacaatttattcaacaaaggaaactgatgaattcctaggaaccatgctttttttctggcttctgcactgtgattacttatgtaataaagcaggccactgcagtgaaattgtcacaaataagatgcttcttgtctgatgccaagatcttatcagtgcataaatgttggatgagagtagggatgaggcaaatgcaaatattcacttataacctgggaagccagacatccctgtagaagaatttacaaaatcaaacgtaatagtctttgatgaaaacatcctcatgaagagttcttcttatttccttatgttgtgtttcatttcagtgtgcctaatacactttccttctagcagacatcacttggatcatctccattcttcacataaacaaaacctaaaaacatgaaatatcaagaatgtcttaatttcttttcaaccaggagactcctttaatcctatgaaaatttgcctattgcttctccaaacaccagctccttataacaaaatatataaattaaggcaacttttaatgagttaagaataagttctctcccagtcacctaaatgagtttgtacgtgccacatacttgcatagccaagagggcttactcaaatgttatgaaagagtgggagaagatttatcccacagtaaatataactaattataagttaattatatttgatctctaggatcattgtatttaatcctacaataataaagatattttgcattagctgctatcatgaacaatttccaaatgccagagggattaatcaaatgaaagattatttcttatttatttattttttcttactttcccatctgatgctagtgaagaatctcttctaagaatctccaagaagtttttttttttttttttttttcctcttttttgacatggagtctcgctctgtcgtccaggctggagtgcagtggcgcgatctcggctcactggaacctccatctcctgggttcaagcgattttcctgcctcagcctcctgagtagctgcaactataggcatgcaccaccatggccggctaatttttgtatttttagtagagacggggtttcaccatgttggtcaggctggtctcgaactcctgacctcgtgatctgcctgtcttggcctcccaaagtgctgggtttacagacattagccaccatttttaagaacttccaggctccagaatccttctactgtgtggctttcttatctcaaaatctttgctgctaaccactagtatggaggctaggtcttcaaccaagaatcttgcaagaaattctaagggccaagagaaaagttgggtgtatcatcactttctacattctgtctgcatccagaactagttatagtgtaccaatttaattacatagaattgtggaaaatgtaatcttcctgtatacactgcaagagaaaacaaaattgatgagaatctatgcaatcattttaccaaaactccacacattctaactttgccacatgctgggtcaggatagattgcttctccttggaggattagtcatgtaattaacaaaaatgtttgtgggagttcattgaaagatactgaaaaagaggggaaagtgagcattgttctgaatactagaagtcttgttttagcatgaaaagcaaacagaaagtattagactactatttttgaatctaaatagaatgctatgtgctatcgcgtctatcaaacaagagcagaagatctcaagagagcctactctatgatttgccaaggataaaaaaaaaatactatttttttctaaaaaataaatacccttgcttttcttttctctttatcctttattgcatttgtacaattgattactttctttccgtttggagttttctagatttagagacacttctttcaggccatacaagtgccaaatgctgtctttttagtcaacttgctaaattacaggtaactcagccaaaaagtagtttaagtggcattcaggtgagtttgcattactctagagagtcatgtaactggataaaaatcagccttcaaatgcaatagagcgttatttattctggtatataagcatgtaaacatgacaaagtgaagctgttaaaacaatgaactatgattcccctaaagatttagagcaccatttagtattttacagcaccaggcttactcttaacagtatctgattttgtcatatatatattttaacttctcattctctctagtggttcctggctttaaggaatctcagcattgctttatttgctaatactgacacctgtgattaatgaaggcttaatatctgagataatttgttgtcacttggagtccctattaaattatagagtctatgtattattttaacataacagggatatgactaaggtaatatttatgaattgtgaagcaagatatccattctgtagcgtggagtctgccaggagttggtacaccatagaaagaattcaggaaagtacagatgttatcatattcctactgcagacctcttgcagggagaatgtgggagagcaagtgatgaaagagcaaaagtgagagtgaaagtgagagggaaagacagacagagagagacaaagagagagattgaatgtaaaataggaaaacatttaaaaaaggaagataaatacttttgcatattatgggggattgaaacaagtgccttgatcttaaattttaatgtttaacatccatttaactcttttattatatctggacatattcacccctagaattcagacacgttatttcacttcttagatttcttatttagtaatatgatgacttcacagaaacagaattactaagttttatttcaaaaatgtattggggacttatatttaatatgcttataccttacaaataataatgtcattctgtgatattaattagtcttaataatattataagaaagaagtgctaaatttgacaattattcagacaattattcaccaattttgaccaactcaagaagcataatttaggtgttcatcatttggacattaagttattacataattttttttctccacaccatgattctgtagtttattacataaattcattattgagggagaacaaagtaatctgcttacaaacataatttttatttgaccataaagtccatacataattatttagtggagaataccagtgtctcacaattcacttttagtgtactcttcttactttgtaaatatgcagtcaaataatagattatttttcagtgtgcgttcctcagaaattgtagcctgagacaaagtgcttagttactgttacttattagggagtgtgatcccagtgagtagaagtgaggctcagaaggtgaagtaggttaggagggacagccaacatgaggctgtattagcaagctgcctgctgattgcatgatgccttaggatgtccccaaagaaaccagaaatttactgcttctcagtttatatgggatggccaccatgtggtgagtgaagtggaacagtttatccatggtttcctatctctcattgataaaagttttgctccactgggtgttaactcccaaatacttctgagtcccatggagccatccttagggaatcctctgggcaggagctgcaggcatgaggcacagttgttgaagttgcccttgtgtggggttactcagagctcaccgagatctaaccactattgggacagctaaaacagaatactggtaaggcctgggagagctcaagttgcatatgtgggaagaatactatattccagatagcacagcacggatacactactgccctccacagctggcttccatactgtaatctggggtctccatagttgtgagaacaatgtactcctttagtttccaagcaaagaaggggatattggggatacaaattcaatcaatcattcccatgtatttgttaggccgtgttggctggaattcccatatagtggttcagcaggccaggcagggtagtgctaagagttgtgccagagaattccctgggttccagtctttctccttattcctattttcttgtcttcagagcaacaaggctagttttcatagtaataagattgctaacatactgtcaaaacggactaaaggcgaattgattatattcggaggttaatgatcagaggaatccttattgactcccggtggaagtatttattccctagtaagcagacctctagcatagaagagcctgagatttccagagtaggagacacacaaatttcacaaggtggatactgacagttaaggtaggagggaccaatcctgtttctacccattgtttctgagacaatatgctattgggattatattaattaatgattcatcgaatatacatccagaagcatagcatttcaattctgttgcatatttccttgagaaggactcttaactgaggctttaccaggccagttatctaactattaggctgactgtctcaatgaggaacatgaaatcaccagtacattttgctttcatgtgcctatgatcatagctgctttgtcagaaaatggttcccttggtctaatgcagtgccatgtggtattgcatattaaaagataaaatattttgtaagtccttggatggtggtgcaagtaggaatcacaggaaggaaagataaatcattatcctgaagaggttttaagctgttaaagagctgtcccaacctgggtagaagaagtcatataaccaacttgaagcctgattcctgcaaggaattgtgctctgttgaaggctcatttttagtatctgttgttggaaattcagaacaccaagcagtgcagtagatacattatctttgttgaggggagccatctgttgggttcacgctattcctgccaacaaagatactttgttcatggcccattgttcaaacattgcaggatgggtggggtgaagacatgttggctgacatttatgtgacgggtcatgttcattcttcgttaaaagtctcctctgtaagttgatgctctctggtgatcattatgaaaaacaaagatctacatattttgtgacaatagccatatcaattacctctttaatagaccttactcccaatcttccaatcttgcttccttcaggcctttaaactggaagaatttattttttctttctcaggaatccaagctcatgtttacctcagcattcttttttctttgtagctttttgtgatgactaatataacatattcatatgctaaaatcttctgaaaagatatacctcaaaggaaggtgattagtgctatagcgctgtgatagttgagaatctagtttattattactattaattttaaaatttggtttggttctgtataggggagaaaaagtaagatcttttccttacccattgcaagggtcattgctgagacccctataaccaaaagacacattaacaagagaaaaacataacaaattcattcaatgtcatgtttacatgacacaggttattcaaaatgaagactcaaagaaacaggaaaagctgtatatttttatgcttggatttgaggaaggggagccaggcatgcagaactgtgaatgaacaaaatggatatggtctaatggtaataaaatgaagaggggacaccgtgaggaccgtttgttcagattcttcttggcatctttatgtcttcagttcagagatgaggacgtgtttttctctgggaacaggaaaagtccctctggaatgagtaacttatggactcctttaaaggaaggtcagataattctttaatggtttgtttcaggggagaaatgcaggagactgtttgaaagaccttcctgcttctactgctacctcaaatgcccaggcaccatattctgagatagcatgtcctgaaccccatcgctttgtttgtatttttaacttatattttaacttatatagttgatgatatttaagttttacaaaaattatctgaaatagttaagtttgtttctttctttttgaagacaaaatcgcctaaagaatgtgttggaattcaaagttggtttaagtcacagtttcaaaagatgaagtcagcataatgattacaattaatcttagtaaatgctaaagcagtgtataaagtacttttatttgggctcatttcatgcacccaacgaacaactccaataaatgccatgtgtattttcattttataggtcagttattgagtatcgataattctataccttttgccataatgagcagtagctcaagccaatgctgtctaattccaaatcttgaaaataaattaagtttataaattcagttagcaaatattaatggagaaacttaagtgacagagatacagcagtgactcaaacaaattccggttctagtgcaggttcaaaaaaacaaatacatatataatatgatatgagtaaaattaaatgttaagaagaaaaggcagggtaaagggatagacattagcagaggaggattgaggtgttcaaggaagttccacctgagcaaatgtcatttgagcaaacgattggtccatgtattttttaacaaatagaaagttaaaggatttacttaccttacatgtgctctgtaactctcattattataaatacaatatttaaatttctataagattttaccaagatttactaaaggtagtaaacttcaaaagcaatctatatagtcatgtagaattggaattaaaattaaatttaataactttaaattctatactcattctgatattggtagctaccgattttattaatcttctgttaatcatttattatacgaaaaagaaatattgcagaaagttgttttcctgagaattaaaatctatagagatgcctccacatttatttaattttggtgtagtaccactctgagacattcatgtcagagctttcgaattctcccctggatctgatggaactcactccgtagtaatcgaccaaatttagaagtaatcaactccatgtggcaaaccaaagcccagatggaatgcctcttaatctttagattaatgtgtctactcagcatttaaggtgtaactccaaaataatggagttgcaatacccttttactttctcaccaggctatattaagctacgagacctaaaacagatttaatcctaaaatatatccatttgtctaacatatttaatagcaaggctaaatcctttgaactgtataccttttatccttattgggataaataattgcttcacaaaatactaacagtttttagatattgaatttaaaaggtgaagaaaatcttgttactttcttgtaatggggtccaggaagctgatgtaactttaatgcctgaagaaaaacactgtagggaaaaaaagtctactctggaaataaaagttttacatagattttcccaggctattagccctggacagtctgtgataattagcttaccacagatgactatggtgaggagtcacatgctttcttatatagctgaacgagtgcaggctaaccaagctgacgggcatgccctcatttttagctccaagtaaaggtgtcgtttgattttccagtgctgtataattattgtttcttcccaggatattaatcttgaccttagggaactggagttttaaatgaaagcctacttttaaaagtgatagaacagtatctgttcatttttttcacacattttaaaagacatcagattcttgctcatattttgttacaattaattataattggtgcaaaggtagtcattttccaatataaacttttatagataaaatcaaaaacactaaaaagtgttgatacagggtcttaatatttttaaattaccacacatgtatctctccaatacctttatttaaatcacccctgctgggcgtggtggctcatgcctgtaatcccagtactttgggaggctaaggcggcagatcacgaagtcaggagttcaagaccagcctgaccaacatgatgaaaccccgtctctactaaaaatacaaaaaattagccaggtatggtggtgcacacctgtaatcccagctactcaggaggctgaggcaagagaatagcttgaaccctggaggcggaggctgtagagagctgagatcgcaccactgcactccagcctgggcaacagagcgagactttgtctcaaaaaattaaaaataaataaatcatcccttcatatattgctaaaactaagccatttgccgtgtacatatcttatgagatatggcgctttctggaattagcaagtctttgttatggcccactcacatagaaagtcagaaagagaaatagcagttttcatggcttctgagtaggcctttcagagcatcaactccaattttgtaagagaaaatatataccaaagtcacactagcacatgcataaaggccatggtgtatcatgcgatgaagattgcattcttccctgaatgtaatgaaggctttctggaagtagagagctttatcctttaaaaaagccactttgatagcagggtagagaataaattacggaagggggagtgttttaatccagaagagcaattgagaggatggtgtacaaatctagaaaataattagagaagggttaatctaaggtagtaagaagtgcagagcgagacttgaaagatagaagataaaaccaatataatatggtgactgggttgggagactgagaaagaagaaaatgtttagtttattggcttggatgactgagtggatgaatgcaccacttactgacatgggaattatgtattgaaggaaagaagagcaatgtgggaaagggtacacatttttgtttaagcacattaatttaaaatgtctatggtatatccaagtgtaaatgttttgtgaactgttgagtatcttagagtacaataagctgagatagagattaggagtcagtgattctttatacatgcttattaaatcacaataatagaagtaatcatgcatctatttttgatagagaagcgtgacgaggactgaggtcacactctgtgaagtttaacgtttaagtgatgtgtcaaagactaggaacccatgaaaaatgatttattttatttatttatttgagacagagtctcgttctgtcgccaggctggagtgcagtggccagatctcggctcactgcagtgaaaatgatttttttaagtggtcagaaaggtaggatgaaatgtaaaatgctttgacctcataaatctaaggagaagaatgtttttcaccatctcatttttaatatagtacttgacatattaaaaatgtcttgaaagaaatacagttcaactgtcaggtcttacctaatgtaagtttcctataaagtatatgggaacagcaaatgggaacatttgtaaaggcatacacataattcccagatagatagatcagtggctgtctagcaagaggctgaggaaacaaaatgcaggcattaaacaaattctgcctctctactacttaaaatcatgtaagatagtccagatgatgtatttgagtgaaagatgcatagcaatctctgtgaagttgttaggatgccttctcaagaggtggtaagtaactggggttggatgttgtgaaaacactctccattcataaataactatggattttcatacgttttcagcctgtgtaaagtcaaccctaaatgtagacctctgctagtcataattcaaaggaacgaaaaatagagagaagcaaaacatactggttaaataaattaggcttttaatatcgtcggccagaattcaagtatacacttccagtgcttcctagttgtttgattttattctcatagagcttaatttactcatctgtgaaatgtagatgttagcacttcctatatcacagccttgaggattgaaagagaaaatatttgtaaagtgtgttaaacagggcataccacatgaaagcattctaaaaaagaagtaacttataccaataattagagacccaaaagagaaaaatataacaatcccagatgggaaaaatattaacttaatgctggtctgtgaaattttatggaaacaggttatttagtaaacccgtatgtttctaaaaacctaataaactagggagaaatagattgctttgatgagttagatgtcttgataaaactagtcagaagccatttgtgagaacagacaagggaacactgcctttgatgtaagttctggctgttaagaagaaaaatgctcacagctgaagccacaaaaaagctagtaacccagatagaaaattccccttttctgtaggaacttagtagtggcaaaacccagaaagaaaacttatttctagctctccaagaaagggcagtaataacatgggccaggacaactaaacaaaactagcaaacaaaaagggaggaaacaaacgaataaaaacagaatattcaaaaagagttgaatgacatacatgtagctcaactcaatatataatcctaagattatgagcttgaaaataaactctgctagatattcattgtttgaaattggagacttcttcctaccactgtaaaagatgggatgtacctgacagattacaggtacagtgaaaatgtgaagagaatatattactgaataaggaaaatggggacatactaggaatcatcgttttcacatcagaaaactgcttgttaaatacactactgataggttcagaaatttacctaggaaattaagtctccaggtgagacttgtttagggtaaattccaaagtgttccaaaggccatcaaagttctaatcatcagacaattttttctagagttgattttgaccagagatatcattttctacatgttagctactgtgtgttcaggcgtatagtcttgccaattttatacatgctgccaagtaacatctttatggttacctaatgggtccgcatagagctacagtgagtttagaggctgagagacaataggttacattttccatgtctttttgtcatttttgttgcttttctctaatttctttcaaaatagtgatctctaaacagtattgatttttataataagtataatgtgtaataaatgtactgcattttttgtagctctaaatagcattatcgcagttcagtgtaaagtcagtgtgtcatttgttgctatagttttcgacctcccatctctggtttatctattcattaccacagttaacttgttagtcacagcttttattagcttgattctgagttattgtaattgtttccaactaatttttttattctaattcattctacaaaaatctaggtaatttttcttaagcaattctcattgtgttaattcctccattttcctctccctaactagcatcaatgttccctttttcccaaactttcctttgagaatttcctccctactcccacccacctccacagtattcagatacggagtttgaataagtttggtttcctgccaatgatatacaaataggctctgatctgtggaagccaaccattatatctcatacctgtgtcaccagtgaggggtttaagaatgaatacataagctattagggaaaaatgatgcctcagtttgtagttagggcttctgggaaaaatcttccttcttcccttgaaggaggtaaaagaaataatttttcttcttgtgcacattgcagtgagagtgtgtgagatccaaaaccattgcagccatttttgtaattagggaaactaattttaggatgaaactgacacaactgagtaaggagatctaggagatggaggtttgtttggtaaagcaaaattccagcgatgtcatgataaaggcagctctacctctgatgtttgcaatcacatgagccaatacatccccttgttggcttaaagcactattgagttactgctttctttctcaatcaaaagcattttatcagatagaagatatttttggtcagtgatatcatatctaaattttgtcactgctactttgaattctattcctactgagatagttaacaccccactattcccaaattggaatgtgaactgtttcctagtaatttctgttcttcatgaatttttaacaaaaatgttatacctagtgctatggtttgaatgtgtcccctccaaaattcaaatgttcccagtgtgatagtatgtagacgtgaggatttaggaggttataaggccatgaggacttctccctcatgaataagattaaggcccttaagaaagcatttgcatgcagcgttcagtctcttgcccttctgcctactgtcatgtgaagatgcagcctccctcccttccataggatgcagccctcaccggacaactgaacctgctggtgccttggtcttgtgcgtcccggcctccagaaccacgagaaatcaatttctgttctttataaattacccagtctcaggtatctgtatcctgttatagcagaacaaatggactaagacacctagttagtatccatgttgtctcataaaaattctacacgagttgttgacaaaaatttatttattctaacaattttgaaaatgttagtcaactcaattttgatatttatttgacacatgtcatatttccttttgctgacaatgagatatttataatgtttaatcaattgaacagttatatttttcaggccatattgttttctgtttttgatgtgtttcctatgaaattcatgtcacaacataaataaaatcctacctctttctttatgtattgggtgccatagaaaaagttagacttacgtaaaaaatataggctttggcaagagtatttatgactactattctgtatcatgtgcttatttttgactttgaaaaagaatggcaaaaaaatggctggtttcaaatatttcaccatgttgagttctgggttgtagcttccaatgaaatggggatctgaaagttggagaagagtgaaaatagtgtaatgactataggagtagatttgtttgataatgaaaaaaacagaggcaaaacacactcaaatattaggctggcgcaaaagtaattgtgatttttgccactgaaagtattacaaattattgctgatcttgatcttatatcaaaatcctgagagtttgtttatatgcagtgatagtaactcaaagcatttgaacaaatggattaacctctcttttaaggcactcaaattaattccaatgatacctttaaaaaaagttgtaaagctaacacatttgttttaatggaagataaacaaatgagatctgaagagcttaaaatggaaaaaatatttttttctaaactctcgtttctatttttcagagtccttgtatatttccagaaaaatgtttatacctacccaaaagtttatcaatttcctttttctttcctttctttcttttcttttttctttccttctctctatacattctgtgtgaaacttgctttctatttaatgtcacctaaaaatatttgggacattatgctgtatatatgcatagcattattttttcatggctacatagtattccatgaattgtatatatcttaatttatgtatgtattgtttaagcatatttgaattattttgcattgttttcatacaaacataatagcaatgggtgtattcctatttgcagatgtcctatctacttatctagacttttttgtgtagattactgaactgaaattgattgtcaataagtatgtttatttaaatatttttagatattaacaaatttcttccaaaatgtttcaaaaatttatactcctagcaaagctatatgaaagttattttttcttacctgtaatctgtatgccttttgtgaaaaaaagacttcagaaatttgtgtgcacagtgaagatccttgatatatgcaccatgcatacatacgtgtatttgtatatattctctgttttgtgtgtgtttgtgtgcatctgtgtgtgtatgtgttctatttgtaagagagaatgattgcattatgtcagaaataaaacactataaatatttgctgagtgggtaattgaatgaatggttgaatcacctatgctgttctgtgctgttcatagaattgagttgaatctactattctgctggaattataattgggacgctcagtgacaagcttctgctcagcaattggctttatagtaatggttgttctgctccttcatgaaatgaatgagatccaggtcaagccaattatgaagggagaaaacattgaagttaatgcaaatcattcagaataggtttaaataaccctagatttgtttaactaacatttagtttaaagaatatttgaaataactacttcctctgtgagtcctttcccaactaagtaaacctgaaatgtacatgcatccttcaagaaaccactgacacagccactttctcctggcatcaggcaagatgctgcagttgcaaaagaactgatttgcttcttcagtagcaagtgagcccattcttaggacaaaaaaagttttgaattttatccacaggtaaaagatatttttgttattagtggaatcagtgattcaaccattcattcaattacccactcagcaaatattattagtgctttatttataaaataatgcaattattctgtcttagaaataaggcacacctggtttgaaaactaattttctctctgactgtttgacattgcatatgtcattcacattctccaagatgatacactcacctgtcagtattttcagtatttgattttaaaaatgtggaaggcctgactcataggcatttagtgattctgttatcttcttttccatcttttattagcgtaaatgattgtcatcataatcaggtcatcaaccagggatttctggcttagaattattcataggtacaacgctgatggctcttctgaaattgcccctgcataggttaatccacaaattgtacatgtatctaatcttcggcctcataacattgtattccctcaacacctccattattttataattctgcaacagacaattcaattgtattatgttgtccattgctaacatctatgttggatggtttttatcaacagtctgtattgtagagggtgagaaaaacagtacaggtagcagggttcattttacctcatttgtatttatttagaacgatgctttttcaaatatttcaaatattgctatttttttcttgtgtctttaatatggttaggctttgtgtccccacccaaatctcagcttggattgtaatccccataatccacaagtgtcaagggagggacgagatggaggtaattgaatcacgggggttgggggggtggtttcctccacgctgttctcataatagtgagtgagttctaaggagatctgatggttttataaggagctcttccccacaactttgcttggcacttctttctgctgccttgagaggaaggtgccttgcttctccttcacctttttccatgattataactttcttgagacctccccaagcatgctgaactgtaagtcaattaaacctcttttctttataaattacccagtctcaggcagtttttatagcagtatgaacatgaactaatacaccccaacagtaacttattttcaacaaaagcacagttatgctctaggtccctactcttctaaaccatacaccctcctagaggtaaactaaagacctatatgatgtctcacttttcatctttacctgtgtttgccaaaggcacttcaaactcatctgtcctttctttaacatgtcttctccttcccaaagtatttttcttcaccttcagtccacattttagtaaatgacatcatatttcagtcattctgcatggctagaaaattaggaattatcttgggttacaatttcccaaacttttatattaaaaagagtatctaacactaccagttttatatcttaaatatttgttatatatctatcctttccatctttatttatagcacttttaagtcctttttaatttttacttgcagtttgacaaatatggttcttactaggattatactatgcgtattcctctataaccttttccctatgtaactctacatctttcttcccttcacttccttaatgtgttttgtcattccatgcccaccatgttcgcatacactaattactagaatgtgagacaacccctctttaaccctgtcatccctttgggttgtcaaaaccgggtgatccatctttatttattgctacacaactatgaataaagtttgttcccaagaaaagacagcaacgtgtctgggtaaaaggggatcatattctctgtaaaagatatgctagattctcagcctcatattcatttgtttctcaaccacctaagagctatgcattctcccaagctcagttcagacataatcacttccaggaagctttctgcaatgctgtgagtgtgaaacaagtgtgcctctcaatgtaatttagggcaaaatctgtaatatagcacttgattgttaatatatctttcacctttgttggactgcaaagtactgaaggacaaaaacctgggtcttttattttgtcatccgcagcttctaataatactgttccaggcatataacagataattgacatatagatgggtagacagacagataaatagatctatatctattacatataatggaattttttttgtaatatatattatattctatgatggcaaggaattgtacctcatttctcctttctgttaaactactttaatggcaaaatccattttagttaataattattcaataaatatgaaccaaattgagttaaattagcaagatacatcgtttaaattacaatgtatttgtaacaaaaatcttagtgtaatacagtgatttatatgttactttttaatattcattttttgctttatatttgtgtgttaattgttcaatgagatgcttggcttacaagatttttctcacccatatttaggtgaatgtatttgaattataaatctgtggtgaacaggggctgcacagatttaaggtaattttaatatgatcaacaaactgactttttttagaaaaggtagagttttgatgtaaactaatattttgataataatcctagcacccatgggtttagacaagtgtttttactcttatatgatccaaaagaaattaaagtggctgggcgtgatggctcatgcctgtaatcccagcactttgggaggctgaggtgggcacatcatgagggcaggagatcgagaccatcatggctaacacggtgaaaccccgtctctactaaagtacaaaaaattagccgggcatagtggcacaggcctttagccccagctacttgggaggctgaggtaggagaatcgcttgaacccgggaggcggagggtgcagtgagccactgcacgccagcctgggcaacagagccagactccgtctcaaaaaaaaaaaaaaaaaagaaagaaaagaaattaaaatataattttacatttgagacacactaacaattcagttgtctgatttaatatttctactcttgttgtggatgaatgtatatatttttaatagaactttggattttaagcaggaagttactgtaacatcaagtaaattgttagaaagtcgttcttcaagctccaaatgaaagattcttcactctttgaaaccttcttttgctgactccatagacttaaccacttgtgattagagttcccttgaccttgaaattgcattacagatagttgtctttggtgctactttccttaacagaccacaacttcttgagtgcagaaaccatagtttattgctctcctaattctaagtgaaaaaggaaaggagaagagaatgtaaaaagcaggggaaagaggcaagcagaaataaaatagtctttgaatattttgcagccacttaataaattcttaagtcagatcctttttgtcccacttctgacttctggttgactttatgtctactgggatggcctcttctcaagactcaattgtgttccagtatgttttctttcttctctctcagcatacctcccatttcgcccaagttatacagtaaacttgctgtttgaaagaaagcgctggacttgtttaatttatattaaagaatgggtgaccatttattgcttttatatggtatcccaatttgatgttaacattttaaaaaaagacatgctgacacaaagtagtaaatctctaatggtagaaattatctgtacaaatttgggatataagagcattgattatcagtactctttgtcctgctttcctcactgtcctgctttgctgaatagtatttgcagaagagagaaagagttagtatgcaggataatttacagaaacaagtatgatgtgggaagaatagagttttttgagagcttaataaatttttttcaacataacttttgaatgattcactctggtcatttagacaggaggcccaaatagcaatgttagaaagctgccagagaatttgttacacaagataaatccagcctttgggaaatcttgtggtattcctaattaccttcttgtttctttatacacgtaaggcttggatgctggaagataacacaattatatctcctcccccaatccctatgtaacagattttccacattgaatttcatttttgttttttaaataatatcaaacctttgcatttctccaggttagtaaaaatgcaggcctcattgtgttgctaaaggatcttcctcttttccccacttagaattttctgaacctaatcagcaaggagcattttgccaggctcctggtcattggtccataaatgaatgacactcttcaggccaagggctagctaattgccaattccgaactctgtgtgttaactagtgtgtgttcttttcacttttcaaagtcataacggatcaggtacagtggcttttgcttccacatttgagctgcctgaataaacaggaggtaatccctcaccttaggctgctgcataatgcattccagcttgttgctctgagtattttttgacagctttaacatttgttactggtagttgatcttggactttttgatccatgaatctgaatggtacggcttgtcctcatgctcatcatttcttggtcagcaaattagtctggggcccttgctcaggatcgtactaaaaatgaaaatccccatgcaaaataagtatttccataattttgagtatctttgttgaaaaagaaaaaaatgttctctctttttaatggcatgagacagttattcttccatcatgtgagcatcttgctctctgtttacaatgtgtatgttatgcagattcttatacaaatatcttttctatttttttaaacgaaggcaggttcacacctctgtcttgtgtccacctttccaggtaccagtgcctctcatttattcttagttttcagtattgcgatttgttttaggtagacgatttgcgccttgaaaaatagtcattgcaaacaatgagtaaatacttaaaaaaaattatagtgtttgtatagtaaaagtgtgtgttttttctcttctaaatttactgtaatgtcacattttacttgtaaataagtaggaatttcaatgtagtaacgtaaataagtaaaattaaataaccagtagttctaaatactgttttaattgttattgtctgtttacttcatagtagtaattgtaggaatatatttcaagaaagtaaatgtaaagtctaacaaagtcactacattatttgttatagtaaaaaatatcaataaccaaaatgcccaaaatgaagtaattgatcaaatttaatgagaacaacctgagggaatattatatgagtggagacaattgtatttatttaaaaaaatataaaaagttgaaaaatgctatttttatgaaaaagcagaatttgacatctaacatatgaaatgatctaaatcaatgtttttcagatgttttagtttccatttttaaaaataaaaagtgtattgtacctatgaccctcatatatgcatacataatacacaaataaaacaagtttttctcacacctgtaatcccagtactttgggaggccgaggcaggcagatcatgaggtcaagagctcgagaccatcctggccaacatggtgaaactctcttctacactaaaaatacaaaaattagctaggcatggtggtgcgcacctgtagtcccagctactcgggaggctgaggcaggagaatcgcttgaacccgggaggcagaagttgcagtgagccgagatggtgccactgcactccagcctggcaacaaaaggagactctgtctcaaaaaaaaaaaaaaaaaaaagaaaggtttttcaaaacaatagtcatcccattaaatataatgtatattgacattttcttttttctctctgttttaatttaattttaaaagaatttgaattgtgacctgttaaagtgatttattgaccaaaaaatgggttgtgatgtgtagctaacaagacattgacctaaaatacataaacgatgtactttgaaaatattctagaaagaaatgcagtataatattaatattttatacataacatttagatatggaatatttacatttttccctcattctgctccaaagttttaaaaatattggcagtaaacattttaacctcacaagtgtgactcaacttttcacgtgccatattttttcatcaagtgtaaatatgttttacttttccaagtgctttcttccagcttcttttccgtttttggtagggtagagcccaggttttaaaacacagagtatttttctggacctagtaagttcaagataaataactattacatgagtgagtgagttaagtgcttgaatggctttataaaacttaactcaaatgtgtttttatgaagtaaatgttagtttttattattattttattcacttcattacagagcaacatcagctctactaaaatggaagttaatatagtcaaatgacattttcatattcaaaatatactcttgtccaaaacatgtcttcagtgttaggacagagttatgtttggtgataatgctgtataaaatgtcatcctgctgaagaaagaacgtaggcttgggagccaaaacagtttgtagtgatctcgctgagccactccgttgtaaaatgaaaataataatatttgcctcataagctttctgagtaattaatttgtataaaatacctaggttcatgactggcacatatgttaagcgcctgcctttccttttccccagctactgggtaatattttaaaatattttataattttaaagaaaattgttgtcatttacagtcagcccttcgtatgtgatgtggaacccgtggacacagagggccggcttttggatccagggttgttgactgagtacaccgatgcagagccacacatactgagtgctggctgtactaccatttcatacaagcgacttgagcatccacagctttttgtatccacagggtttgcggagcccttcctcaatggataatgagagcaaactgcaattagctgtatataaaattacaatctttaaaaacgtaggcttttatatcaactgaagtgactcaggttcagcaacgcataatataatttttcttttctttcttttttttttgacacggaattttgttcttgtcacccaggctggagtgcggtgtggcgcgatctcggctcactgtaacttcctcctcctgagttcaagcgattctcctgcctcagcctcccaagtagctgggattacaggcatgcgccacaatgcccggctaattttttatttttagtagagacggggtttcaccagattggccaggctggtttcaaactcctgacctcaagtgatcagcccgccgcagcctcccaaagtgctgggattacaggcgtgagccaccatgcccggccgccaagataaattttataaataaatacataaagtgtaaatatgaagtgggaaaaaaataccatctaattttaaaaagatacaacacttacacagatatgatatggggggaatatatcttagaaccaaaagtactaagttgaatataaatcatcatgttgtactatacctatgaaagggaattctcatatatatttcagaagatttggccaacaagaatagaaaatgtctttgagctcatccctgtgttctttaggatcttcatttaaaaagcagagttgtcattcttgttttttgtttgttttcagggtgtactaaaaaactaaagtcagttcaccatcgtacatgaaaaattctcaaaaaatttgtaaacaaacattaaagatttaatttgatttaatttaatagaggaaattaagattaatttaatacaaatctctgtgcacattcaaaatagaaatggtgaattcttcttcatgttcactgagaagagataaggatattggttaaactggcaaagagaaagagcaaaaagggaaggtgctgttgaaattttaaagcagtcttttaaaatataactgaccaaaatgatttttagactctgatacaacaaaataagtgattgaatttttgaagtctcataacttaataaaatagtatgatgtcccagaggttttgatttacatctgaatagaaccttttaatgaaaacaaaatatacacaaaaatgaataaataaaaataaaaaatattttactgagaaaaaaagagattattgatcatttaatataggggtaatttccttaatacatctatttattaatgttatgaattaattttctcaacttagaaaaagtattccctacatagtatgaaaaattcaaacaatgtgataataaaaggtaatgctgcacaggaggtaaacacacaaactactgggcttgaattcaagttctgactccatctattaatatttctgtaagtctatatacaaatgtcgcttaatctctctttgcctcaattttaaaaaaaatgtaaatgaaaattaaaataattcttgtttctattatggggcttaaattgcgtaatactggcagattacttaaaacagtgcttggcacagaataactatccaatatattttagcctttataattattgtataataatatagtcaaaagacacaagcagagagtgcttacagaaagaacaaaatggggcaacaagtatataaatcagagccaaccattcttacaaccaagtaaatgaaacaatgagacctttgttaacatatcggattgaaagatttatctgttgttataggtgtgggaaaaaaagagactctcaaacactgttggtgagagtataaactggcataacctttctgagggcaatttagaaactatcaaagtgaaactgcacgcatcttttgacctagaaatctgacttctaatattactgatatttaaacatgtctacaatcttgttaacagaaaactaatggatgcaacatagcagttctagtatgagttgtatgtgcttcagaaaagtacatatacacattcatacaaaatatgagtatgcatacagtcatgtaccccataacaatgttttggtcaataatggactgcatatatgagggtgcttcaatagtggagctgaaaaattcctatcatttagtgacattgtgtcctttgtaatgtactgcaatgcattattcaacgtttatggtgatgctgctgtaaacaaaactattggactgccagttacataatgataatatacaactatgttactggtttacatatgtactatactatacttttcatcattactttagaatgttctcctttcagatattttttataaagttgagtgtaaaacagccttaggcaagttcttcaggaagtattccagaggaagtcattattataatcataggagatgacagcttcgtgcatcttattaccactaaagacctttcagtggaacaagatgtaaaggggcaagacagtgatactgatgatcctgaccctttgcaggcctcggctgatgtgtttgtttatgttttagtttttaatttaaaaagcgtaaacattaaaaaaaattaaatagaaaaaatcttatagaaaagaacataaagaaaaatatttttgtagggtgtcaattttggatctttcctgctttctcttgtgagcatttagtgctataaatttccctctacacactgctttgaatgtgtcccagagattctggtatgtggtgtctttgttctcgttggtttcaaagaacatctttatttctgccttcatttcgttacgtacccagtagtcattcaggagcaggttgttcagtttccatgtagttgagaggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtctgcttggtgcagagctgaattcaattcctgggtatccttgttaactttctgtctcgttgatctgtctaatgttgacagtggggtgttaaagtctcccattattattgtgtgggaatctaagtctctttgtaggtcactcaggacttgctttatgaatctgggtactcctgtattgggtgcatatatatttagcatggcacatgtatacatatgtaactaacctgcacattgtgcacatgtaccctaaaacttaaagtataataataaaatttaaataaataaataaataaataattttgaatatgtagttgcataaaaaaagaaaaatatttttgtatagctctacaatgcatttgtgttttaagctcaatgttatgagtcaaaaaagtttacaaaattaagtttataaagtaaattaattacagtaagctaaggctaatttattgaagatacaaaaagattttaaataaatttagtgtagcctaaatgcacagtgtttataaagtctacagtagtgtacagtaatgtcctagggcttcacattcactcccattcactcctgaactcacctagagcaaaataccaaccctgccgcctccattcaaagtaagagccctagacaggtatagcattttttctttcataccacattttgctatacctttaatacatttagatacatgcgtaaggttactaaccattgtcttccaattgcctatagtgtgcagcacggtaacatgctgtgcaggtctgtagcctaggagcagcaggctatgtcccataaagcctaggattgtagtaatctataccacccaggttcgttaaagtatatttatgatgttttcacaagaaatcgcctaatggggcatttctcaaaatatatccctgccattaagtgaagagtgactgtataggcataccttgctttattgctctttggtttattgcagtttgcagatattgtcttatttataacgtgaaggctcgtggaaaccctgtgtccagcaagtctgttagtgccattttttcaacatcatgtgctcacttcctgtctttgtgtcatgtcagtaattctagaatagtttcaagctttttcattattattatgcctgttacggtgatcagtgatcagtgatctttgatgtcactattgtaattgttttggggtgccacaaacagatcccatataagagggtgaacataactgatgtgttctgccttctccatcaaccaaccattacatcatttctctcttcctcctccatccttattccctgagacacaacagtattgaaataggccaatgaataactgtacaatggcttctaagtgttcaagtaaaaggaaaaatagcatgtttctcattttaaatcaaaagctagaaatgattaagttttgtgaggaagacatgtcaaaagctgagataggccaagagtgaggcctcttatgccaaacagttagccaagttccaaatgcaaagggaaattttctgaaggaatttaaagtgctactccagtgaatacatgaatgataaaagagaaaaagctttattgccaatagagagaaagttttggtggtctggatagaggatcaaaccagccacaacattcccttttagccaaagcctaatacagagaaaagcccttactctttgattctttgaaggctgacagagttgaggaagctgcaaaagcaaagtttgaagatagcagacgttggttcataggattgaaggaaagaagctttttccataacaaagtgcacggtgaaacagcaagtgctgacatagaagctgcagcaagtcatccagaagatctagttaagatcgttgatgaagatggccactaaacaacagatttttgatgtagacaaagagccttctgttggaagaagatgccgtctaggactttcatagctagagagtagaagttaatgcctggctttaaagcttcaaaatacaggcagcctctcttgttaagggctaatgcagctggtgactaagttgaagccaatgctcatgtagcattccaaaattcctagagcttaagaattatgctaaatctactctgcctgttctatgtaaatggaacaaaaaagcttgaatgacagttcacatgtttacagtatgttttaccaaatattttaaacccactattgagatttaatgctcagagaaaaaaaaaagattcctttcaaaatattaccattcactgacaaagcacctggtcatgcaagagctctgatggagatgtacaaggagagtaatgttatttttatgcctgttagcagaatatccattctgtagcccatggatcaaggagtaattttgtcttttaagtctttttatttaagaaatacattttgtaaagctattatgaccatagtgatttctttgatggattttgggaaaataaattaaaaaccttcttgaaaggatttaccgttctagatcccatcaagaatatttgttattcatggaagaaagttaaaatatgaacattaacaaggggttaaaagatgtcaattttaaccctcatggatgaattttaggggtccaagacttcggtggaggaagtaactgcagatgtgatggaaatagtaagaaaattagaattataactgaaacataaagacgtaactgaattactgcaatctcatgatcaaacttgaattgatgagaagttgctttttatggatgagtaacaaaagtaatttcttgagatggaaactactcctgataaagatgctgtgaacattgtggaaatgacaacaaaatatgagattacataaatgcagttgataaagcagcatcagggtttgagaggattgacttcaattctgaaagacattctaccatgggcaaaatgttatcaaacagtgttgcatgctaccgagaaatctttcaagaaaagaagagtccactgaaatggaaaacttctttgcttattgtaagttaaaaaattgccacagccatctcaaccttcagaactactaatcttgtcatccagaacccaataacattaaggcaggatccttcactagcaaaaagatgaccatttgccaaaggctcagatgatggttagcatattgttttggcaataaagtattttaaattgaggtatatacgttgttttttacctaatgctattgcacacttagtagacttcagtgtagtataaaaataacttttattgcactgcgaaaccaaaaagctagtgtgacttgttttactatgatatttgctttattgcagtagtcaagaattgaacttgcactatatcccgagtatgcctatatatggaaagataaactgaaaactgaaaacttttgatatttcctttaagtcagtgagactatgaagggtgggacctatcatggttaaagaaaggaagatattagactttcatctcatagctttttaaaaaacgatgtgcaattgttatagtaaaaatgtctaaatgaaatatatagcttcaggcataaaatgtataatcataagggctaagcaaaattgaaaacaggtcactgaacaaaaaggatatttaaaaagctctacttaatttaaaagctctgttggttcagtatgtatatttatacatatttgttgaagaaattatgtattttttataaaagaagcagcgaagagagattaacactgctgaatgtggtgtcagacaaagcaaaaaaattaacaactgtcacaattcttgtagtgtagataatttttgataaaatatatgcaaaattagaattgatagccacagcctgaatagatttagctgaaattcctgctagagaaaaatgactttgttctgaatatttgaaatactagctatgggattcagaataaaaatgcattgttgtagtattaggtaaacacttgcttaatagaacaaactgacaaagatatcatctgtctttttcaccattgtatttcatgcctgcgttgagattctcattttatttataataagaggtaattattaggccatagaattcacttagaaaaaactgatgcattttataaagttcaaagtaggaacatattttaaaaatgtaaaagctttgccttaattgtcccctcaatttattagttaattactaatcagtttattagaaatgtgatttgtacatcaagatcagcattaaaccataaatgcatgtgttttctagatgcatttatgctgttttatttctatatgctattttattaagagatttatagatgaaataggaatctttaagttagctgatatatagtaaatattcattatatcaattgctattatctcatacaaaatgaataattgctagctatgctttaaaagatatattttaaactacattgtagagagtcatacacttaaatgtttatttatataattttatgaaaaaaaaaaaacaaaatcatatctatacaccttaccaaatggaaagttttatggtcagctaggtttttctgaccgcttaccctacactaaaacagtggttcacatatgattatgttatgaattgatcaattgctcggctatatgcaataccataagtaacagaataaagagaaggtgctaattgttaaaaaaaatggcttatttacaatactcataaatataagtccaacctgtcttttatccttaagctaaaatgagatatataaactggaagatctagcaataaaaatcatttttaccattccagtggtatatgttctaatcaatttctaatatgtagaattttctcaaactaagagtctattttatattggcaaaaattttcctaataaccttgggtaattaaaattcatatttagctcaaatttctggtaagagaaaacgaactccatatagactagaattagtctctgtggaaactagtatgttctctgaaaagagcacttttcaggttcttctctttttgaaaagtgagttggtcaacaaaatgaaaaataacaatggtgcatacataatgcacacatccacacacatacatgcttacgcacgggcacacaatccaaactgagagcatcgagtgagggtcaccaatggggcagtgactggcaaatgtgaatttctttcatggctgttgatatagttgttaggaaaaaaagatttaagtacacttgttttcaaaatatattatggaaaacattgcagttttacctcaatcctaatcctgaatttttttaagatttcttgttaatgaaattcactatcatgtgtaaaaatgttagtattaaaaatgtaagaacttgttttttcatttcatttggaatgcacataaaaattagtctgtgagatacttatgttaggtgtcattttgtaagggatttgttttaatcccaacaagtgaaataattagcagtttaaacaatgaaaaatgaatgggcactaattgtgattgacatgaaagagtatttctttgattattttaagttatttggtaagtagaataaaagggggagggaaactaaatctgtttgaattcctgctatatgttacacacacagttgaattctccacaaatgatctaagtttattccttacaacaccctatagacaggttttatctctcttttaaagaccagtcaaatacagggaggttaagtatcaagtcagaaatatgagaagtcttctctttcctttatccacaaatttaaccggtcatcaagctctatcaaatttccttaatgtcttgtatattaaacccctttttatattttctttattattcccttaacccttcatcacctctttcctggactcttccaagagtagatcttgcagtagatcttctccacagcctttttctacaatgcaaaactaatcacatgactcctttccttaatgcccttcaacatgtctccatttttcataggatgtactccgaaattcttggcaagctctacaagactctccacaatctggtccctgctcatcacttaaggtttatattcacacattcttattctatttctctcctagacttctcagccatcccaagataattgcagttctgaatctattttctgctgctttatgtctgagtattttctcacctgcctttctttgacttgagctcaccacgccccacctcaaaatttctgccagattgtcttctgtaagctagtgataacgtcacttccttcataaaccatttgctcacctgctacccttgttctctgtcccctcttacaagtgaattgacagctctaacacacatttctaccatagcccacctaactttagtttcagtagtaacttaaatgtttttctttgatcgttagtctgggattaagtttagggttaggacagggacaatgttatattttgtgtgcaaacctggtaactagcatatttcttgggacatcataggcattgtatttcttattttgtttgtaaaggaatgatattggagaatatgaagggtattagaccaagggaaagattagacattcacccataacctagaaaagaatcaattcagggtatccaaacagttatcagtcatggaccttcttttagagttttataattaatattactcaattctaattatttcatatctgtgtgtgtgtcttttccaggtttcaaatttccagtatattaaatctgatttgctcaagttcagtcggatgcgtacaactgaattagaaaaataacttagactcatgtgagatgtgaccagtaggtgtcattcacaggaaagcagcattgttaagactcaggtcgccactttatgagacacccgttggaggtattcaaaggactttagctggctaggtagtatttaaccgataaaacagagcaagtatatatagaaaacatttatcaacaaaaatacagtagacccacaaatttaaaatcactacgagtcaaaacctctagcgacaaatcatgaagtgggtcttcaagctcttgtgaaactctggtgtcctgaattatgcatatcactgcagtcacaacaatttgagaaaaattttacttccaaaaggaagtagcaacaataaggttaatgttttacattggaaaagtgatcgttctccagggcaatatggcagcaatggctatattaagtatttagtcaaatatactataagcttatggtcttccattgtttcttattaagataaatgacaagatcttccattttctttgtagtccagagaatttgaaatcattcctaatatcttcttcttttcatatttaatttcccaagtaattataataattatgcccatataatgtctcttaaaacttttacattgtctacctccagtgcaacactttacttcaaattacaattttatttcacctatactgtgaattagcctcctaatttataactaattgtattaaatgcatccattctgctaagctccacccttctaatttcttcttcatacctcatccagagttaacttttgaaaactcaaacctaagcatgtttctatcctgcctgaaactttttagtgggtttccatttctcctggaataaagacagaagctcataacttggtctaccagtaccccatctccaacttcactaggctctgcctaatcaaactcgtctttttttcttatcctttgtacttagactgctccagtaagtgtacatgatgttctctgtggaattcccttttattgcttttttacttagttaatttctactcacccttacgttctcagctcaagctaacttctttatagaagccctctttgatctccctgctgggtcaaattcctctactgtctttcttatgcaatactcttcttcttaacatcatgctgctatccttacagtttgttcacagcaccaattttactcatttgagtgtgattatttaattaatgtctctacactaaagtataatttttgtgaatgtggggatatgtgtgtttctgtttctaaggtgtctatcacatggcaacaaattaggcaatcaaatatttgtcaaatacatttatgtatcattcaccaaaatgttagataataatttgaatatgtcaattttcttccttctaattatgctctcatttataatacatgttcacagtattatttctacttttatcatatattaaaacagttattaatagataatgctcagttttaatcttcatttatgagtagataaattgctagtttaactgcataaaaatatacatttcacattccatgtttattcaaccagtctgggaacaattctagagtttacatggaaaaaaagaagagcattttgtactgtcaaaagagttgatatgccctaattctcaccctaactagactgcaggtttccctgtcagagaccatgcatttaatgtttttacccctaaggaatcaggagaattccagactttaagtggatagtcaataaataatttactgtatttttcttcccacattcatgctcccttagctgtttttgattacttgtctgccatttttgtggcaaccttttgtgctagttcactgaaccagaatatttaaatgtttttatatagcatttattttacgctcaccctggcttttatagcacatgagaattcaatacaaccagaaagtatttggtgacttaaaaattaaagtatttatgttagattctctggcagaatatttatattttggatttacatacagctattgaaatactctaaatataaagtgagagtttcctaaactttgaagtagcttagaaaacatctaacctggctgtaagaaattaataacaccaaatttgtatagtctctcctagataactgcttttaatgaactattatttctcatttttattctctttgtactcccccaatcctcatcagtgatactaaggtaaacttacatgctttatgcatgatcaaagtgcttacacaagaaagataggatgattaagaaaaacaatgtagggagcagtttcttaaacttcttattaaagccaacttaattctctggaaaagaattaagcagcatttgaaggtcaccagctcttcccaaacctttcagagtatcttgtcctgagacacaatgtttgtgcagcaacaactggttgcctgataaagaaagaaaagagtgagggacctcactgataaagaattgtcatggggtaaaggacatgagggaaggtaggagtgttagtacatacaacctcctgctttttctttccttctcatacgtattttgggatccaagagaagatcacaaatatttatggtccaaaaattttttaccaaaataaaaaatgtatgtacaacatcataaaaatgttacaatggcttgggtagctcaaaaaatgtcaactgggcacctttgtttgtactgctttaaggcatcaaataaatgttagttaaggcaggatccatggtagaggtaaatggcttatgatatgatcagaataatagctttcaattgcatagtaatatgcggtttatatagctccttcagattaattatatcctttaaatctcatcacaaccaaagattatatgattaaaatttagaagagccagaaccaaaacccaagccttccattttaagtccagtaagctttccactatgggatgctgaatcctttcttttccttcctcatctcctcctactcctcctcctcctccttctgtcaactatattagttaaatttagatgtgctagcattgttggagctggggaaaagatgtggctgaaggttgataacatcaatccttcaagcctgcttcctgagcttccagaagttgggcttgccacttaacttgctggatatatgtctaacttttctgagatcaagtatctaggtgtaaaatagaggcattacctctcatgcctaaatcacaagtttctttttaagtttgataccaaataatttagaaggaaatactttgtaatctctaaaaaaataattttaggtgacttattttaattgtatttatcattttcaaagaataacattataataattgcattcactaggtacaaatttcaattgatgaataaaaatgtgagtcatcctttcttttagaggagaggaataaaaaaaggacactttgtaaataaagtttgctttaactgcgttagcttgctatttcccaccatcacttttgtcctcctccttgctcattaagcagtgagtccaaagtgtatctgttgctcttgttgctgtagttgactctgagtggctacagtcttttctaacttggacaagaaaagctagagcatcagtaatcagtcttttcctcgcattttgcttttgtttctggtaggtaacagttgttttagaacaaaattcattcaaacatgtttctctattaattagctggggatgagtttatctgttatcaggaagaagaataaggaacaggctcaaaatgtaagaacatttgcaatctctttacctttgcagtaagtttccttctgcaagtagtcttgtgactagcagagatttaaagcttgggtaataaaaaaaatgaataaaaaatcatcttctatgagaatgtcaaccatggggccacagaggaaaactggaaacttgggaaaactgacatgaagtggaggaggtttattttctttttctctctcttatggtaagatttggagacagcagaaggagagaatatgaacacctataaaagaacatataaagttcttttcagagaaagaactttaaggaactttttgaatagagcaagtttataattaaaataccatcttttagattacaactgttgtcattatggaattagcagatatttaaattggattatttttaccaaattactgaattttcatcattaattgaggtcaataaatctaatttgaagtatcaggaactaagtggttattttaataacaagtctagaaaataaaatactatacatttttttcaaatatgcaaagggctattctagtatactactggaacaagtaacggtattctaggaaagttttatccatatttactacagaaaatttaaagaaggaataaaaagatacttcttgtaattctctatagacattcactaaagagctgagttatttggagaatataaataaattatttaatactttgtaattttaaccaatgactcatcttttaaaaattgtttggattttctgcctttaatgtagtcgaaggatcatatgattaatatagtaggaatgaaaagaatactttttaagttgtacattccagctacttttaggaaagctcatatttaaatactggcatctatctttctttattgatattctttagaatacttcaatattaatgtaatagccttaactcctctccttgtaactaatgccgtgccttctcgcccttccttcatgtgttacaagaatcatccttccaaacaaatttgattaggtcacactcccactgaagaccattcaataacctctccctgtacacacactaaattccaaaaaagtccaagatacttacttatgttctggcactaaccaaaacttctgtttattattatttcacattatgttccagcaataccaagccataggcaattatctacattctatcaagctatcatatttttcctcctttcagtacttgaaatgactttccctcttttaccccgtacagcctttctcatctttcaaagtctactacattcgtctgttgacactcttcctttgtgtcaactacttgcgtacattgagtatactcttattattgctcttatcacactgtatttgaacatactggtacagtaaattacagtctggattatgggctgtttaaaatagaatgcttgtggctggctgggtgcagtggctcagcattttgggaggctgagaggggcggatcccttgagtttaggacttccagaccagcctaggcgacgtggcgaaaccccatctctacaaaaaacacaaaaattagccaggtgtgatcgtgtgtgcctgtcattccagctactcaggaggctgaggctggaggattacttgagccctggcgatggaggtagctgtgagcaaaggtcactgcactccagcctgggtgacagagggagaccccatctcaaagaaagatagaatagaatagaatagaatagaatagaatagaatagaatagaatagaatagaacagaacagatcagaacagaacagaacagaacagaacagaacagaatagaacagaatagaatagaatagaatagaatatgtgtttgtttttgtatcctcggttcccacactccccagcacatatctaggaagcgtgattgagcaaacatagaacagatctagagtaagagagactcaacaaatgccaagtggtttctttactgagcgcatgctgatgtttgccagagtttaggttggatgttagatgagtacaagcagtcattaatttgcaaaagattgatattctctgaatagcccagactacttcttccataatctcttttctccagagctgtgccaaagatgaaggactttcttttttttctggctgaaattgggagaaatgacaagaaatttgaaaaatagaaataaataaatacctataaaagtaaaaaaatgaatgaaaataacttttcagaatatctcttcagaaatagacaatttatggctcaacatgccatagcaacaggcagaaaatggtcaatcacagtttctggtctgggtcacttttgatggtgcttttaatctggcattgtcaggtcactatttggaggatattccctgactaagctgttaaaatttctgattatacaagtttgttttgtattttcataaaatgatcattttaatttaaaggtataataatattcttatttcttattcaacattttatatctttgtgtagaatattttccttattgttttcatctagtttgttaaattaaaattaaatctctaaaaccaactatttgtgacaaatcaccaaagcctttagtggtatttgtacagcgaaatcatgaaataatacgtgtgtcaatgaaatatatttatacttataggccgagagcagtggctcatgcctgtaatcctagcactttgggaggctgaggcaggcagattacttgaggtcaggagttctaaaccagcctgtcctacatggtgaaaacccatctctactaaaaatacaaaaaattgatgatgggtacctgtaatctcagctactcgagaggcttaggaacaagaattgtgtgaacctgggaggcagaggttgcagtgagttgagatcatgccactgcactccagcctgggcgacagagcaagattccatctcaaaaaaaaacaaaaaaaaagtgtatttatatgtatatatattttcaataaaaacatactaaattgtataaatactaaaatccttccatctttttcccctaattttagtcatcaagttcttatgatcaattggctttcaaaacatactgaggccttcttaacaacaagtgaaaatttccaaataaatgatcttaattaaatcatttaaagtacagagcaaacatgaaagaactattagttatgcctcagtcctcatagaaattatgtgcactagatacagtacacattgtcatattttcctacattattgtcatcatttaccatgaaaagccaatttaaagggaggctttttttttacattaggaagacctatcttctagcaaaatattataaactttaaagcaagatcaaaactaaagtcaggacactagttaatgaatctggaaatgaaggtcaaatgggactttgtggatcaacttataatttaaaaaaaataaggacaaaaacagcacacagcttgtttaaagagacttccaggtgctgctatatctttagaaattttgattatcttataagtacgtactaagtacaatagtcactattcctaaagtacttctagtgcacagatgaatagattatgaaatatacaaggctcaaacgatatgtcaaaaacattgtccagataagtagtataggagttttgaggaagcaggattcacttcaagttaggatgatctggggtaattaaaatgatagatggacttgtttggcaaatgaggtgacagaggtatttctgaatttgtatgaagagaatttaggtaatagctgcaagctacaaaagtttgaagaaatgcatagacttgctagagtggaatattagtaggtccactttaagaaagcaaaaggaagaatgtggttttaatagccaggcagagagccaataatcaatagagtcttgagcgtgaatttctactcagaaacaaaatgactgacctggtattttttgttattgttcagatagttttattattttttctaagacattttcattaactagaatagagagaggatgattatcaatcctattgctttgaaaggcacaaaacaaacactgacatgagataaattaaaaaataaaggtttattttagttacatcaaagcagttctacatttaaaaggcattatacattaatgttttatcactttttatatatgtaataatttttctttgaagtgaagatgcagtttagctcattggatttgtgagtaaaacagatactttcagctcctttaagcaaaaaactgtaaggctatattaaaacttgtcagtctattgataccatagtctctggttctgacttgccaataacttgatctaataataaagaagagaaaatatttaggaaatgacgtggtagaagaagaaaagaagtagtgtgttttttctttaaatgcttcaaaatagagctcttcccactgacttatacacctgcgtgtggggaacaagacctaccagccactgtgtggtctcctttgatacttagaacagcccagaataacccattcaattcattggatgacttcatttcagaaatcatgctttttactgaaatctgaaagccgagaagtccggaactggctttacaaagagatgaaatagttttatgcaagaatagctcaaacaaaatgcagggatttttttgtattccttgtggcttcgttgacagtgatgcattgatagtttgggggcaaatcttcctaggttggagctgatcaacaagtgggaatctgtagcaaattgtgtcaagtcacgatcaattctttgaggtgtaatgatatttttattaaggcaagtcagtggatacttagtacctattaatgttatatacaaggtgtggcatcgaatgtgttcaagtgtaagtctgtgttaactgatgcttctttacaacagatacctacatattcattatgtgtacatttgttttcatttgagagtgaacttgatgttatttgagtccacagtctgtaaaactcagccaacacacagaaaagtacactgctgctagaattgctttccaagatcgtgaaactgctctgatgttttactcagagagaaacctttacaccatttccacagtcgggtttgattgaacaaacaggttgtgcatttgtaatgaagcatgtggatgaaaaacacaaagtacccaatcacctttgtgctcattgtaagcctgttaacatctcacatatctcctgagatccactgcccttttaactaagagtaaagccacttgtctcccctaggatagctgggatgtctgaaatagcagaatgtttgcttttgggctaaatgcctctcctgctagctagtttagctattgattgtgctttagcttatgactactttgccctgagacttctctcaaggattataatctatctaacatttattcagcacagccaatgcctttagtcttcagggtttcctttctgattgaccttatgttcccttcaagaaactaccagagtataggcatgagggatattaatgtgatccctaggttaaatattatttcattccttttatgcaactgttctcttacagtcagagacaccaagtctttaataaattataatttctttaaaattataaaaatgtgttggttagatttaacaaaattaactatgcaaaagaatgcagagaaaagctacataccaagacttccagtatgaatatggaagaaaaatagagcaacttctccctttttctgcatttcctacaaaagtgacaaggtaaacagaaaaaaaaataacctctctattttcattgaaacatgaaggcatatatcaatcacagactgtgtgactctcatagaagccatgtgaagtgaggttcagcagaagcctcgaatgggaaagtgttcactaacagaatgacagtacaactgccagggcaatgccagtaaaaatacacctcacgaaggcataaggcaaaggcagagttggaaaaaatttattatctgcatcaaacaagagttgcaggatctagacagagtagacagagatcaagcagatgctgcatagacagaaaagttgcaacaaagccccgcagagaacagtcaaacaatccagagatgcaaattttagaaaaggcaacaaatcatgtaatctttgaaggaaatttttacaaataactgggccaggaaatctaatgcattccttggtgaaccctataaaagttggaaacaatcaatataaaaatactattggaaagctttgctagaatgatgctgtcataaaacactaaattcaggagaactatcctaaccttgaaagatcaaaatcctgaaactataatgctggaaaaaataattttaaaattattctaaaaaattctttacatatttaaagaggaattatttgagaaacatacaaaagcacaacaatacttcctaggccaatttacacaataaaatacacaatggtaacatatttttgcaagcataaacagtaaggtatactaatgacagtcacatacatgtaatagttacgagcacgtgaattgtattcatacagaaatacatctaaaagcaaaatctataaatgcatatcactatggtcagttagtgtgagcaccaagctttataactggagtcatctgaaataccatggcagacaacctgagatttttgacaagatctatggaaaaccacagtaagttacaactgcatatgcagtcaccaaaagagctgagatcttgagaaactttatctttcacaaatgcacacgtacaaatgggacatttctccatttattaaggaagcttcagtgttttcactttgagaaccagagaagctgatggtgtaattctcatttgtaggctgaaagcttcaggacttagaaagtccaaaggccagtgagctttaagttctaatgtcaaaggtgacataagaaaggtcagccaggtgcctatggctcaggccgggcgtagtggctcatgcctgtaatcccagcactttgggaggccaaggcgggtggatcacctgaggtcaggagttcgagaacagcctgaccaacatggagaaaccccgtttctactaaaaaaaaaaaaaaattgcctggcatagtggtgcatgcccataataccagctaataccagctactagggaggctgaggcagaagaattgcttgaacctgggaggcagaggttgcagtgagccaagattgtgccattgcactccagcctgggcaacaagagtgaaactgagtctcaaaaaacaaacaaacaaacaaaaccacaaaaaagaaaggtctgtcccagctctcagaaagagaccaattcacctttgtatttgttctctccagggcccagctgattggatggtgcccaccatcactgagggcagatcttccccacctgatccactcaggttcgcacactagtctcctctggaaacacccacacagacatattcaaaataatgctttacgaagtttctatgtatgacttactccagtcaagttgacacctaaaactaagtccacaaatctaccccttgtcaacttggcacctgtaagcatcctcttaaaccatacttcatttccaaataaagacaataacaaggtaacagttacacttaacatgaaacaacgatcttgtgattgggatttttagaacttttcttttaaatgttagggattttgaactgtagatatttagacataaggaatttttatatttcaggatttcaacattagggttaaggcatttgggattgagtctttggggattatgatccaaacccaaagttcagaccaaacactttaccatgactttgaaaaggtaacaaaataattatttcaatgaaaataatacagaaaaaaatgaaatgcaagaactcaggtgaagcaacagtagttggttaaaattaatttttagaacacaatataaaaataaaacaagttaaaaaaagaacaaagaacaaggtaaaatggacaatgtggaaaacactgtaattaacatggagtggagtatggaaaagaaaaaatatgagaatgaaaaaccagtgaaataagattagaaaatgttaaacaaataaacagtaagcaaaaatattaaatatttgcataattgaagtttcctttaataagaaaaacaaaaatacttaaaaatattttaaagtgattagagggacataaaacatttaaggaaagcattattttatttttccatattttgtatttttggtacttgttagtctttacaactttgcaatgtgttgtgatgtttttccctaaccaagcaagcattcaatttgtacccaattctgtacttaaaattgtatattatttttctaaagaagacactcagtatgatcttcagataccctaactccttggcctgctcctgcattactgtatttctctccttaagatactataaatattaaatgcattcttaatcatccttttgcaatcagtctgtattaaaaaactgtaggttactgagagtctaatttcataaggtaaacatgattttgttgctgtagtatgaaaccacaaaggaaatagcagatattaggagaatgattatgatttccctcattgattcatacaataacaaacacttattgaagtcctgctatgtgatacacttttagtctaggcaatgtacaagaaaagataagccaaactttccacagccctgaacctcatggatcttacactctggtgggaagtgagcattaaaggaataattacacagataattacacagcttccatactgatatgggttggctgtgtccccacccaaattccaacttgaattgtatctcccaggattctcacatgttgtgggaaggacccaagaggaggtaattgaatcatgggggccagtctttcccatgctattcttgtgatagtgaatacgtctcatgagatctgataggtttatcaggtgtttccgcttctgtttcttcctcattctctcttactgccacagtgtaagaagtgcctttagccctctgccatgattatgagtcttcctcagccatgtggaactgtaagtcaaattaaacctctttttcttcccactgttgggcatgtctttatcagcagcatgaaaacagactaatacaataaattgataccagtagagtcgggcgttgctgaaaagatacccgaaactggggaagcaactttgaaactgggtaacaggcagaggctggaacagtttggaaggctcagaagaagacaggaaaatgtggaagagtttggaacttcctagagacttgttgaatggcttttcccaaaatgctgatagggatatggacaataaggtccagactgaggtggtctcagatggagatgaggaacttgtggggaactggagcaaagatgactcttgttttgttttagcagagagactggcagcatttgcccctgccatagagatttgcggaactttgaacttgagagagatgatttagggtttctggcggaagaactttttaagcagcaaagctttcaagaggtggcttgggaactgttaaaggcattcaatttttaaaagggaaacagcataaaagttcagaaaatttgcagcctgactattcaatagaaaataaaaacccattttctggggagaaattctagtcagctgcagaaatttccataagtagcaaggagcctaatgttaatccccaagaccatgaggaaaatatctccaggccatgccagagacttcatagcagcgcctcccatcaccagcctggaggcccaggaggaaaacgtggtttcacgggccaggcccagcgtccccgtgctgtgtgcagcctatggacttggtgcactgtgtcccaaccgttccagccgtggctgaaaggggccaatgtacagctcaggctgtggcttcaggggatgtaagccttaagccttcgcagtttccacgtggcattgagcgttcgagtgcacagaactagaagtcaagaattcaggtttgggaaagttcgcttagatttcagaagatgtacagaaacacctggccgcccaggcaaaagtttcctgtaggggcggggccctacattctccattctcatggagaatctctgctagggcagtgcaaaagggaaatatgaggtcggagaacccacacagagtcccttctggggcactgcttagtggagctctgagaagagggccactgtcctccagaccctagaatggcagatccaccgacagcttgccccgtgtgcctggaaaagccacagacagtcaacagcagcccctgaaaccagccagaagggaggctataccctgcaaagccacaggggcagagcttcccaagaccatggcaatacacctcttgcatcagcgtgacctggttgtgagacctggagtcaaaggagatcaatttgactgccccgctggatttgggacttgcatgggccctgtaaaccctttgttttggccaatttcttctgtttggaatggctgtatttacccaatacctgtaccccattgtttctaggaagtaactaacttgcttttgattttacagtctcataggcagaagggacttgccttgtctcagatgagactttgttttgggttactgccgaaatgagttaagactttgggggactgttgggaaggtatgattggttttgaaatgtgaggacatgagatttggaggggccagggcagaatgatatgggttggccatgtctccactcaaatctcaacttgaattgtatctccccagaatactcacatgttgtgggagggacccaggaggagataatggaatcatggtggccagtctttcccatgttattctcatgctagtgaataagcctcaggagatctgattggtttatcagtggtttctgcctttctttcttcctcattctctcttgctgctgccatgtaagaagtgccttttgccctctgccatgattataagacctcccaatccatgtggaactgtaagtcatataaaaactctttttcctcccagtctccagtatgtctttatcagcagtgtgaaaatggactagtacaggtatttaaccagtatacacaccaataaagacaatccagttgatagattgttacaatccttaaataccaattggggctgggcacggtggctcatgcctgtaatcccagcactttgggaggctgtggcaggtggatcacttgaggccaggagttcgagaccagcctggccaacatggcaaaaccacatctctatcaaaaatacaaaaattagccatgtatagtgaaatgtgcctgtaatcccagctattcaggagtctgaggccagagaatcacttgaacccgggagaaggaggttgcagtgagccaagattgtgccactgtactccagccttggtgacagaacaagtgagactttgtctcaaaaccaaaccaacaaacaaatgacaacaacaagaacaaaacccagttggtaaagtggataaatggctgccatcctcaagagtgcaatcttccccttccccacctttcctgatatccagcagctaaaacagtaacatcaggtaggcacagaagcaggtctctggttcccagatccagtttaatccatttgtattttgattggtcaatgtaaataccactcagtctcttgtaaatcttgcctcctcacttggttctgtcattgaatccaaaggagacaaagggatagtgacatctcactctctggtctcctgccttgcccaggcaatgggggcttcagtagggagaaggctggtgcctgtcagctgtccagctagccctcttccacccatacacttacactcagggcagagcaggaggcactcagccataaagataccgctgttcactggtgggggtacagggaacccaatgcctaaaggttggaactcatttagtccgaaatatgtgtggtagacattgccagccagcattctcactactccctttgttggagggaaactatggcctccttggaatattagcttttagcgaactggatagagactgagatagccggggctgtggtgtaactggggcagctggggatgtgggaaacattgcagggtccatactcatagagaaaattccgtgggtttggtttagaggagattagacctggggatgctgaagaaaagtcctcctttttaccatctctattaatttttaccttttaatgcaacaattctgttaaaacccatcaaatgtctgccttcttgatcaaatgtaacaaaatacatttgtaaatataatgtgtaaatataaatgtggctgactgccacacggctctacttcacacctttaaccagaaggattaagttgagacccattaaatgagatgttgcaataaatactttttgcgacttggtcaataatatagatactgagtatattaaaaatacagtattttcaagaccaaaagcacgatagtgtaattaccattaatttgacaggagctatgaatattcagcaccaagcatattattgttggtgtaaagataaatgatctgcttattgatagtgtcatcgaatgagcatgattttaatgagattttcatttaaatagttttatctggtttcttatgttaaaccgtaggatagaaaaggactttacgtagctcataacatctgatataaataaaagatcacaaaaaatgccttctaaaaatcaacaaaaaatttgggcatagttagaataatttgatggacaatttatgctataagtcatcatttaataaatggtagtttacacacactcatacaaaaatactgagtgttggtgtatttagagaatggggaatatacttgaatttttgctttatatgttaattatatattattttatattgctgtacaagttgtgacataatttgaatatcaccctgtaatcacactaataaatgtgtaatgccaggttgggatgggattaccattctacaggggaagggtccagttctatgagcatgtagtaaagtaatatttcatatattgggatggtcagggagaacttttgtctggtagtgataagtcaactacaatataaggatgattagaattaaaagcattctagatttacccaagatgtgtgaaaggtggtatgttggaaaggagctggttgtgttcagagaactgaaagaaggctagtggactggagtggaatgaataatagaaagagcactatgtgttgagggttgagtcatagttggaggccagcccatgtagtatgtatgccataggtcagatgaagaatatagtctgcactaatgctgaagccgttaaaggaatttgatgagcttggtgaagtgattacattttaatttagaaaataccactctgtaagtgtaaaaaacaaactggagggagacaagtggcattattgaaagacaagatattaggaactttcagtggttcaggcaaaaatatgatgatagctaatagtaggctattactgtagcaatggaatgatggactaatacatggaaaatttaggaagatttgtgttagatgtggaggatgagagagaggtagataaacagtagacagaatagaaatatccaaatttacgtttagctttgctgagtttgagcttcttatattgtgccacatgaaaattccattcccttctttggtgctatagaaaacaaatggaaccctcaaaatattgttgccaaaatctacttggatcccattagaatcacatggggagctctattcagagactctgattcaattggtctggagtaagacctaggcatgagaatgtcttaaaagctcctcaggggtttctaatgtacagcgaggctgaaaactactgatttagagagaagtgtggttggtttgaactatgaggtttaagagaaatgaatagacagcaaagtagaaatattttacaagtgaacaaaaatacagcaaaatctttgtaaaaatgatgctttctctttgtctctggctttgtctaggttatgttcagttttttttggtaaaaaaatcttccagatgcaggagacttaattgaatccactaagatgcatttagaattattaactcactaaaatattacttcttatttgattccttttttagggtataaaagcgaaaaaatcatgttaattctgattagttttgttttgaatattgatcgttggtgggttgctagcctttcagaaataaaagtatcaaccacattctaaactatttaataggtcagatgatatgtggttagaagggtgtctgtgcatgagagatagggtatacaaatgaatcatttaataggtaaatattaactgatgaaactgcaatgtctttctttcaacctcagaagctaagtatttaaaagtaacatttattctcatactggtggcacttactaatgtccttgtattttaatgcattgtttgattagatgtaatagactattggccttcaaataataagaaaatcttttttttattgaaattggtaactagttatagttaattttaaatactaaagtttcctttaacatatataatattttggaattataaagcctgtaacaataaaacaggtaaaaatatgggaccttgttctggagatgtaaaaatgtctaagacatattctgtgctctaaggaatcttaaaaaccgactggttaataaatgaaataaaatattgaacttacagagtagcatgtaacattgaaaacctgcagataaacagtacaattttgtgcttcctattttaaggatatgaaccagaaaaatacagcaaaaggacttcacaatttgcagaaacttgccctccctcatgcctgggggaggaagaaaagaaccaagtgatgataacactaatagctactgtgttctaggcattggaataagtgagttttatacatgacatcgttaatacccatgacaattctttggagaaaatattattactaactctgttttatggatgagaaaaatgcttaggaagtcctgcccaatagaaatacaaaaagagtcacaaaaagaagccagatatgtaattttaaattttctagtagtcacattaaaaaaaaaaaaaagaaaaaggaaacaattaaaacgtaataaattgtgttataaaatccaatatatgtaatccaaaaatagaatcatttcaacatttattaaactgggatattttacattcctttttctgtactaaagcttcatatatatttgacacttccagaatatctcaatatggactaagtacattttaaatactcaatagccatatgtggttagaagctaccacagctcagacttagagattttaaataagttgtccaagttttagctactggaaaaaggaagagctgaaattcaaacctggatggtctaaccacagagcatgagctcttaaatgcaatcctgttctgcttaggaagatttgatctcatattaagaaatctaacttgagatcatcttattcatacagaattttttgaaaattacagaatacatatcctcatttcgcaagcaaataaatcgtcttaatgaggttaggtaaaatcctaaaagattcacaattagtaactaatacaatcagatgttgaacccacacctgtctagtttcaaagcccatattttaactacaccacaaataaataactagattcactgaaaaggaattcaaaggtaagtaagacccctccccacccaatggaaataatagatggtaattaccaagcagggtgttcttataactaagcacccttcttcgcttctcttatttttaaaaattgtctatgctttctcattctctttaaaaatacaacagtaagtactaccaaccccaccatcacaaccacaaaaacttcaattaatgggttatggcctacagagctcatgttgtctgtggcattttattggcaaacagctgtaagaagtatgtaataaacatctaagaaccatgcctggtatttagactatagtggcatgttaggaacacagtaccccgtggacacgatgctgcagcaatgatacagctttctagggaatagcagaggtagcctcaggcaacaaggaggtgggaggctactctaatgctttatcattaatggcctagaagacttcatgttatggtgtcttgggttttaaattaaatgtcaaatacaatttgccattgaaaatgtgaagtgtggaactgcccttagagactctgagaattcagtcctctaattggtggctgcctagtactgagtagaaatagttagagattattatttggtaaattctcacaccagtctgcagaaatgtgtggacttttacatcttacacttcaagtctgtagtaaaaccttgagacagtattttaaaatatgcagtgttcaatgtagttttaaatacagtggaactgataaactcttccctttgggatcatgccatcatttatgtcctgatctctctgacatttaatctataatatcaggaaatctgtgaaagaaactgaagcagcacacgttctatttacagtggtttatttagttgcccccttccctgctgacaagagtctgttttaataataggacgaataaaaagatttccaatccacttcaatgtgttagcattatatctttctgaactatgtgtatattagcgctaattatgagatgtgtttaagtctaaaactgtaggcttaaacacaaaggcgttatttttactgccggttttaattagaaacctaaagaaacacgtacaattaaatatgctcataaaaataatagatacattcctataatcctcgtcaatttgttgcaccattaatatcattccgcatggcagatttaagaatgtattggagtaagtcaagtggaaaatggcaaagaacaaaattactagcatttaaaccactgtaactgttttagaacagtgagtactgctctaggtatctgctgcaatcactgttttattttgcaaccacaatttaaagttaactgtttgcccatttcatgtatctcttgtttctaagaacaattaatcttgtactaaaaatacacagcttcagaataaaattgacttcaaacatttattttgcaaacataatttttaaaggaaatattaatatgcttaaattttcctgataccaagagaaagatttattttacttgaagaaatatactgtttggcaactctcctcctccatgtaatatgtaaacccaggtggagtagggtatcacaatgccattttataggttaaaaaatgtctccatgacttttccagccacacgatacctacaataagagaacctcaggagatatgcaagctttattcatagataacttgaacttcataccagatttagtctaaatgatcataaattatgaaatgataagtttaaaattaagttttatcacaatgttatagttcattgcaaagtgaaatacaattttatattcctagttaagatgtaaatgttattttgagattgtttatgacatgatttttactattaaaaatcatttggtaatattaaaagcttagtcttataaatctttaaactattaaactgaaacagtagactttaaataaagattaggtcttattattttctccacatgacccaaattatcgttttattgtttgtgatctattccctaaatcctctctaaacattaataattgttcttttatacttaaatcttaagctgaaagagaaaactagtctaagataaaaatatttatggaatccctatatttctagcatttttcatttatttcatgtaagtatcataaaaatttatgaaataattattactaccaattatctttccttttcacatgaggaagcggagtgtcagaatagttaaaagtatcaaacactatcacacagccaggaacatgtccagctgagatttaaaattcatgtcttctcttccaaatctcatgttctttctgtaatattgcacatacttcccatactatagtcacttttgcaaaagtattaaaaagttttaaagtgttgtaggaaatgagttcaacataaaaatccttgtaccatatatgtaaatcattttcctcatctctagccccacagttttaataataattaagctacttgatttagtaatttgatccagtatactcatttttgtcatgtattttaaatcttaggtgctttcttcttttgtgaaagtgttgaattaattacatccaatatatgcaaagatggtgaatttgcctgttacagatacttctttctcctgtgtcatctgagaaaatgtgaacaagtcccacaaggactctctttgttgtgctttgcccctgcatgatgtggccttttttgaaggatgttatgaaaaacaataatatagacaagatacctgtagagtaagaagcttctatattgggaaagtctatagaagtaagcacagcacagataaaggcctaagaactaatgataactaaatatgtgttgtgttcaagttctgagacaaagaaagaacgaaaaagtgcatacaatgtatatttgatattaggattttgttattattttctttgcttacaatttaaagataaataaattaaatgtgatcatttattgagtacctaacaatgcacggcattttgctgggtgtcttcaagacaaatgtagacaacatatggcatgcactttcaatgtgttcacaggttcagatcaggagacacactcataattgctatattattataacatagatgtggcctgggatacaaactaattgctacaaaaagcacaataaagtgttagattaatgcagaggtcaagaaaaaatttttttcaaaggcatgagacttaaaatatagagcagaaatagactaccaagagctaaagaaagtttagtcatgggaaggagcatgaatgaagagcatcttaagtttggaaaggggcaaatgatactcaactgctaaagcagtctgagctacggggctatgtctgtctttctcactattatatctgcctatcacagaaatttggtatatgatagatgtacaggtgctcactgaggaatgaatgaaaatctagggtatgtatgggaaaaatattagataagtctacgaaggcaaattataacgaatttagaagtatcttgataaacatccaaagcagtctgaaatgtattctgtagcccaatgactgccagtaatactacgttaaaaagaaataatcagttttgcttttatgcaaaaacactaccctttaatgtgtagcattcagtcaggatctccctgccctcttaaatctttacccttcatcttctgacagatgctgcccaaccctatatgaagaatcgtaacaactccacacttgagaaataactctgccctactctggaagatttaaggacaccaggttaaaaatgagcagtacactagctgactgaatcctctgacatgcacagtgggcatgcctgaaacttcttgtagtgtagagcttccattgaattttaatatattaatattcactgtattttgtgttatgaaggttttctatgttctaacacatgatctccttgaaatacagttcatctcttgtttatacttttctcttagcagctagtatggtggttggtactttttatgattaataaatgtttattaaagggtgtcagttggatgttccagaaatcagaactcttacactgaataagaaatgccaagagagagttaacaactggagggccaaagaggagatggagcacagttgaataggaaaggtattggactgacctgcagctctgacacctgtgaaaaggaggaagatacaagattgctcagggaaatcctcaaatcatgttttgatgtgatgaattctgggtcaaggtttctcagcctcagcactattgaaattttgggctcagccaggtgcagtgaatcacacctgtaatcccaacactatgggaagccaaggcaaaagaatggcttgagcccaggagtttgaggctaggctgggcgacaaagtgaaatctcgtctctatggaaaatcaaaaaattggctacgtaggatggcatgtgcctgtagtcctagctactccggagactgaggttgtgggagagcttgaacctaggagattggggctgcagggctacagtgaggtgtgatcatgccattgcactctggtcttggtgacagagggagatcttgtctcaaaaaaaaaaaaaaaaaaaaaaagaaaagaaaagaaagaaatgtggggacaaatattttcaataatttactttccaaatttatctctttgtttttaattgtcatataataattgtacgtatttatgggatataatgtattgtttcaatacattaatacattgtgtaatgattaatgcagggtaattaacatatctatcacctcaaacatttataacttctttgtagtaagaacattccaactcctctcttctagcaatttattgttgactatagtcaccctactgtgtgataggacactgtaactttttcttcatttaaatttgtaactttgtacccagtaaccaacctcttcccatgcctcctcccttacaccctcccaagtctctggtaaccactgttctgttcactacttctatgattttaacttttaaaaattccacatatgaatgagaacatatggtatctgtctttctatgtctggcttatttcacttaagataatgtccccattgaggaaggctgaatattattaggttgttccaaaataattgtgggttttgccattactttcaatgtcaaaaccgcatttacttttgcgccaacttaacacaatgtttactagtctctctggcccctactactagatgccagtagcataccagtgacaacaacaaaaaaatctccaaatattgctaaatgttccctggagggcaaaatcacctctggtggaaataagtagcctgggccacccctctttgtacatccagagccaagattgcctattagaggcatctctcattaggcagaaatggacaggtccttgtaccaccaccctgctcagtcagtggttggggctgctgggaaatcacatggcccaagctaagacacagaggtggatcctggagttgcaaacaactggaagctggcagctcactgctccctttgcagctgaactgaaagtttttccttggaaggaacttagagcaaggtatcttcaaggctgcctcataaaggccataggtcctccttttcagttgaaggccttgtgttgtgccttgtctggtatgccttatttggccacctctattaaatttatccttgatatataatctgtgctctgttatatatatattcctggaatagaattctttctgtcaaaacatctgcaactttagctattccctttcctgggtgataaaaatctcagtttgactctacagaatcatatttctctgcattcaaaccttgaaatataaagctcttggacttcagaaatgaagtgatttctgcaaatgaacaatagcacaagaatagctaaatatagtccacattcattttatacagcatcttatatttgggtcactggccaattgactgtggtcacctatttcttgtactttctgcttttattatacatttctggaaaatattaaggtatctgtcaagtggatctttctggtgggtggctttgctgaccatcacatttacttgcacttctgatatcaaattcagttaggccataactctgctagacttactttcttaatctgctctgacatttctcagagcatctcaaagattgtgtgagtcaatcacaatggtctaaaaatatcaaggcacaatgaacctagataaacaatacatagttattgttgctttattagatataatagaaattaggccgggtgcggtggctcatgcctgtaatcccagcactttgggaggctgaggtgggtggatcacctgaggtcaggagttcaagaccagcctggccaacatggtgaaaccccatctctactgaaactacaaaaattagctgtgcgtggtggcacacgcctgtaattcctgctactcaggaggctgctgtggcaggagaattgcttgaactcaggaatcggaggttgcagtgagctgagattgcgccattgcactccagcttgggtaacagagagagtctgtctcaaaaaaacaaaaaaaaaaaaaaaaaaaaggaaataaagtaggggtagtattaccttgaaaacttttctaaatatagggacattgtgttaaactattcttgtgttgctgttaagaatacctgaagttgcataattcataaagaaaggggtttaattggctcacagttatgcaggctgtataagcgtggcactggcatctgcttagtttctggggaggcctcaggaagcctttactacggtggaaggtgaagcaggaccaagaggatcttgtgagaactcgctcactattgcaagtatagcactgagaagacggggctgaactgttcatgaaatatctaccctcaagatccaatcacctcccactaggcccgacttccaacactgcgaattacaactcaacatgagatttagaggttacaacatcaaactgtattaggcatattctgagatcagcagctattaaaagacatttaaactcatgtaaattaaatgtgctatttatactatgtagaatgactgcttcagattatttaggtactgtgctgagaacataatgaaattattatctgcttgaagaactgagtcagggattgaaaaatccaatagctttctttttgagtaattattttaaatgcttgtttctgaaataaacagtattaagaatttttaaagccatttaactaacagaaacaatgtggagaaattatagtgactctactgaattttttttttatctgtgaggtttcaaaggagttaatgaaatcaggtaactggttcctaggagtctgcaaaggctggtgctacctggacacagaataaagaagctaaaatagagagaggcagtttattagggacttggctttgcccagaattcagatttctttactttccttactagttcctatctacttgatcacaatgcttctcagtcattactgtgtgggggaaaaaatcaataatagccatttggattaaagtttgagatataaaaacatccactgcatatccctgtagtatctctttttccttcattgagatttctttgtaattcctttgccaacaacatagaagaccactcttacagattcttgtcacattgtgagtaaaattccaccaggggatctgcctaatattttataactatagtatatatttttacagaatacgttcccaagtttgttgtttgtttggcttattttttatcagacatttgccttgcctttagagaatatgaatatttcaggtaaaaaggtttaatgtggaaatgaagtacaaaaatgtatatgactcctaagggtatttctatttgctgtttcaaacattgccttggaattatttacaattcccagtttaactatgtgcctataacaagacattgtttaaatgcaatttagccctgtggtttcgactgccagatgaagatagtgattcaaaatgccaatttttccaaggggatgtgggttaaattttaagtaaatcattaaaagcccaatttagccaacaataaccaagcataattactcttacttaactgccttccaaagatccttattttcatatttaattaaattaaaagagaatttaaataacagagtaaatatgggtttatttctcttgctagagaccatggccctaaaatcttattcatatcacgttatacaaaggaaatttttaaaactcaaaatctttcaggtttcctcattgctccactaactttttcagaaaacaaatttatccatgtgaaatatttattacctctcactgttgtgcagagtatatattctgcaaattatatgttgaaaactatttaagtcagaatttagtcgacttacttgttcatgcagaaccctgaacaggtgttctcatgttctcactggtttgttttccaggaagcagtaacccaagtccccttttccgtaagttgcacattttggaatgtgtgagacattctctccctgcacgtagccagggcttcatctcctaagtcgtcccactcattattagaagaacttctcctaaaatggatacaaatctgttctcttaaattcttcaacaacttggactttgaatagattttcctatcagtaggaaatgaaaaagtcagcatgagtacattatttagacctgctgaccaggaatgagaaggtgcagctctaattctgatgccgagtttgaattactgggggcattagggaaatcctattactttgtcacgtctctttgtcttctctgtaatgatggaatgtcatttgatgctgtgtactgtcaatggaagcttgataagatctataaatttggaaagatttcatttttcataaagggttatgtcctgcaaggtggccattctgatgggctagaaagggtagccttccacaaagaccattagcaggcactttgagggaggggagggtggaacaggaatttatacaaacaggttgcttaaaaatacatattcaaaaggatacaggaggaactatgaatcccattcagaaccccaagctcatctgtcagatatatcaactgaagaatcacaagatctataaattgagagaggaaactttagttgttataaagagttacagcctgtcaagatggacaccctgcaggctataaccctttataataaataaagtctcctcctcacatttgtagatctcatgactcttcacttgacagtatattatattgcaaaaaatatataggtagtattggaagttatcagagaacttttgaaatttagttatatgattatttatttatgatggtgtttttaataaaattcacactcctttcactgacctatggatactttgcggtctggccttctatgatcctcaggcttgatctcctaccacttactcctgggcattactttgcactcatgatggccttttctctgcagcttggacacgcaaagcccattcttacgttaagatctttgcactgactcttaattaagtgacttatttcatttctgacaaagctagatattttgaagtaagaaatgttatagggaagagtgtgagtgtgagtctttcatgaaagatacacaacacaaattaggtttgtgaatgaaaattattttctttttttttttttttttgagacagagttttgcccttgttgtccaggctggagtgcaacggcacgatcttggctcaccgcaacctccactccctgggttcaagcgattctcctgcctcagcctcccaagtagctgggattacagtcatgcaccaccacacccggctaattttgtatttttttagtagagacagggtttctccatgtcggtcaggctagtcccgaactcctgacctcaggtgatccgcctgcctcggcctcccaagtgctgggattacaggcgtgagccaccgcgcctggtcgaaaattattttcattagctgagctataaatgtttgaagtggagcagtggaaggtatgtgggcagacaaatcatttgagatagactatagggagcctgcaatgccagactaaaaatttaggtttctgttttataggaaatgtagaaagttgccttatatgctaaactgtatgtaaaagagtttttaataaataatttcaggtgtgtatctgttttattaccaaacagcaggaggttgtaaagatttaagatggatatgaattcattttcagaataatttattttccagcagttaccctagaaaatttaacatagatattttacaaaaatctaaagttaattgcattatcctccttctgagtaatacaagttgaatatttaacttcagccactttctcttaatttatatgctactatcttccattatcttaactttatatttgtcttactttttaccctaaaggatatgattattattgatttataaagacaatcaccacatttttgactcattattctttcagatagttcagtgtgttggttaaagacatggcttctggagttagactgtctagatattaatatgcagtttacttagtagttgtgcaactttagaaaatttgcttaacctttctgtgccccagcttcgttatctgtaaaatggaaataatatatttacctatatggttctttttgtaaaatgaattcctctagaaaagcacttagaacagtacctggcaggtaataacaattatatgtgttttctattgttatttttccctttatgaattttatagcttacttctgcagttactatttttccttttgtctgataaatattattatttttctctgtaaggatttatttttggaaaaatcagtttttgatttaatagaaagaggtatttctctcctgtcctttacataaattttcactgggtctggaatagtacattgctaaaaaccttagacaagttaaatttcacagtttatttaggcaaataatgattcataaatcaggcagcactcaaaattgaaagaggttcagagagctcttctctatcagtctgagcagtgagaatttgtaggctgaacataaaagcaaagttgaaaaattacctgattggctacagctaagtgtttgccttatttggacatgagctgactggaggtccataattgtatagccaatcgctggttgaatgtttgtgattggctgagacttatttttcttcagtcagttacggggaaggtttccaagttaagtttcagtttgcttatctaagtgcttgaattagggagacatcctccggctaatggattccttatttgctttagcaataaagtacattattctcatttgtttgtatctcacagtacattattttaattttttgagtctcattcttgctatcagaaagtcaaatgcgagtctggttttcctacttttatagttactttctttttctctctggctgctttttggttttagtattttccattttcaatatgatgtgcacaggtatttcttctttttggatttctctggtctttaagaatcttaaaattggtaaattttatcaattctggaaaatcttagcaattatctatcttttcacatgttgcctcatcccattttctttctcactcaaaaaaatctgattagacatattaagaccttttcactatcattgtgtttctttcttccatagcttccagctattgcctttctgggctacttttaggtaatctttttattcctatttcctctttctcatggtgtcaattccttttttttttttataacacaagtaatatgcctgaaaagtcaaatatctgaagtctttgctggtatgattctgacctttatcatttctattgactctcacttttagtgatttcttttcctgtaagtgacatgactcttgactgaatttttgactattgagattttctttattccttctacttctatttattcccatagtttagacctgaaaattctattttactcttttatgaatggagtatctctctagagagatatccctttgggatcttagacatatggattctcctatttgattacccagctgtgtgggccctaggctttggttttggtcccccacttccaaagcagccatatacataaatctgaagtacattgagaattgcaaagtcactgaatagtaaagtcttctttggttcccagcttaccactcttatttagctttcacatctagtacgtttttctcttcctaagtagttcactgaggcattcaagaatattttataatattctctgtattactttaagaaggacatactccttcttagtcatgatatccagttcccaaattgccagaaaggaaatctactgccactcagccatgaaatggtattcagcatcccaacacaacacaaggcctgtcagaatttatgtggagtcgtgagccatagttgtgtctttaccctgttctaatatcagtcactaggtggtaggaatcacaaactatttctggcatcagattctagagtagttatctttttttctttctgattccagtatccattaattatacttttgagtagtaagtaatctcgaaccatactttttctactcttatattttaaataaaattataaagttgacttgaagtctcagaaaactagtgtggctccttttaaaatttttgctggaccctattccacgcaggttttgttgaggcttaaaaaatgtttatatttaaaagagtaagaaaaactgatcttcactatgcctcacggtgtttaacacactatagaaaatcatgttaaaaagaatgcctccaaaacatgtgaacactgtgagctcagtctgctcactacatctcttagcactttgtccaggacacaaaactgtcatttgcttttctaagataaacaatatcataactcaatctggctaaatttgaaagccaaaatatttttttgctgcttggtcctcaaaagatatatgacagcaagcaataaggagacacattcttctttattcctgctataactttggccacattttgttatctattttttttccccaggtgcattgagctagataacttcaaggatatcttgaaagcaattcacctcaaaaacttattttatgttccttttctatgagccctattccaaccttattcagcctttcaagggaacttccaagcaaaatgtcacaagcttcagtcttagcaaagagtcatggttgagatggagaataaggtccacggaaaaagagatgtttcttcattttattcctttcaccaaaatttacatacaaggccctcacattgaggccttatcacatgcaagtgggagtagaaacacttttactcaacctctactgttctaatttcacagaataactaacatccatcattaccttaataaatgaaaataactcagaatatagatgatattaacaggtaagtaggctaatctctagtttattcactgccactttttcagtcacatatttaccaagattcagttgtgtttgttacaagtctagttatataagttgtccatgttattgtaattacgtaagttaaataagcattttggaaatcacagattacatgagagtaccaagagtaagagcatttggcaaaaagtttgtttaaggctaaagccctaaactttataagatagtcacttaaaaatgctataatgtacgtatgaaataactgcataaaaataatgaaagcctccaagaatcctgccatcagatcacttcatatgtttttaggccactttaaataaatttaaagttgtatatgatgcaacacaggcactatttatacactgcagtttcctgtgatgctgagttaaaagaaatcattttttccaccagaatctttataatcataaaaagatgtcactgctatataataattggcatatatattctgtatattaagaatacagaattaaatattagatggcaaacatttaaggcatatgtgaattaagtgtttttaaagggttttttattaactcagtaccagtcccaattgtgtcagagtaaaggttgtctggtctctcacagggattgctttggaatcttaagacgtgatggagcttaagggttaacattatttattaactggggcaaattagcttcatcaataagagatgtcctagagattgtgtaggtaaagtgcttaacacaatgcttgtaatttatctaataaatggtagttgttattaggatagtcaagtatcccttaatgactgagccatattctgagaaatatcttcttaggtgatataatcattgtgtgaacactgtagagtttatttacacaaacctatatggtgcagcttgctacagatctagcctgtaatatagtctattgcttctaggctacagacctgtacaggatgttactgtactgaataatgtaggcaattataacacaataagtatttgtgtatctaaacatatgaaaagtacagaaaatataattatcttatgggaacatcatcatatatgcagttcaacgttgactgaaatgtcattatatagcacatgactgtagtatgaaaatctaagaaacactgagttttttctttttttttttttttgagacagagtctcactccatcacccaggctggagtgcagtggcacaatcttggctcactgcaacctctgtctccctggttcaagtgattctcatgtctcagcctctcaagtaactggtattataggcaagtgccaccaggcctagctaatttctgtattcttagtagagacaaggtttcaccatgttggccaggctggtctcaaactcctgacctcaagtgatctgcctgccttgcctcccaaagtgctgggattacagacatgagctacgcacctggtcagtttttgtgtttttttttttgtattatattttgccaaaaaatttatttcctagagacttcagtttattcaataattattatctaaaaaataataattgaatactttctatggtggtcactgttctagatgctggttctgtaaagataaacaagacaaaaatccttgcttccatggatatgacattctagtaggagaaaaagataactaagatgtaaatagactagtttaacctcaggcactgataattgctaagaataaaaataaggcagggcaaatgtaagaaaaatcagtgacagagctgacaggagggggcttgctattttaaggagagtaaccaagaaaggcttctagaaagaacagtctgcaatgatttaaaactctaaggtatggaaaaaactgatgttggagaggcctaggcagaggacacagtatgtgcttggcatgcttgaggactagcaagaaagtcagtgttgtgggaatggagttagtctaaaaagttagaagatgaaattaaaaagttagacagggaccggattgcatacggccgtgggcaaaactgtatagaattggtgaaaccagcagtctgtaatagatatttctttctctcgctggttctctccctctctctctctcttaatttgcagatgtatgcactattaacaccttgcatttttaaaagactaacttgtaaccaagtggaaatatactattattacttgacttacttcgtagacatatattcagacctattaaggtgtaatgctttaaagtatttgtacatgcagtcaacctcacaatgcacttattctttgtaatctatgactgaatccgaacactattatctacttattgcactctacttgcaaatatttgcaatagttcagaggaaaatgccaagaaatgggatgtcatttcatacattattctttgaatgtaatagttgacagaaagtacatattctaagaattgaaataagttattttaaaaatgtgagattaaacaaattccaattagtagtttccaaattcctgtttgtgactttttaatctcacaatgcacagcagtttaatgtaaactggtacattaaactggtagccaaaaaggcatttccaaatacacatccttctctttgctttggtaacttttattcattgattataacttaaccttgcatctagtaggaacctaatatatgtgtaattaattatattgtcatttctttgatgcaggaattttattaaagtcatcggataactatgttttcaaaagaaacgtgtaaaaagtttacatatttcagaatcttaaatattatttcatttactttttattttactcagaagagttattttacttagcttaatgtccttcagtattatgtattttaaaaaaaccaagagagtaaatttcagatgtctcatcataaaaatatgatacgtaagtgaggtgatggatatcttaattagcttgatttaattatactatattttatatacatatcaaagcattatgttgtactacataaatgtatacagctacaatttgtcaatagaaaaagcacaaactaataatctcaatactagaaagagacagaaagggagaaaaagagagagagaataagggaggagagcaaaaataaaatataatgtaattatgtatcttaaaaagaatgactttttaagaaatattatgttgtgtgtatttaagaaatattattttgtttatgccctaaggaccaagcactggtgcttgaaaatgaatacacacacacacacacacacacacacacacatacacacacacacacttcttcttttacaagagattttaacataaaataagttattttagaaatcaaattcagtgtaccatttatatttgagagtaggaaaaatgtgcctggagtttatacttaaagattatttcataacacccctacatggcatcttatgaaaagtgcttcacatgcattcctactaaaatctcaccttctatcctccggtcacaggttgtccctttactctgttaatttcttcagagtatgtatcactgtttgacactgacttatttatccatgtgttccttgtcagtctttccacactgttccactcaaaaataagttctttatctaagaccaataactccttgaaattttactgaagatcctttgctactgtgtccagtttctcctgctatcttcatgagtcaatgctccttttgatggctctcaacccatgtatgtgtgtgcacatgaatgtctgtgggttttccctctgacagtcccagaaacagcccttaagggttgtaataacatttgtatttgtttatgaagaatatttagaacaacagaggaccttaggacattgtaaatagagcgagaagtaccaatttggggagtatgggactgagcacaagctcataaaaatgagttaagccaaagctatattaccttctcagaattcacaatttcaaaaaaggtcaatttaatcatgaattgaaactttgctaactcaactgtgcagttctcatgagtcataatcatacttctggcaactttaatctctccagttattatgtgtgatatgtggattttattattttcctttctggtaaaaagcagtgtataaataaccaagatgctttaaattgtcacaattagctatgaggttgttatttagtactttgaattatatgtatatctgatatttactcataaaatacagaaaatgatgaaaaaattcttttgtttaggcttgttataaataaattaaccattattgtcttaactttcttctccattaatgatccccaaatataaagttaaaatagactaccaagacttatatttaaaattataaataaaaatggaagtaacttcatttaggtagaggtactaacaataaattcctttctttgacataactatattacattatgatctagctaggggaaaaaatacgtgtctatatttttcagatgtttcctaaaatatagagataacctagacttctaatttcataaggagggatcagataccaagaaggcaatcattattcaaaaatcattgacatactttacaattatttctcaactgaacggctttgcgccaaggagaacatagctgacacgtgaaaattctggaggtacttgtggattacagaaacttccaatatatatttgtcaagttcttgcagaaagtttagtgtcagaattttctattcttttcatgtttattgtatcattcagggaaaaaaaggaaccaaatatattaatgtgctatactggttattgttataaaaatggcattagacaaaaacattaaatattcatgaaaatcctttttcccttacgttccagccagcaaaagatactgaaagaaataattcaccaaaggagagaactataacacagtacagataatcataggagttataaacaaaggaagttgacattaataattaaatgagaaaaattccctgtggtggttttgatgagctacaggcacaatgtgtaaaatcacttggccaaccgatcattagttatgctctagaccaaaggagtatatattaatgtaactggtttctctaccctatttttctagtccaataatttgtctaaggtaataaatatagctattacacattccctgtgaggaaaaattatccccattagaacctgatgtttttactatctgtatgggagtattcaatgtagataaatgtgaaaaggagagttgatcacatttcctaagtacttgtattgtgtattacatgaattctaacagaaactgtattattgctgtctagtgcatattaatctgacctttgcactaatggttatttatcatgttattaggagatttttgcattggtttgtatttgttggcttttctgtttgtttatttcctctgtttaagaaaattgttatctatctcaaacagggcactctttaatgaagaaacaccagagctgttaaacacattgagacacagaagattctagtgactgaggatggcttcctcttggaaactaatgctgtttctgtcagtcaccatgtgtctttcaggtaaaagtcctgattaattaattatttgattttctaagtatcaaaataaccaaaatatatcaaggtctccattacaaaatatcctcaggtattaatttaaatttatatcagtatttatactttccaacaagagaaaggcagcaacccttaagccgctgttaacattgcaaaatgccatatacaatttaatataataaggtacactataaatgttaataaaatgagtatttacctccttgacattcatttgcaatctaaaccatctagctttcagaaggcttggaaatatatatatatatatatatatatatatatatatatatatctcccacacatatatacatacatatgtgcatatatttatgcatataatgtatatgtatataaataattatgtattttatagcagctaattataaaagtgtctcatcacaatgctaaatttcaccatataaaacagaatcaggttagctttattatatataacacagtatctaaaggcatctctaacacaatgtattttttcagattgtctcaccttctctgactttgttgtaattaaacttatttttctatatcttgactctaaaatgagatactttattccgaagaaaagtttatagtattggtagtaataatatcataatgcctaaagttaatatgtcagagcttatttgctttaattgaagaatgattagaaattaaattgtggtcataatttaagcgctatgcatgtaacatttacagcttgattatatttaaatcagtacctatattgtgggctaaatttaggtagtatgtatggtaagagagtctgaaataaaatgtaacagctgataattttagattaaaagattgctttcattttaaacacatttttaatgtgttaattatactaaatatatttttaaagcagtaaaatattcattttgatatatatgatcattcagtactctatgcaaatattgatataaatacatacatgttccatttatacatatatatgaggataacacatgttcaagatatgtatttatgatcatatataatatagaatacaaactacataaagatatagaacatgcatattatttacatatgatcactaatattgcctcatcttctatatggttatattactatgcaacaaaaatatctaattgattatactaaatttctttatttcaaagaactaaacacattctcctgtcaattaagtctttcctgtattgtgtaacatgaagaaaactgcagattgtctaaagaaaaaaggactgatagaagaacaaacccaaatacaagaaaatataaactctttttagaatcatttaagctatattttttaaattataattttacaatggttattctttagcctttatactattattactattcgtaatgtaccaaaagtataacttcaattatgtatgatatatgagtcttctttataactgaaaaggcaatcctcaacttatcagattatgctccaaaacattatttgaaatctaaaagaatttctttatatacagaaataaatttagtatttcagttatataagttgttatgtgttgaatgtaatatctgcagcatacctgcactcatctaaatgcttttacaagatatataaaagcctttttattgcaatactagtaattaaataactgaaaaaacaaaaaaccaagtaattatttatatattagtactattatacgttcaacacgttgcttacagaaaaaacaggtttaataagagacatgcaaggaaaaaggatacctctataaaaagttggtagagacatctatgacatgaaaaggtaaggtatctcaaaggcattaagagttaagtgaaaactgtgattcatcaatattatggttacttaaaaaagaaatcaagagtcttcagatattttattcagtgttgggtttcttttttttgtgcagcattactgtcttccctgctgatctcagttgtttctcttttatcttctcaatgtcattttcctcttgaacttataagccaactgaaggagatggaggtagggttgcaagatgaaataaaggacacccagttagatttggatttcaaaagaaagttttgtgtgtatgttttttgttgttgttttgtttttagctctggtatgttccatgcaatattttatttcattttatctagaaattaaatttaacagatgtccagtgcttttatttattaatctgacaatgctagaaagaaagaaggtggtgttctataataatactgtaaagtttcattctcttgtatttgtccaatattgtttcctcaaataaacagtccctgcaaaagagctattatacagtggttgtggaaacaaacacaaaaatactcagcctgatatggggtccatgatccctagatttccagctaatactggaatcaagttactattcatttcatgaaataaaggaaacattggaagacagaaataattaggaagagtttgggtatgagtggcatttcaaatgttataggcaaagcagaaagaaaagttgaaaacaaaggtcatgtacaattgctacatgggatttgatctttaatcatcatatctgcggttgatgtgcagcaaatattcagttgcttttttaaacagatgaatttcttttttgctgtagatatctgtttaaaataaaattgattaggatacttgaaaggatcatttatcaagaatgattatgttcaaaatctttcatttgccttcatcctcattttatcatactatttcagaggtggagcccctattctgcttttgttccttggttaatgcttacactctatattgccctcactattttaaatatttagtattttattatttcattttcactggttattgcttttagctgtatatgaatgtcacattatagggcctatttggcacactgagttaattactattacgaaaatgagggccattaagctgtggatcacgagcacattttacgttgttggtgctgtttgaaccaaaaagactaactgaagaataccctgattgtattccatatttcctttatttattcagtttttgaaaatctacggattatcttgggtgtgtctaagaaacggaaaagaactcttacctaactctatgtttgaaaactcactacaggtagtcataaaagcttggcatctttcacaagaacaggcaaccttatattaaaaatgaatccacaattaaaacaacaatgatatattgctacagatatcaaaatggctaaaatccaaataaataaaaattaataaaaacaataccaattctggtgaagatacagattgatgggaactctcattgacagtgagaattcaacatggtatagccattttggaaggcagttttgcagtttcttacaaagctaaacacaattttgtcatatgatcaaacagtaggtcttctaggcatttacctaactgatttgaaaacttatatccacacaaaaactaccatataagcgtttaccagagatttagtaataataaccccaaactggaaacaacaaatgtccttcaataagtgattaaactatggaattctatacaatggaatactattcagtgataaaaaagaatgaattaccaataccaaactacacaaacatattaatggattctatatacaaatggctaattgaaaaaaagatgatagtttgaacagactacatgctatatgattttctttatataacaactggaaagagaaaagctgtggagactataaacagatcagtgattgccagggtcagggagaaggttgaatgggtaaatgaagcaaaggacattttttagggcattgaaactactttgtatgatactataatcatggatgcaagatattacacatttatcaaaatcaactagaactttccagcatggagtaaaccataatgtttgcatatttaaaaaatatatagtagtaggtcagaggatctgaggacaaaaagcagaatatgacaaagaatctaactgtattattattattattattattattattattattattattttgagatggagtttcaccttgtctcccaggctgcagtgcagtgaagctatctcagctcactgccatctctgcctccgggttcaagaaattctcctgcctcagactcccgagtagctgggattacagatgtgtgccaccatgaccagctaatttttctatttttagtagaggtgggtttcaccatgttggccaggctggtctcaaattcccaacctcaggtgatccgcctgcctcggcctcccaaactgctgggataacaggcgtgagccaccgcgcccagcctgtattattaataggaagcaacttcacttaggggagttaggggataaacagacttaaataacttcagaaatgagtctgcaaaactaaaggcaaaaaatactgtacttaagcactgcactctagttaataatattttttcccatgtcagcactcctaaaatccataaacatgtatactggaacaactaagtccatggaaggcagatggtggaggccaggtttctcactgttggtgtgggagattacaataagcaagagaagaagtttagaatgatccatgtgataatggattagaatttgagacacacacatgtgtgtgtgtttgggtgggtgtgtgtatacttctgcagatatactaatacctatttcatttctctaacagctgagaaggattagaatctatgtgtctgagtagcaaccaacacacaaagtatcaacatttcggtttctaataccatttataccattttctactcaaagcaaccagggctgtttagagagaagcctaattctaggactgggccaagaaatatataaatcattctagagtatcctgtagtgccagaaagtaagcgagtgctaaaacaaacaaaccaaaaccaaaacaaaaccagaaagaatatgagagtctggtgtgtcaaagagatgtaggagccaactgggatagttcccagtaaccaaaactgggacaatttcagcaaataagtaagtaagtaagtaagtaaataaataaataaatattgggttatagtccaaataaatgaatattcataagtccatattgatatagataaaagattaaataaataatgaatcaggaaaattgatcaatctttatgtagattaatttcaaataatttatgtagatacttcatcctcaaggaggtgtgaaataaatatctcttttcttaagtattcgctgtgcatactgacttgtttccaaagagtacagaatgggaaatgggggccaaaagagaagtgatttcatggtggagaaaactggtaaacatttcctcagccatgtaataatcatgatcaatattagcagagataagtcatgttgatgatattacccttggtatgatgagaatgacagctcagctttgtggttttcctccccaaaacctataaccccaaaactttcgaagtcatcaaaacttaggaaaattagggaaacttttgcacagaaagaggagactaaggagatatgataactaaatgtaatgaggtatattggataggatctcataagagaaaaagagcattacataaatactaaggaaatgtcagtcaagtatgtgtgttagtgataatgctcaggacatttcatccccagaatataactgctggagatcagaatatgccactccaaagtatgcctccttggcatactagttattttgagttggttattttgaaaaactgcagacacaggactggctctgagaagttgcccttttgtaagaaaaatgtgtgtttgcataagaaatacctgtttgtaagagtgtctctctctctctgcaccatgaagaggacaactaaattactagagactcataatcaataaagcaggcattgactaaaatctgcatatcaaatcttacctttgtttaagctgtttttctggccatcttatcttaactgagccttccttgcacttttttttcctttctattaaaaagcaatgatgttgaaacctaaagtttaattttattttctttgagatctgctctagacatttacatatttctctgagttatcagtcatatacagggaatatacatgttaataaacttttttactcctgttgatctgtctttcattacaggaagtcttagttaagaactattaagtccacagaaaaaaataaattatcttttctcctctacattcgttacaaataaaatataaatattagtttattaactgtggtacatgtttcatactaccatgagatgttaataggaaaaactggttatgaatacatgagaattagactaagcatagcattctgaatacttgaataaaatatgatgagggcctgaaaataagactacagtgaagattatcaacaggagtgaaatatttaaaaacatactggcattaaaatatataggacttagtaattgattaaatatttattggtagaggaaatggtttcttaccttgcttataggtgtagatgatcttgccatttacctggattcttaataaaatgggaagtgcagatttaaagctgggaaatactgagctcaacaatgtacatgttgagctttagatgtctacaatacccttaggtgaaaaatatctaaaatttagggaagatgaccgagctaaaagtaaatctgtgattcattcttgcatggatgacattttaagatatgggaaaggaaataatcactcaacaactatggatgtaataatgagttataagacaaggaagcatgtctgagtagcatgtacttttttaaggggaaagaggaagtacaggctgaaaagaatgaaaggcaaattataaattttgggaaacggtgggaaagaaggaaagcaaaacatctccagaaagagagtggtcagcagtggcaatgcattaggaagtttaaatgtgactggtactaaactcttttcttttaatgatagtaatagttacatttaatgaagtagtagaaaccccagcgttacggcagtgagttgtgaattggttagtagaagaggaaaattagacaattattgtcaaatctgttttctgacaatgtaaacctaggaaaaggagaaagaatggtagagagcttggaaaagacaaaaatttgaggaggagtgtgtgtctttccatttgtggatatgtgttttaaggctggagaaactgtttatggaaattcaattcactttatgcccaatgtacatgaagaatgcatattgccttagttagcttttgcagcataacaaatcagcccacaatttattcacttaaaataaaatagcatgtattctttcctacaattccaagggttagagctcggtggttcttctggtctgggcagcctcagtttatctctgcagtacccatgacgcacttgatggtgttatttggccttactcacattgcttgtgattgatgccttgttagcaaaggcaatgggaatgacttggtcatgtctctgatcatccagaaggctagcttaggctctttcatgtagttgtaggctttttaggtacaggaagaaacaggaaaatccccagtttacaagcacttttcatgcctctgttatatttgctaatatttcattggacaaagcaaatcccatgagccaagatcagattcaagaggtggaaaagtagattcaatctcttcaagagagtagctgcaaaagcacattatacagagagcacgtacagcaataagaaaaacgtgggctcattttttactctaacacatatttatatatgtctgtgactgtttcacatgcaaatagaagcaattctgttttttttaaaatttacttatttatttagacagggtcttgctttgtcacccaagctagagtgcagcggcatcatcatagctcactgaaacattgaatccctgagatcaagtgatcttctcacttcaccctcccaagtagctaggactacaggcatgtgtcaccacatcagggtaatttttttatttttattttttattttgtagagatagggtgtcactaagttggctggttttgaattcctggcctcaagcgatcctcctgcccaggcctcctaaagtgctgggattacaggcatgagccaccacacctggccaacaattctgtttatagcaaaagtaaagtagactaaatatttctctgtatcctcattttcaaatacagtagcagtgaaagaactgtgtcctaaactcattagctgaacgtaaaaaaacaaaaacaaaaacaaaaaagaactttaaaactctgtaaattaatttagttttcttaatatgaaattaattaacttcaagaaaatctaagctattatcaaagaatatgtgaaatcatttgaggtaatcataattactgtagcctatttttaatatatatgtgaaaaaagcatcaacattttaatctctattgtgccaaaatctgttattgttctctttgagaattctttttttggaacacatacatcccccaaatgtgtgcagagatagcaattggaagaagacaatacggtccaggatttatctactttcaatttataagcagctttcctgatggttttcggctctttgtaaattcagtctccatgtttaaacaaactcaacaacagaaactaaaattttatgttcctttactctgttatgcagaatttctccagctaatgggtttttttaactatcatattctttttagactatggccagtaattattctaatttctttataagtatttaacatttcaataagtatatcacaataatatttagtacaaatagcttcctttttgtgaaatataaattgttctttattcatgtgtttgggcttaaagaacaataacccaaaatatgatgctttgtcatgctgagcactttcaacttgtcttaaaggaagttggaagcccctagaagccgcctcataaccaaggactttccacctttcccttgtttctctcctcccaagggcactttctgtggaagtgcccttatctgactgaggaaatttcttccaaaagaaatgcaattgtcttaaagcctcctcctcagaaatctcatcaaatgatcaggcaatattaactagcagagaagagaaaaagactaaaagttgtcaccatgcccagatagacttttcatgtattcttctgagggtacagtcaagagattacttgagagactttatatacataataagacaacctttgtttacagtgaagtttcacccctcactttctcacaatttgttgccatctgccccagagctcagaggaaccttgtcccttgctattttctgttccccattaccacttggtattcaaagagaatcatttacaaaccattgtctgctctttgggaccattcagttctcctgaaaaatgatttactactccttaaaattgcctacattctcctatctctgtctttccaatgaagaagagtatatacgattgtgaacctgattgggttgttaggtaatcattctcccatgatttccccccatgcatgttagtaaatttgtatgccttttcttctgttaatctttccattgtcagtacatttcagccaaccttcagagggcagaagggaagtcttcccttcatacctataggtggaacacaaaaccatgtatgacatccgtttaggtcatacagagtggtataaacaattaataataatagtgatatcattgctttcaataagagtagctttatgaaggcagataattatctgaaattgttttggcttgctagcatgctgaaagagtttggatgtttgtcttctgcaaatctcgtgttgaaatgtaatcccccattttggaggtgaggtctagtgggaggtctttggatcatgggagtagatccttcctgaatagcttggtgccctcctcttggtaatgggtgagttctcactccgaataacgtgagatctggttgtttaaaagagtgtggcaccttccccctcactattgcttgctcctgctctcaccctgtgatacaccagctcctcttgctttctgccattgttataagcttcctaaagccctcaccagaagccaagagtgttggtgccagcagaactgtgagccaattaagcctctcttctttacgaattatctagcttcagatatttctttatagacacgtaagaacgaactaacacacatgcacaagggttagcaggatcactttcatctcttttcccagcgtgttttgtcttcctgtaaattttacttaatgtcacattcttttttactactgtcgtcatttttttggttgtgtgtttagttaaactaaaaaatataggtaagaaatgagatggaaagacacagagaatagcagtggccagctcattaaagaggatttgcagaaaagggttatgtatatgaagtcattaatatgagtctgactatttcctgactggtgtaatagagattttaatagaacagcctaataggacactgagatcaggggaaataatgcatgggagatatgtcatatacaaatattattagtatttattcttagaataggctggaaagccatgattattaattcattaacattctatcctttggttggaggtttttgaaaaagcattcattttgtactcctcagtactagcatatatttttgtcaacatcctaaatttacctatatatttctagcaaaagttgtagactaaataagaataatacttaattaggtttattaaaactaggtatatttatatcttttccttgactaaatttataaatcttagaatcaaaaataatttgaggtttatgtagtctgtatctttgcacttgggtaagtaaagtatttttttcttctcaatagggatgaggctcagaaagattctgtctgtctataggtgttacctagtaggagaataatgggaggactgtctcctgtagcagcgcttttcaacataccagacaatatgaaggtgagacaagagaggaaatctaattcctggagccacagtgacctccttcctagacctacattaatacatatagtttttttcttctgaatcactttcagatgcttctaatgtcagctgtattgctttaaaaacaacaacaaaaggcattttttttttctctactttgaccccattctcctccattgagttaaatccattttattggaaaggtgacagtttgttccttctgccaagatgatgatgtactgttgaacagagagtgtctgtcattgataagcttatacaaatacagtccttcttggtggccgtgtggtaaattgcacagaactttgtcactgccagttagtgctgcctaagaacttccaaaggaaaatgaaaatagaagtgttacagaaaacaggtgcctgctaatataaattctgacttccctgctgcagttgagaaagagaaatggattatggctcctccatgatcaaattaaaattatgtatttgcacattgtatctgtccctggggaagttatgatgataatggagactacctctgtgtggaaacccaagttgacttttatcagctgtgccctggcggtattagacgtgtaattaatcagaagacaatttaatttctccttgtcagtgggcggtgggaactggattacctgaacttagtgagctttgttatttttatattaaaagaaaagaaaatgttaaaaggtttctataattgtcacaaattcctggggtgatataaaattaaactatcaactaaaaagccaggttcagcatcctagagaaataagagcaaatttgtgtctcagtgtattggagattaaagaaaaagttaacttattaggtcagctaaatattactttttacattagaaaatatttattgaaaaatatttttccccttgagtattggctaaggagtatgcaatgtacatcaaaagtgttttggaatctagaagatgacatggacatcatctcttctttaaactggactaaccctttctggcaagataactttcaacaataatacatccttcctgatagaagattaataattacattgattttctttattattataaagtaatgctccaataattcacattatatcaagtgtccatgagaacttgtgaatgaatgtttatattatcatttgttaagcagaaataaatttgtaccactataatactgctgtaaaatatgcttgcttatggtaagaattgttttactgcttagcacgagcatctggggaactgcctctatgcagtcatttgaataatttgtgagcaagaaaacagcttattttctgtacctcacctgttcaaattcaggtctctttggaatataaagtggaaagacaattacattcattgagcactcaagcaagcagacataagtgcgatgcagaatgcaaaggaagattcttgatctcctttatattaaacaaattttatagttttatcaggatccaaatatggattatatataatatgtaaaacgaaccatgtataactaattacaagaatgagttaaatgccatatattttctgtttattttagctctttgagaaaaatcctattttgctagccattaataaagttaacaattgactttttgaaactctgtcaactttcatatctgataatatttaacatagacatcaaccagaagatttttcttttctattatctggaaaagaacattttccattctaattttcgttatagctttcacactgaaatttgtcagagcacttagttaaatatcaatgaagtcttcaggttggtgactaggcttatagtatggctttaacctctctgtggctctagggtatgctggaccatctgaatggtccagatcatggataaacatggtttgaagtgaaaattttttatttttcagcatttgaatattttgcaattatgatttttacatgtttatacaaaagtacaagatcatctgttctataagaatagataaaatatctatctgttctatttgctgtttcatatacaggacctagcataatccttgctatgaatgcttgctatgggataactgttttttatttttattatttatttatttatttatttattttttgaggcagagtctcgctctggcgcccaggctggagggcagtggcgcaatgtggcctcactgcaagctccgcctcccgggttcaagcgattctcccgcgtcagcctcccgagtagctgggattacaggtgtgcaccaccatgcctggctaatttttgtatatttagtagagacagggtttcatcatgttggccaggctggtctcgaactcctgaccttgtggtccgcctgcctcggcctcccaaactgctgggattacaggcttgagccaccatttttaagaacttccaggctccagaatccttctattgtgtggctttcttatctcaaaatcttcactgctaaccactagtatggaggcatgatgggataactattttttaaatgaatgaaaagaaatatttactttaatttttttcttgggtttagagggacacaaactatgctccctgttgcagtaatttctggtgaagaaacatccgaataggatgaataattttacattctccaaatctgatcattctaatatttttaatataagaaataagctgagatttctttgggcatttggaaatcctactgaattaaagccatagcaattatcttagcttagttcaggggattgtaaaaacaaccaataaaaaattactaaaggcaaaagaaagaaagtaaagaaaaaaacaaagaaggtaagatatttgaatagtcaatgtcttcatcaggctgctcagcctcatgtcatccattttcacacatcactgaggcctgcaagaatttgcttcaagaggttctaaaggttactttaaaaaaaaaaaaaaagaagaaaagaaaaaagcttgggtcatatgcctctttacttgtttctctatggtaattcagagatgtactggctcacagtgccgttgctggcccaaagctatttttatttaatacctaaattcagaaagaactatttcaacctggccccaggatccttatttgttccagaatagccctgaaggaattgactgtttttaaaataggattctataaaacccaacatgcagcatttgtttcatttatggttcagtcgttcttctaagaaacatcatagctatagatagaaagtttcaagtagtcgtagcctatatactttgtcaaagatattgtgtattggggataaagattacagagatcaaaggcatttaaaaatattatttcaggtaccagttacataataattttcaaggatcttttagtataattcatttgtctgttaatttaccaagtatttattatgtgcctgctagatattttgctaggtgctaaggctataggagtgaacaagacaggcaaaatccctgtctttctggaactcacattcttgtagagaagacagacactttagcaagaaataacataatatctaataggaataattcccataaagaaattaaatggaataaaatgatagtgagtaatattgggggagatggggtggcaaggtgttattaaacatagaatgatcaagtaagttcactctgaagaggtctctaaggaaaaacgcaatgaacatggaaatacaagccacatgaatatctgaaacagtatttcaggcaggcagggaaagacaaatgtcaaaaccctcaaaaggaaacagatactgtacataaagaataactaatacagatgagagaagaatcaatacagacaaagagtctgtgacaagaagagtgataggtggtgaaataatgagatagacaatggccagagcagaggagaggtataagttaataacacgtaaaggcagcctgctttctgctttatggaaaaccaactgtccagcttgagtaagaaagaaggcctggacatgtgtaggatgctattgtagtagttgcgagagaaaaggtaacatgaagtatttagacctgtaggttttcaatggctatttgttagcttcattatgagtcagtactggtatgaatctaccaaataaggagctcacataatcttcagctgtatcaataatgcctagaataagggagaggttagatctgtattgctgtcatgctaacaatgactgattttatgttcagttccagactcagtcttataatggaaacagataatcacaaatgtattcaggggagggaaaccaaagttaggaaaccttgacactttaaactctgttgtaacagaaatgagaattgaaatggaatgactagaatgagaactgaattaaagactcagctattatttaggggaatttttgaccaaaactcaggaagcacatctttcttcttgcaagatcttcactgaattaattattgctttttgtaagtcaatgagtaaaagatgcagaaggttaagatacaaatgacttaggagggaaggcaaaaaaggtttatcataatgaagtatgggtacatatcctggtcatacttccatagagtgatttggcctgtctcttctctcatattcaaattaatcatagtgaatttcagttatagatttcttctttacttaggacatcaagagttagcctttgtatattctctaataacaagcagctatcattgtaaatgacataaagcaagctataaagactttgaagaaagtaatattttttcttcatataatatacataaatataatttcagtatcctgctctaatcttaatgagatacgaaagcctctcagttcacacagcaataatcattacatggcccatagcaagaaatctcatctcaaaaagacagaatttccaaaagttaatactacatacaaccactatcattaaatagctaaaagtttgttatatgtaagccatttagacttattttcagagatgtaaaataggaatgttcaatcctttggcttccatgggccacactggaaaaagaagaattgtcttgggtcacacataaaatacaccatcgctaacgatagctgatgagcaaaacaaaaacaaaaacaaaacaaaacaaaagctaaaaaaaatcgtattatgttttaagaaaatttacaaatttatgttgggctgcatttaaagccatcctgtgctagatgcagcctgctggccacggtttggacaagcttgctctgaaagaacaaaccggtagaagctacagaatagcaaagggtagaattagtttgcctaaaaaggtcctttttagtttgcctaagtgtccagagttggtcagtgatagaattggcactatcataagagtttttcaagaaggttcatgtcaagcctgaacttccttaacacggaaatgatcattatttagtaaatgatcattatgtaaagacaattttagcatcaaagggcttgctcagactgatgatataatgctcccctccccttgtccatagatctattatactgtaagtcagactttcagaaatagttaaaagttttattttattttgttaatttttaataattgagggttttttttaaaaaatagattatcaaatgagaaaacagtgaatgattgtgggtagaagaattgagaatggaagaatatattggcggttagaaacatatgatggacttaacacatttcagattacaggaaaaagagaggaggggttaaaatatatttgtgtttgatgttttgagccagcatgcgggagaacagtggagccagcaatagagataaaggaagactaaaaagaaggggactatttttaaatttaaaatagccaaatatgatggaatatttaatttaagaaataaacagttgttattgtcaaatggaatataattaatttagtagaaaatttaatacactagaatcagttttaaaatgaagtatgttgccaagaagctactctgttttggattccacccaaggagtgtttttttttttaaataataaaatggacctgattacataatactctttttatgaactcagataattccactctgccaggctattctacatggtaggaacgttgttttaaatagttcctggccgggtgcagtggctcacgcctgtaatcccagcactttgggcggcctaggcgggcggatcacgaggtcagcagatcgagaccatcctggctaacacagtgaaaccccgtctctactaaaaatacaaaaaattagccgggcgtggtggcaggcgcctgtagtcccagctattcgggaggctgaggcaggagaatggcgtgaaccaggaaggcggagtttgcagtgagcccagatcacgccactgcactccagcctgggcgacagacagagtgagactccgtctcaaaaaaaaataaaaataaaaaataaaaaataaaaatagttcctaataagcttccaggaatgaatttttttctattgagacggagtctcgctctattgccaggcctgagtgcggtggcgtgatcttggctcactgcaacctctgcctcctgggttcaagagattctcctgcccctgaccatttccttttttgtcttcttttcattggccatgcatgcattttggagaaacctttctagagcatatgtaattctttgaaacttctctaagtttccaagacatgttcttctaccaccgtcacacgtttcaattcttaaaagaaatcaaagctaaaattattattatttattatactttaagttctgggatacatgtgcagaacgtgcaggtttgttacgtaagtatacacatgccatggtggtttgctgcacccatcaacccgtcatctacattaggtatttctcctaatgctatcactccctataccccccactccccgacaggcccaggtgtgtgatgtttccctccctgtgtccacatgttctcattgttcaactctcacttatgagtgagaacgtgcagtgttttcttttctgttcctgtgttagtttgctgagaatgatggtttcctgcttcatccatgtccctgcaaaggacacaaactcatccttttttacagctgcatagtattccatggtgtatatttgtgccacattttctttacccagtcaatcattgatgggcatttgggttgattccatttccttgctattgtgaatagtgctgcaataaacatatgcatgcatgcatctttataacagaatgatttatattcctttggatatttacccagtaatggattgctgggtcaaatgttatttctggttccagatccttgaggaattgccacactgtcttccacaatgattgaactaatttacattcccaccaacagtataaaaacttttccttatttctccacagcctctccagcatctggtgtttcttgactttttcatgatcaccattctgactggcattagatagtatcacattttggatttgatttgcattcctctaatgactggtgatgttgagctttttttcatatctttgttggccacataaatgcctttcttttgagaagtgtctgtttatgttctttgcccactttttgatggggttgtttgtttttttttcctgtaaacgtgttttaagtttcttgtagattctggatattagaactttgccagatggatagattgcaaaagttttctcccactccgtaggttgtctgttcattctgatgatagtttcttttgctgtacagaagctctttagtcagaaatgacttcttttaaaatgaaaaatggtacatttttgggaaatagactggaaataggagggctatatactagtttcaactttgccatgaattgtgggactttggagaagtcattatttccttctctgtaacaaaatgggttaggctacattatttgaatcttcttacatattctaatgttgttttccaataatctcatatcttttattataaagtctcaaacttgggaacaacagaccttaagtatctcaatttttgaagaaatggtgttagacgtgtctatataatatttactaaaatatgtaaaatagaatcccccttaaatattcagaaaatttgatacttaaagaaagttaagagaagtgaaaaagaagtcaccaggctaaatgatgctgttggcagtggtctgagatttcttttcccctcactcagagaaaggaaaaagtgatgattttctttacctcggaataggtaccagaggaactgcttgtggtcattggagtgtctgcagagaggaaagatatgccttttactctacatctaaatgtttactaagtgacagaaactcagatttgttaagaacatgctaaaacaatcttgagaaaggctgacgtgcttcctgtggattttgagggtcgctaacatggcagcgtaagagcatagaaactagattctgttttccaaagtaagttgataaaagctactcttggagcaaaataaaattaaaaggtggtagagtacatactgaatcccagcatttggaagagcaaaggttcatgaaccttctgtgggacagaagttgatgcttcataagtagccaggcatgacccttattgatggattctagccaatgccaccagacaggaggaggtgacttcagaagaaagaggaaggtagtctccccaggggtggagctgggagaagagcaccagcataagacatcagttagagagtagatttctgtgtcttagaactaagcagcatggcagattagaaggaacttccaaagaaccaataggggcaacccactagagaatccgtacttggacaactaccacacagagggccccggtggccacatcacagctgcaccattcagctaaaacttgtggcctgtatattccagcaacattggaaggatttttcaggagaagagaagggagacaaataaagatcaaaacaaaaatagaaacaaataaccgctttttccctaccacaggttccgaagcaccacggcaagcctgatctgtgaggagaagagagtggaggaatgagagattgaattttttgtctaggcagagctggatatattagtattctcaaaatgagtcttaattgccaaaacaagctttgttttaataccttaaggtatatggaatgctgaagacccatcaagaacctcatctatggcagagaaagggaaatctggcaggaggtgtttaaagcagtaattggagaaatagaaagtgttttagtccctattataaatgcattacatatacttggatattttctccttattgacatataacccttttggtagcctttcattgatgtttttctttcagtaaaaatgtaatgaatactactctgagtaaggcaatgtccaggacagacactgtagataaaccagagaaaaaggcaacccttcagtcttaattcatagaggtaacagactctcttaatccatttgggctgctataacaaaataccataaactgggtggcttataaacaatggaagtttatttcttatatttctggaaggtgggaagtccaaaatccagttgcctgcagatttggtgtttggggagggtgtgttttgtcatagatggtgccttctcagtgtaccctcatcacttgttggaaggagcagggcagctctctggggcctcttttataagggtactaatcctattcttaagggtttcaccctcatgacctaatcacctccccaaagttctcatctcttcatactatcaccttgggggattaagatttgagggtatatgcattttggagggacacaaacattcagaccacagcacaaatctttggactgagtaatcaaatttgaaccacaataaagggaaaaaatgttgagggatttctatggtattatgaatttcttttattaatcaaagtttcggtagaggtctttattggactttttgtggcacaattgttaaataattcacaccaaaagacttcaggaaaagacagggcttaagagggaggttgaaggattgagggtatttgaataggtagagagaaaaaaagattgcattagtgcattaaagcagggagaaatgtccagcacttttcacatagagttgtagctctgcctgcttgtgtcctttgacacattacagagattcttgcccccatccctctccctttgcctcaagcactcatattctacaaccatatgctctaaatgggctcttcacatttaggaaaataaattgagagtacatgactagtgattctaccaatgattaatcttaatgtttagagaaagcatggagtccaggacaaatagatgtttttactagattaacgtacagagttatgacatttatgtttctatgaagcaatttgctgtaacttatgctaatattgtagtttgctgtaggatgtcatgattttcatttaattaaaaataatgtgtgacagatgattatttttccattgagcccgatcattaaaaatttatttctagagtaataaaataaaaaatacagtgtttaaaagagtttgtgggactatcacaaggtaattaccatagacatatatattgaaaacaaagtttggacagttctttagttattgcttctaaaatgtttaaagatgattctgcatttgtgcagatctttatagtgaggaattaattctcaaagattttcttttattattattattattattatactttaagttttagggtacatgtgcacaacgtgcaggtttgttacatatgtatacatgtgccatgttggtgtgctgcacccattaactcgtcgtttagcattaggtatatctcctaatgctatccctcccccctccccccaccccacaacagtccctggtgtgtgatgttccccttccagtgtccatgtgttctcattgttcaattcccatctatgagtgagaacatgcggtgtttggttttttctccgtgcgatagtttgctgagaatgatggtttccagtttcatccatgtccctacaaaggatgtgaactcatcctttttcatggctgcatagtattccatggtgtatatgtgccacattttcttaatccagtctatcattgttggacatttggcttggttccaagtctttgctattgtgactagtgccacaataaacatacgtgtgcatgtgtctttatggcagcatgatttataatcctttgggtatatacccagtaatgggatagttgggtcaaatggtatttctagttctagatccctgaggaatcgccacaatgacttccacaatggttgaactagtttacagtcccaccaacagtgtaaaagtgttcctatttctccacatcctctccagcacctgttgtttcctgactttttaatgatcgccattctaactggtgtcagatggtatctcactgtggttttgatttgcatttctctgatggccagtgatcatgagcattttttcatgtgttttttggctgcataaatgtcttcttttgagaagtgtctgttcatgtccttcgcccactttttgatggggttgtttgtctttttcttgtaaatttgtttgagttcattgtagattctggatattagccctttgtcagatgagtaggttgcaaaaattttctcccattctgtaggttgcctgttcattctgatagtggtttcttttgctgtgcagaagctctttagtttaattagatcccatttgtcaattttggcttttgtcgccattgcttttggtgttttagacatgaagtccttgcccatgcctatgtcctgaatggtattgcctaggttttcttctagggtttttatggttttaggtctaaccatgtaagtctttaatccatcttgagttaatttttgtataaggtgtaaggaagggatccagtttcagctttctacatatggctagccagtttccccagcaccatttattaaatagggaatcctttccccattgcttgtttttgtcaggtttgtcaaagatcagatagttgtagatatgcggcattatttctgagggctctgttctgttccattggtctatatcctgttttggtaccagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattgaatgtataaattaccttgggcagaatggccattttcatgatattgattcttcctacccatgagcatggaatgttcttccattggtttgtatcctcttttatttcattgagcagtggtttgtagtcctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatgagcttaaggagattttgggctgagacgatggggttttctagatatacaatgatgtcatctgcaaacagggacaatttgacttccttttttcctaattgaatgccctttattcccttctcctgcctgactgccctggccagaacttccaacactatgttgaataggagtggtgagagagggcatccctgtcttgtgccagttttcaaagagaatgcttccagtttttgcccattcagtatgatattggctgtgggtttgtcatagatagctcttactattttgagatacgtcccatcaatatctaatttattgagagtttttagcatgaaggttgttgaattttgtcaaaggccttttctgtatctattgagataatcatgtggtttttgtctttggttctgtttagacgctggattacatttattgatttgggtatgttgaaccagccttgcatcccagggatgaagcccacttgatcatggtggataagctttttgatgtgttgctggattcagtttgccagtattttagtgaggatttttgcatcaatgttcatcaaagatattggtctaaaattctctttttttgttgtgtctctgctcggctttggtatcaggatgatgctggcctcataaaatgagttagggaggattccctctttttctattaactggaatagtttcagaaggaatggtaccagctcttccttgtacctctggtagaatttgactgtgaatccatctggtcctggactttttttggttggtaatctattaattattgcctcaatttcagagcctgctattggtctattcagatattcaacttcttcctggtttagtcttgggagggtgtatgtgccgaggaatttatccatttcttctagattttctagtttatttgcgtagacgtgtttatagtattctctgatggtagtttgtagttctgtggggtcggtggtgatatcccctttgtcattttttattgcatctatttgattcttctctcttttcttctttattagtcttgctaacggtctatcaattttgttgatcttttcaaaaaaccagctcctggattcattgattttttcaagggtttttttgtgtctttatttccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatatgtcccagagattctggtatgttgtgtctttgttctcgttggtttcaaagaacatctttatttctgccttcatttcattatgtacccagtagtcattcaggagcaggttgttcagtttccatgtagttgagcagttttgagtgagtttcttaatcctgagttctactttgattgcactgtggtctgagagacagtttgttataatttctgttcttttacatttgctgaggagagctttacttccaactatgtggtcaattttggagtaggtgtggtgtggtgctgaaaagaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccgttatgtaatggccttctttgtctcttttgatctttgttggtttaaagtccgttttatccgagactaggattgcaacccctgcctttttttgttttccatttgcttggtagatcgtcctctatccctttattttgagactatgtgtgtctcagcacatgagatgggtttcctgaatacagcacactgtattttctttatccaattttccagtctgtgccttttaattggagcatttagcccatttacatttaaggttattattgttatatgtgaatttgatcctgtcattatgatgttagctggttattttgctcgttagttgatgcagttgcttcctagccttgatggtctttacaatttggcatgtttttgcagtggctggtaccagttgttcctttccatgtttagtacttccttcaggagctcttttagggcaggcctggtggtgacaaaatctctcaacatttgcttgtctgtaaagtattttatttctccttcacttatgaagcttaatttggctggatatgaaattctgggttgaaaattcttttctttaagaatgttgaatattggcccccactctcttcttgcttgtagagtttctgccgagagatcagctgttagtctgatgggcttccatttgtgggtaacccgacctttctctctggctgcccttaacattttttccttcatttcaactttgatgaatctgacaattatgtgtcttggagttgctcttctcgaggagtatctttgtgccattctctttatttcctgaatttgaatgttggcctgccttgctaggttggagaagttctcctggataatatcctgcagagtgttttccaacttggctccattctccccgtcactttcaggtacaccaattagacatagattttgtcttttcacatagtgccatatttcttggaggctttgttcatttctttttattcttttttctctcaacttctcttcatgcttcatttcattcatttcgtcttccatcgctgataccctttcttccagttgatctcatcggttactgaggcttgtgcattcacacatagttctcatgccatgcttttcagctccatcaggtcctttaagaacttctctgcattggttattctagttagccatttgtctaatttttttcaaagtttttaacttctttgccattggttcagacttcctcctttagctcagagtagtttgatcttctgaagccttcctctctcaactcgtcaaagtcattccctgtccagctttgttccattgctggtgaggagctgtgttcctttggaggaggagaggcactctgatttttagagtttctggtttttctgctttgttttttccccatctttgtggttttatctacctttggtttttgatgatggtgacgtacagatgggtttttggtgtggatgtcctctctgtttgttagttttccttctaacagtcaggactctcagcttcaggtctgttggagtttactggaggtccactctagaccctgtttgcctgggtatcagcagcgctggctgcagaacagcagatattggtgaaccgtaaatgctgctgcctgatcgttcctctggaagttttgtctcagaggagtacccggccgtgtgaggtgttagtctgcccctaattgggggtgcctcccagttaggctacttgggggtcagggacccacttgaggaggctgtctgcccattctcagatctcaagctgtgtgctgggagtaccactactctcttcaaagctgtcagacagggacatttaagtctgcagaggttactgctgtctttttgtttgtctgtgccctacccccagaggtggagcctacaaaggcaggcaggcctccttgagctgtggtgggctccacccagtttgagcttcccatccgctttgtttacctactcaagcctgagcaatggtgggtgcccctcccccagcctcgctgcctccttgcagttagatctcagactgctgtgctagcaatgagcgaggctccgtgggtgtaggactctctgagccatgcgcgggatataatctcctggtgtgccgtttgttaagcccgttggaaaagtgcagtattagggtgggagtgacctgattttccaggtgccgtctgtcacccctttctttgactaggaaagggaattccttgaccccttgtgcttcccgggtgaggggatgcctcaccctgctttggctcatgcatggtgtgctgcacccacagtcctgcacctactgtcttgcactccccagtgagatgaactcggtacctcagttggaaatgcagaaatcacccatcttctgcatggctcaagctgggagctgtagactggagctgtttgtattcggccatcttggctccaccctctcaaagattttcattgtgtttatttattattgactgtaagtaacagccatcattataaaattaatctcatgaaatagatcagataattttttactgggatcaaagggattaaggaggatgtgatttctctaccaaatgttctttatgctgggttcttcaaactaatttttcaatttgaaagtattaactttaaaattgaatatttaaattgttcaacgttgttcccttttgggggacaaagtatatagtacattaccgggacataacactcagagtattaaaattagctctgtattctcctacttgaaaaataattgcatggcttttctcctagctcaccatacttattcacactggccctgattactgttatatccttagtgcagagcttctcatgctgttggccacagacagaaggaccttggagatgctccagagtgtccatggtgttaaaactattttccttataatacaataatgttattggcctgctttattctcttgacattgttactaatggagcaaaagcaatggtgagaaaattcgggagccatggcttacacatggcactagcaactgtattaaataaaatattaaatcttgtctcactcaataatatctcccatgaaacaacaaaaatattaatattattaaataaaacccttaaatacacatatgttagtaatttgtgtgacaaacaggaggcatacacaaagcacttctgcttcacgcatgcagaagtacagtggctgcctcagggaaaagcattctgctttcatttgagattgtgtagttgtttgaactgtgaaacaaactagcagcagctgctttttcatgaaacactgtttttacttgaaagaaagaacaacagacaaactgttattcaggcttgcatacttggtggatattttcttaaaagtgaactgagtaggcctgttgctgcaagggaaacaactaacaagatctgttgccaatggcaacattcaagcttttgtgtaaaaactaaaatttttgaagacttgtatccaacttcatgagctagaccatttcccaattcttagagacttacctgattgttaaggatttgtgcaattcagtggacacatattttccaaatgaccaaacacacagtgttacaaaatcacacatggataaaagatctaatctataagacagatgaaaggattttaattttacagtatgaaaagttcactcaggtgatttcagattactcattacaactagcctttaagaaacttgagttttggtatagtatcaaagaagaatattcataattatctgaaaaggttattacaattcttctctcttttttgactacatatgtgtgagagcagggttttctttagctgcttcaaaaagaacaaaactacaactggttgaatgaaaaaaggtaggaggatctagctgttttctattaagctaaattcagttttacaaaacttataacaatgccactcttcttacaggctttacattttgtcttgaaaaatatggttatttaaaaaaatatatatatttaggttaacttatagtgggattttcatagttattttaagatcatttaatacataattttattttttcagtattgatttctaatatagtaaaaatacagatagatataactcacctaaacaaagttctttcaagacttccattattttccaactgtaaatgggccctaatatcaaaaggtttgagaacaactactttagcacaaagttaaatgggatcgtagacactggaatgaagatgtgaggagtaaaggctggagagttagtcatgtttgagagcatggagataatatctgaaacattttgtaattcataaagaatttggacgattgcaaaccactgatatatccaaggaaattactgaatttaaaatttccgtggtgaagcaggtgaatggcaatgacaaagtcaggattttcttgtaaaataaattgttctttctttccttccttcctatttttcttcctctgaattcagtcagctaccgtgttagtttatttcttctattataatatatcatatcatttattcctttcttgatatatatctcatatcatgtatttcattcatttaattaaatcccgttccaaatggcctcatgtctagtctgctaatttctttctggtttctgtgcaatcagtttttatttttttctctttcaacccatcctgaaatctgctgactgattaacccacttcaatccagtcttagctctattaccatcatcccacaagctcaatcaaatataatgaaaacatttgtgctaaccattggtgagatgataaatctcaaacttctcagcataataactgacataactcagcataataacggacataactcagcataatggctaaaggaccctctctgagcatgttttaccctttctctaaataaaaaatgctctaattaaagtagtttattcgttttctttttaatgtgccaaatctgttttaaccatggtacctttctgcatatcatgttctctagcctgaaatgcccgcagtctttgccttatcatcttatacagataaaatgagataatacttttcaataaattagtacaatacctgaaacataataagcagtaaattaaagccagttatttttcttattaatattacgactatactgtaaacttctggagggaagatactataccctatatcatagttgattctccattgtatagtagatgtctctctatgtaatatatgttcacaaaatatatgtggcttatagtgatgattatccatattttgactgactttatttaaagttttaaggaagggccactcatctaataaatctgtccaacaagacataatattttaacatagtcaccaaaataaagtaaaaaactctaactcagggcaccataaagtgctagatatgtaagcttatccaggaacgttaatgcacctaggcagagaatcatcaacaatagtctagtaattggcaagagtatcattaatcaacttttttccaggcaagtaaagttaaatcagaattcagttaacaattcgtaatgtgtgtgcgagtgaggatcagttaaccatttatgaagtttatgccatatgttgaaaaccaggtcatattgcaatgaagtcatgttggctactaagaaagagcaactcagaaatgaagaggttttgcagtatgggtaatccgctggatatcctgtctctgacaacagagagagaagcggctatagaagctgcctactctatactgcacaggatctcctcatagaatagaacatggaaacaaagctctatttgctaccattatatagagaatgagctttctttggaagaaagtatacatgtggaggatctaaacaaaacaatgcacaaggtaaactgacttaaagacacagtgtctcccataaaggagcgacaaattcaatagcaggtatctgctatgggagctagttccctgaaaagaagagcaaccagattcaattacaggatacctgagagaaaaacctacagtttgatgctgtttgctactaacgaggatccattttcttctggtaatctgcccagggaatcatatgtgtggctgcattagatggtacgtttcttctttccaaacaccactcagaatttgaaagatgtgtgtgggagtgaggatatgttatgaagatgggggtcatttgcaagtagtataaagatttgataaaggaaaattgctgagaatttttttaaaagtaatgatcagcttaaaaactagtagcagagttctctcttaaacaaaataaatgccatttgctagcaaaacactttgaaggattatctaggttttcaaaagagtgctttaatagttgggtcaaaatgggttcatgctgagtgacattaggagcagaatggttctgcttaataaagtggaaacatttttattttcttggagctgatctagagaaggaagaagcaaagaggaacagcataacaagagaacaagaaccttaggaaaatatgtggccagtgagaaagtcctaagactgctataccttctccactgtgagcccaaaatccatagtttaagaccaccggccgggcgcagtggctcacgcctgtaatcccggcactttgggaggccgaggcgggcggatcacgatgtcaggagatggataccatcctggctaacacggtgaaaccccgtctctactaaaacacacaaaaaattagctgggcctattggcggacgcctatagtcccagctactcaggaggctgaggcaggagaatggcgtgaacccaggaggcagagcttgccgtgagccaagatagcgccactgcactccagcctgggcgacagagcaagactccttctcaaaaaaaaaaaaaaaaaaaaaaaagaccaccatatacaatcactttatgtaaatggcattttgtagaagtcaaggcaaaggtacaatgttccatgtttgtgtcattttcagattaagaagaggaaaagaaattgttcatgggtaaaattaggaattctgggaaactgggactttgggacaaggtataataatgaaacattaaacccctagtgagctcttagggggcacgtggtggaggtaggagaatttcaacattccaccctctgtggggtgagtcttcaatccattttatttaatacgttaaagtaaaaggaaaattcctaaaaccagaggacttatggatacctagcagttgacatctgggctaacatctgacctgtatttaccttcagaaatcagggaaatccaggatggtggcaaccgtgtcaatatgacacagtgaagcaggtctcaccacagaccaacctggttgcaatattcctgcctgcgttgggagctaagtaactggaacaagtttttgtaacgtgattagagtttcttagaatgagtaattgtcacagttgctgttgtggaaaagtaattaattatatgaagtaattagttttccctcaagcatacttaggcttgatatttttgtgtatagaaatgaaaataacaaaagcaataatatatgtatcttgataggtagtgtgctggattgtagatagaaaatggcgttgatggaacgtgaaacatgaacatgttgtgaaactatagaagtgcagcaaattggtacacaaacactgtcataatacaaggggatgactttgaaggggcagctttaaaatcaatatcttctttagtagtggtaaatgctttataaatgctgtctgcctgaataacaagatgggaataagccagacaaatgtagtcatgattttacaatttcagaggaaatcaccatcaataacatgcaaaatgcaataatttggaagtgttgtaaatgtgcatatttaagttctttaattaatttcaacatataattcaataagttctaccctgattattcagtattcatgtattcaacattctaaaccactaaaagcagaaaaatactgcttccaaagaaggatctgaagtaaagcacatgtatatttagaatatgaaaacagtaattttgccttgaagaaatatactaatagaaaatgaatcaaaggtgatcttgggaatatgttttctatagtgaatacacatgttagttcaagtcacaaattccttcctataaatatttagaaagtatattgatgttcataaatcattatgctttaaatatatttgaagaaaagatatatgagtagaaagaaaattcaaacatacacatttacatgttaatatcaacttaaaagttaatggctattatcagtcaagtgtacatgaatataaaacaaatactatgtctctaacattggaatagaaggaatggcacatgtttacagaagtataaaatgagcttcctatcctcataatatttttctaatattcttgagtataggggaaagttaatgagcagaaaaattaaggtgagtaatacaagatgtgtcatattgtatgcagtgcatccacacactatctaaacaatgaaggaagagagttttacagaagaatgatttacggagagattcactgggctagtgagggtatagccagtccttgagagatgaacttcaggtatagaggaggaaggatcatccagaggaagataaacatcatgagcagagatgaacaggcctctatgtaagcggaagagaaattcagtgaatgcagtgggaggggaaagtggaaaaaaaagaggacagcaatgattatacaagtcaaataaagcataaaagcatcagttacacagagtacaatttcaaaaactaccattgataataataaaaatagataagaagagactgctggatacagaaaggcaaaagcatgagtgatgtcagagattaatgcaaaagagatccaaactcagaaaccctgggttcaaaccctggcattgttgtttattagctgtatgactttgtgcaatcactaagccactctgaaattcctccactcctcaaatggcaatgatattaattaattgacaagtggcaaagttaagataggacaatatttccaagtagataacacagtacttgatataatagaaatatctgttatacaaaggtcattgaatgtaaatctggaaaaaatatttagatctctgtacaaattatgtgttgtagatatgtgtcagtaaagccactatgcagagtcatggcaagaacattccagacaaagggaatagcaaatgcaaaggctatggcaggaaagagtttagagtaagaaatgaaaaggaggcaaacacagaaagactatagtaagcaaagggaacaatggtttgagatgattaaagaagaaggctaatgccaatcatcttgaccatgctagggtttattctgaaaagtgccacaacaccagggatgctagcattaagaaaaagttgttcagaatatattttttccaaatatgtatagaaataaatatttactatatttcaaataaagatatggtaaacatgaaatatcaaacaaagcataaactaatataactatacatgcaaataataaattacaattataatgtaaattgtgaaccactgatgactctgctttttttaacttcagcccactgtgtgtgaggatcactgagctgctgctgcctttgatgtaacatctccacgttggcccaggctttcctgccctgtttagaggctttacgagacgtttagttgatcttttatcttaggcccgtgtatctttttgatggttctctggagggaggttgggatagctttttcttggacagcaaatttaaacccctgctaacaccagcagagcccatctcatgatttacctcttctcctctccaccagacatctgcttattttagagtactctttttacatgactcaacaaaaccttttttttttttttttttgagacagaatcttgctctgtcgcccaggctggagtgcagtggcgtgatcttggctcactgaaacctctgcctcctgggttcgagcaattctcctgcctcagcctcccgagtagctgagactacaggcgcgtgccaccatgcccggctaatttttttgtatttttagtagagatggggtttcaccatgttagtcaggatggtctccatctcctgacatcatgatccacccacctcagcctcccaaagtgctggaattacaggcgtgagccaccacgcccagcccctcaacaaaacctttttatttggcagctggtgcgggaagagagataacgagatactgtcatggatattgtaagaattgtggagtaaagagaggctgggggaacttgagatacaggtgtcctgaataaggataagagaaggcaggaaaggggagagtaagaaaaatatacagtgccaaacatttgcaggaaaatgcccaaaataaagattttatgcaaactgaaataccagtattttgacacttaaaattgcttagtataatggaaaaataaaaatcaatattgaaattccaatagagatggagaaaagtaacaatttttttaagaatatggaaagaaaacaagggcaattcctaagtttttgccttgagcagctaagtatagttttaaacaggtggactgtttactaaagggtgaagattggaagcatatgaaatttgaaagaaaaactaagagctccactttgaatatcttaaatttgagattcctctaaacagaggttgcttaggtggttggatatataagtctggagtctccagaagtcagtgatagaaatctacacaaagttgactgttttcaagatatctctggctttaaaagccatggaacaggatgagatttcctagagaggggttattagatgagtaacagtagaagttcctataaaatctgcagataagtttaaacaatgtccggggaaggaatagagataaaaactcaagaacaagttgccagcaaagtagaaagcaagccagcagagcataagtcagagaaaccaagttaaagaaatgatctaaacatgaggaagacgtcagcatatcaaatgctgcaatgatgacaaatatgatggagatggagacacagccatttgagtatgataacatgggaagacgccaagctggagttggggaagtgaaacagaggtcaagaactggacatcatgagtagagaaaattccccttaaaaattctctgttgaagcgttcaaaaaattagacaaaaaagaaagaaaagaaaagggaaaaaaaggtaccaagatataagagtaactaaggggaatgtaaaattaatatcatgtaaatatttttgtttgttttttctttgtaaatttgaagtagaacatgatcatatttcaaaagcagaaggattgttttgaggaactgtaggaggtgagtgggaagaatgtgaggaggtgaatatagtagtctgagtaagaaatgatggtgggttggacaagcatggtaacagaggatgtggagcttaattgtcagcttctggatgtatgttaaaattagaagcaaaaacattttttaatgttttgcaaacgaaatgtgagagaaaaagggaggcaatggtaatagatatgacaactcatagaatatgacaacataggctttcaacaaatagatttttagcaagaatgtgtaaataaatgatttttccctaccaagactggcttttataactagcttagatacctctctaacttttggccctggatttccctattctgatggagagtgttttctctccttcattataaccctaaaatccaaatgcatattttagctgtttatggattaagagcataaagatttttgatcttatcttgtaatatccccttgattgctagaatgcctgaaggatatgtaataaaaataaataaataacaacaactctgtgttccaggccaacaaggcacataagacataaaaatggaatgtaaactcttgtcactgatttgaaaggaactgtcagttgtttgattctttaagtgattctgtcacacactggggacccccgtcagtgcagtttcactcctaaactacttttattaaaagtatgtatcatcatgtggccacaaaagcatgctatgacagaatagtaattttttctttctcttatcttcactatcttcatcatagaaaagtgttgtgtttctatggttgcaggaactaattaattctatatcaagcagatatattaatagaaaatactttttgggtattgaaaaacaaagttagtattttaacaaattttaggttgttttgttcttcccatcaacaaaatcccaccatttaaaagctattcctgtattattgttttcaacctctccttcttctgtgtttacagaggatctaggccagaatgtgtaacttctgccagattcccatgatgtggattatatccatctctacttctgagtgttttccagaatctctttcttattcccagtgtaatgccaagatgagatcaatcactggaatgtgccaattatcttaatatatgcctttgtcagaggtcaacagcgtgaagtgtgtcctctcttttatatacagagattgtggtgttgttagggatttttccctctttagaattggtgcattttaactgggatgttctatggacatatctgatgattacaattactatataggcctgattgttgttctgcctagaatagtctctatttttcatgcatgctctatccagtattgttatactttttaatggattcagcagatagtgttgctttattgtgaagaagcattttatcctcaaccttacatgacctagccttgtctactcttctagcattgtggaaagtagtgtttatttgctacaaacacttttgctgagtggagtgctttggttggtagctttttccattaagtgcagtactgtgaaaagctgcagctaatgcagacaagtgaggctttaacactctgcctgtctgggggatgttgctgatatctggacaaagcttgcactcagaaggtagtcttggtctgtttctttgcgtttagaccattgtgtaagctcaattcatagcatgcagttgttcttcacctgtgcactgttaagaagggtcctgtactttaggaacaggtaaaggttaactattagaatccacccagcacataataggatacagtgggatttgtggttcactttggccggttctatcaatatgagctcttaacttggagtgcaactgtgaaaagaagtactttagtcacaaagcaataggtagcatcaggtttgcccagcacaaagctgcaggtggttaacgatggtttgccacaccgctgttaatggtgctgctttagatcagtacaaccctgtaagtggtagcatttaaatccagcacaacaatgtaaaaggtggtgttttcatctcattcagaaagaccctggtgtggtaatcctcactttctagttgatttttgataggacacataggtgataatatggactgtttccatcattattctcatcaagtcacagatcattaaagacaacattaagtgaaataagccaggtacagaatgacaaacactgcatgatctcactcatatgtagaatcaattagttgatttcctgaaagtagagagtaggatagtggttaccagaggctggtaaggtagtggggagatggggggaccagaagagggtggtcaatgggtacaaagttagttagatgggaagaatgagtttcagtgttctgttacacactagggtgactatagcaaagaacaatgtactgtatatttcaagacagctagaatattttaaatgttgccactacaaaaaaaggtaaacgtttaaagtgattgatatggtaattacaccaatttggtcattatactttgtatatatgcactgaaacatcacagtgtaccccataaatatgtacaattattatgtgtcaattatatattaaaaaataaaataagggaaatatttttatgtatttccttagtaccaatgatttccttacccataactcagtctttgttttaagataagtggacttaatatgaaaatattctaaacctctcaaacatgtctcttttaaacaagtatcaacatgaaatattagtaaaaataataggtaaagtgcaatattaaaaagcgatttgtggaaaagcaaaggtaaatatgccacaggaatcaggaacatatgataagccataaagcacacagtttatgtatgaattaccagtgtttttctctaataccttattctaaataaagaaaaactaacaatacagaggctttgtcctcgatgtatgaatctcaatttttataatgctgatacttcactgaattcctccttctgccatatatatatatatatgactgtatatactattagttgcaagaaatgtgtgatctttataattaaaatcaataaatattgaactttagtgtggtgcatcatatccctcataagggtttaaggccttttaaagcctttgtgcttcaagtctaagtccctaaccagccacatcagtatcacttgggaacttgttagacatgcagaatcttaacccaatctacagactccgaaatttgcatttcagcaagatccccctgattcaagacacgctttaaagtttgaggatcactgatctaagagacccagataatcttttgggtcttgccttggtgaagatactttccaaggctcaggcatcacaatctaaattaaagcttttgcaggatagtcaagaagaccattactaaattttggagccacttcaggactttgctaaaaattacagagatcatttactttgtggctgagaaatgtcgtcctataccaaaagataggattaagatatgagtttaagtaacctggaatcctgctgaagagatgaattcagtcattgactatcctactaatagcatagtaagagcaaggagttctggaaactcagaagacaatatagatttttattcatagaaatgcaatgtgaagaaaagatcacagcaaactaccaagggctactatctcttatgtgaatctcttatttaacacacattcattcaatcagcattttgtaaacatctcataaacacccactaatcacagatttagggaaaaagctcataagcttcataaagaagtctgaagcaaattatcttaaagaaatgttttcttatatgtctttgcttcagaagtaaaattaacatagactgtatattagtatacttggtaccattacataaacatgtgggaggaaaaaacatatttgttccgattgaattatttgtgttggcagatagccaattctcttttcagaattccactactggaatacttgaagttgaatgaaatataaagcaacttctgtttgccaggctataaaactaaagatgtccatcaggccaaaggattcaaaactttataaatagacaataataatcgcaataaattatattgggttgaaataggcatacatataaaactaatatgcttgaaaaatgatgacctgttctggtattattattattaatcctgttatacatgggaagttttcttcaatcaatgattagcaagaaaaatgatcagcacttagtttttgagataagttttctttatacatctaattttttagaagctatacatagtattcattttcagatctcaacttcttgatgcgttagagttaggaaatggtttctgatccagaagactctcctactgttgtaagaggatatattaaacaataccaatcatatgattcatttgagtaacaaatataattgaatatttagcatcagatataagcaaatataaagctggagtctcacggaatgttcttggttctgaagcctcagcatgcctcacccctgtagcaagtcgtctacaagtgattctatcccaattagttaaattcagtccacctttgtatgctttcaattccttcaggtttgagtagtctctagtagaatagaggtaggaaaattaagctattttgaattcttctccttcctattgcacgttctaaactcccaaaatatttcaagcccgtccaaagagtagtgaggggagcttggaaggagtggaaactctatttatgtttaagactgaaaaaaaaaaatataggttgtttgtttagtgtgtgctcagttatctactggctctgactgtcagggtttttacccagcctgttttccggtactggttatatctagctgtttaattttaggtcctctgctttctcagatatcttatactaactcttttgtgttattataagactaacttgtggcacattaagtgttcctccagtgcccagctggccacacactccataacctcagggtaccaagaattctacagagaaatgattacttctacctcacattttcaatgagtaatcaccccacagctttctccggtatttttcacttctggatgccttcttggtgtggggccatggaagtggcaagcttatgaatgccatagcatctccttggttccttgggtgtgtgggaagcccagggattccttcccaggttgcatcagctacgcagaaatagtaagccctcattgacaccttccttcttgtaataccactctgtcatctctttttggcatttaccacaattctgagccattaggatgtgtctagagattctgttgattggaaaattccatgtagggaatatgataccagtttccttcacttgcaaatattcctacatattgtggggaggtatgtcaagaataacaatttttgctccctaaaactgtatccatgctacccccattcctcaggcgggaaccttttcttccttcctcccttctttccttcctttttcttagctttccttttcttttcttttcttttcttttcttttcttttcttttcttttcttttcttttcttttcttttctgtccctctctctctctctctctctctctctctctctctctctctctctccctctctctctctgtctccttccttccctccctctctccctcccttccttcctccctccctccctcccttccttccttccttcctttttcccttccttctttccttcccttcttccttcctttctttgtctctttgtccctttctttcatggcagaagccttttgcctccttaatatcttaagggagatttttgaagtttgccctttggaaaggtacttctttttaatttaggattaaaaagatagcttttttttttttctcatatgtgacctaacagtccagcacttccagtttagcactcagatgggaaggtgccagtgatagctgagggaagcaggaaagggcatatgtaggtgatatttcacatcatcacattatatttggccataaacttttgctaatattactgtggaactttaggacttttacagtagggaataatttatattttaatatgcaggaaaaacaccatttttcctgacaagcaatgacatatttcattttaatctatgataaatgttagttaaagtcaatttaaaaaatactgtaaagctcaaaattatgcctatgatatatatgtctttaataatgtcttttattaatgagataagattaggagaatttgatatgagagctaacatttaagaaaatcaaaattatgagtcatagtttcactttttaaagttgatttttgaaataatgtagatacatggttaattgattttaaagcagtgaaatattgtatcctcataatatacactgtgtctaaaaactacctgtaaatctcaatttgttacttggaggtgttttttttttaacataaaataagatatctacattctgaggcattgaggaaattggattttataaaataactacaataacccttttaagttgtttttttgaaaatgtctccacctttcataggttgcttattgacacatagcttgagaagagaacgattttctgagagatttttttaacattgatttagccatttagaaatggattttaacttgttattgatttgtgtattattttacatattatatctgtaagattttataagaaatcaaacatcctttaagatgccagttgcctgctaagttacttgtcattttgataatatttcggtgttatttccaaatagtgttctatgttgaagggcacagatgttattacattatgtattttaaagtaaagtgagttatactaattatatgtaaaacattttatcacatattaatctcccttcctcctgatataccaaggttaatatgttcacatccagaccaaattctttgtgcaaatgttcctcaaaatctttgggtggccatcatcaatgcatcaatgacataataagaatttattgaatgtttacaacatattgaatggtgtattatttgatttattaggcacagacactttgtcagaagtttaaaatccatataggaaaatgacagatttacaaaaagacatttaaaagtcaataaaactagatcattaatatttaatatattatacataaaagctataggaatgtggagaaaggaaaccaaatggggtcatctactttaaaagtaaagagaaaaaaacctttcctgatgacggcaggactgaagttgacttttaagaactgatacgaggatgaagagaaatgagtttaagggtacaaacaagggaggaggaataaactcagtcgttgatagcagagtaaaatggctacacttaacaaaaatgtgctgtacacttaacaaaaatgtgctgtgatggacaccctgagtaccctgattttttaatcactatgcattttatacctgtaacaaaattcctcatgtactccataaatttgcacaaatgaagaaaaaaactgacatgtaaatatattttctctaattttaaacctagtaaccaattacttgctatgtgagcaatataagaccagcgtagaaggttcatgttccctgctgaaataggatgttgtgagctaatgcaacttacataaaaattaatgtgacacatttaattatttgcataatgattattttacctcatgttaattaggtataaattgtaatgggtaagggaaaggccaaggactaactttgcccacttcagctgttgcctgagtacatctaggctaagaatacggtcaccctcaattcatcccagcttcccagggcaaactgcctctccttacccctaggataagtgttggactccggaggattggggtactgttctctgaagttctcagccagccctctacaactataataccagctcaataggaagatgggtagaagccagttttttcaaacaatttttatacaaggttatccaccagtgttggagcacctaaatgaggaattttagcttctcctttctttttttcacctttacatattaaaggagaaaatattctgtttaccatggaaatgaaaaataaataaacacataggatgacattttcaagaagctcaaaggtattttgggtccagttgatcattgttaatttctaagcatctcttcactgaatttcgttgacactgaacttctactgtatcaagcagcatttatatctactgcaaatgtaattggcttaggacccttctctccttgttttgtcttaaatatttatttactttttgtgtttgtttgtctctcctactaaacaacaaggatcacatataccttatttccctttttatctccaaagtttggcacttggaaggtttttaataagtatttgttaaataaatttctgatttcatctgccatctctctataaattatttccaaattacaacaaatgtgactttatttaatctttactcaagatgttgaaagtggaactcattgcttcttacattttctactttataacctcaaaaaatatagtcctttctgagggttctgtcttcccttctaagtccacttagtaaatcatcaaactttgttttctttccttcgggctgtcttggtaaacctctttttctttctacctgctagtcctagcagttaccacttcctgtcaatatttgtcatccctcaagcctcttctaaacattaataatagaaaagatccttaaatcacaccttctaaactttgcctagaaatatcccttgagagtaagaaaataatctaaattaacttgatattcaaagtactccacagggatttccaccacaacctcctcaaattcattatacataaactttttgacaaagcaaactttactaaacaacgaatttgtatttctccttctttggtgacaccacaccctaaaatttttctttccttaattctcatcctgctctgagactaatcaatcccacctcatctctgttctccaacgcccagtaggatactggcttcctctttaaattctgtgctgcctgctttctgagccagccacctggcaactagccataaaagactgtgtatgcttttttacatttagaggtatatgtcacacttctgcacataaagttactttgctcaatagtagagagtatgccatatacctttttaatcatatcactttacacactagcttatatctacaaaatgcataaccattttacctatatactatatatacctatatacctatatatacctacatactaacaaatgttttaaatattacatatacagagatatgcatacatatataataactgtgttatagaaattccaaattcatcagataaagtacaagttcttaagaatctaataatagatacaaatcatgtagattactgaagaggtgcagacaaaatagttaccatgagatagagacacacttttatacgaatatatattatgtatacataatatttgtgggggatataattttgtatattaacttctagtttctatcttgattatttactttattgaataataataataagaaacatatttttgatggagaatagaaatagatttagttagtagaaatagtacttgttaacttagtgaattcagaggagatattaaagaggaaagcgcagtgtttacattcatatgaactcaagtgttaggtgagccaagaacacagcagaagagccaataaaaggagcaaaaggttcattgacaattgtattgatcaggcacatttctggctacttcaattgagagcactacccatatattaatatagttataataaaaaacacatacaaatgaactgtggccatttaaggaaaacaacacatggtttggctcccactactttatgggaaggtctggggaggagtttgtgcaatgtaaaaaaaaaaaaatgtatcaaaaatcacagtgttgaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaatgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagcagaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccgatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcagcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggagttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtatgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacagtctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactagcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtgcaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaattaaagaggacacaaacaaatggaagaacattccatgctcatgggtaggaagaatcaatatcgtgaaaatggccatactgcccaaggtaatttacagattcaatgccatccccatcaagctaccaatgactttcttcaaagaattggaaaaaactactttaaagttcatatggaaccaaaaaagagcccgcatcaccaagtcaatcctaagccaaaagatcaaagctggagacatcacactacctgacttcaaactatactacaaggctacagtaaccaaaacagcatgttactggtacgaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggattccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaatgaaactaaagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcaccatcactggccatcagagaaatgcaaatcaaaaccactgtgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaagggctataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaagatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaatcacagtgtttgtgaactcaaaacttctatactgccaatctcttttaaactactatattatctgctgaaaagtcataattttcaataaaatgtttaataaatatgtgttgtcccatctatgctgcatactaggaattggaagtccttttagttactggcagatgttacagcccactaccttgtttgcttgcccaggaaactgatgtcagcaagaatgatcaggtctacaaaacagtaagattagactaggtagtaagggcaatgcatgggttgaattttgtcttacaaggaaaacaatgttgaccttctaacctccctggtcagaatgtgactttatttggagattgggcctttacagaggtaatcaatgtaaaatgagttgatgagattgggacctaatccagtaagcctggtttccttataaaaagagaaaaattgtacacagaaacaaacatgcataaagtgaagatgatatgaagagacacagggagattaacatagtcatctacaagccaagtagagagaccccagatcagattttatcctcagagcctccagaactgtgagatgctaaacttgtgttgcttaagccactctatttgtggtccttcattacactagccctagtcagctattacaggcagtaaacttaatcatctagctttccattcttctagttcacatatgtatgtagattattatgacaagaacaatgtgtgtctatatgagttctaagtctcaatagttatgaatgttcattaagtggcgatcatagaactgtaggagtattaaaatctagcaatggacatagacattgcaatctgctctattaaaattaatttcaacacttattctcctttctcactgataaatatgcaccccattttcttaaacttgtcctttagctttgtatgccagtttcacatgactattcccaaatgtctccctttcttcctggaaatgacgtggttatgacagatgatccatatagcttagaatggatgttttggataaatgtataaaactccagttagaattcaaatttgtgttctcttgccttgtgcttatttatacttatggttgtttaaacttgtgttacaatactgatgtctctttgtatttgataaacaacaaaacagtagataaacaaggatatatagacccaaagagataagtggcaagcaattattctgagcaaggatacacagaccccaaaagatgagtggtaagcaattattctgagcatctgactaaggaagggctcctcataatactagtggttatgggtgatacctgtgcagatcagaaagaccccacctgtctaggttctttttcttttcataaggttatggctgatgcctaatgtaatcattaatgtattcagggagccgtggaacacacagaagtccaggaagacacaagtagaaaattaggaattgattattagggaaaagaggaaagaaacaggaattggttgatatgcctatcctggttctggctgatgaagcaggttcatcaggaacataggaacagattctcaggctcattcacttaggaactttagattattgagataagataggtatcatcatctctcagagccactgttgaggtgatgtttatattgggtagaagattatagtggaaagaatatagactttgaaaacagaaaaagaaacaatattagtgctctggctcaactgtttactgggtgtagttctttttgcaaggtccttagttttactcagtgccattttctttttcttagggttgttagaaagacagaggtaatagcagttaatggaaattcctcatgttctatgtgccaggcactatgtatagtgattcacatgtgttaccttattcaatccttataacatgtttataagataaattgcactgttaatccttttaatacaaatgaagaaatcgagattcaggtacttgttcaatgccacaaagacgatatatggtagagctttgtcagtctagttcaaaagtcaaaacacttaaccctgctttctaatgtgtgcaaaacacttagcataatgtatgacatacagaaggattaagcgaatattaagtccctttttcccaactaactctaaaatattcagactgtaggggttctattaatgggttctctagtctgccaataggaaaatatcactgatgtaatggcctatttgagtctggccctgatgcatcatattctatctggtgttatttctcagtcaggtatagattctcagtcccacaccaatatttaggaccaggactagacataacatgatgagaaataatgggatccaaatgatgaatttatggaggaaggtggatagggatcttagaacatattttgttttccagacagtgctttaatcagattcaaagaggtaaaattagtttgtaagaagtcgaactattacttcatgacatgggtctctgtaagagaggatggtgacatttatataattatcaggtgaaagcaaaacgtagtttcagtgcagacgggaaaattactacaagggaacatgtgaagaacatgtgatattaaaccgagcagggattccagtggccgcatgttaggaaatgataaaagttagatagatagctataatgaaaggtcgcaagcttagtttaggttgttttcattaaatattccaggtaatgggagcaagtgtgagagatttccccaaggtaagggtatagcagggatggaagaagcaatggtttcagaagcaaaagagaaatatttgttaaagagagcaataaataagcagcgctatgtgcttagaaaaaagcggggagtagacacacaatcctaagtacccaagtacgcgtgcacaccaaagcaaatcattgaaactgcttactaatgtagttgagccttcatggtattttgcactcaaggtgctggtgaatgatcacaaagtaaaggtctccattcacttttttaatgtgatgcaaatgatttcaaactttattttcaaggtgccaacaaagacagcttaggctgtcattttcctatagatgctgctgtaccttcatacatcaaaaagtttatttgaataattacatattgtccacattcttatcacaggagtttcctaacccataataactacatcaaaagaatactcagctacagcatagtgcatttcaatagtgtagtcagtaacagatacattctaaaagcttttcaaacccaccagtatttagagattcccccaaacagatataattcatctgagtaaaatatatacagctgtaatttatcaggttgactcaagggagataaatcttactaaagacgtacaattaatcacagtccttctagtatttatctggcggcttagaaaagttaaatgtaaaataagagtcagttcaaattctctaagtgtgcattaatagagtctgtggttgagtaaatacacagaggaaaatggatttgtgttcaatttaaagtaaactatatttaaatcagtagtcctattcaatagctatgaatttaccaatttcaactctttcatgattcatgtatattataatcaacccaagtagttgaaaaaggtggatggaggaatacacaatcttcactacaaaggtataatatgcttccttttttccgtcattctaatagcttcatttgaccaggaaacaaaattacatatggaaaagttgtcttaacagccaattggatagactggcagttttatacttttggataactttaagaaaggtctttgagaatagtacctgaacacctaacatggataatagaattctataatcctacaatgaaggaggtattttgtggaatttattccatatgggagagtaaaaagcagagttaacaggggttgtcatccatactcatgattgcattttgtatttttcaagggctcactagagccacaaccttcaaaatagatcaataacattactcagcaactgatatgtaggaggcacttgcaataagaatttctgagtctttatactaactctgtgaggtacatcatattatttagaccatccctacgaggaaactgagactcataattgttcaacggaatgttcaaaatcagaaagctactatattgcaaagtctgaccaggttttctgatctcaagactgatgtaatttctacttgagcaagatgcagcagaaagtgaatgggtttttggagtttggggtcagatgcacctgcttgaaaggctgtctcacttatcacctgtggatctaaggattattctcttaatccctctgaccccatcttcctcttacgtaatttaaattgagtaggtaaaaagttaattttttataaaagcttaaaaattacaccacctgtactatgtaaaaaccctattgaattcccttcctagtatattgaacatctattatagtacagtaattaaacccatattgtcttctttagtctttttaaaaacttttgatctggaggattctaagtctttcatgaaacaacaacgtaggagcctgagctctccaaagctgcctttacaaaattgaaaggttctctagtttctcaaaacacaggcattatcatttattaatctttttaacttcactttatgcattcaatgactcattccctttttcatataacatttcatatgattccctctttcaactatttattattctttatttgaaaggcactctgccagattcagaatgcactaagacaaaattctggccttggagatgtcaacactgttgtgaagtgaagttgacacaccagtagacagatgagtggtataaagaggagcgggcaaggaactgagagcactggacccagaaacaagaactgaggttagaaagccaatgcaagtgtggagcccagggaattggcaggtttcagagtcacttacactccaggaagtttggaagccaaatggcaaagtagagctagatttctggctcaaggtctttagtccacaaccacgatgctcacaggcaccatccatcattaaagaaaaaaagccaaaggaggatgatatggttaggctttgtgtccccacctgattctcatcttgaattgtaagcaccataatgcccacgtgtcaagaaagagaccaggtggaggtagttaaatcatgggggcggttttccccgtgctgttctctgccatggtgagttagctctcatgagatctgatggttttataaggggctcttcccggcttcgctgggcctgtcttcttcctgcagtcttggggagaagggtccttgcttctctttcgccttccgccatgtttgtgagtttttctgaggcctccccagccgtgctgaactgtgagtcaagtaaacctctttcctttataaattacccagtcttgggcagttctctatagcagcatgaaaatagacttatacaaaggacatagcaaaaagtaaagcgagaataaaatcaggcaagaagcaggcaataaagatagcagggataagaagagagagaaaaagtaccgataatatgcagcaaaaagattgaaattttaatctttattttggcattaaatataaaaaactaaaatccttatagtaaagtaatatcaggatgatatatttgacaaaataatgattcaccatttttattctgaggataatagatacttgcatttgtgatttgatggaattaaaaagcatccactaaataaagtttgtcagatgaaataaaatgaagggttatttgcacaaatatattttagaataaatatttttgatgtaaactgttaacttgtactttatgtttggctaattttagatgtttaaaatctagattttgctaaaaatattggaatgagtcaaaatgtttcctgaattgttttctgcattgttataactatagaataattataaaactctgttatagctatatagcatgtgaattatgtttccaaaagattagcaaagttttatatgtgtttgaaatattcattttctgtcagtcaaaataaacttgaaagtggaagaatttaggctaggcagctttaatcattttttatccaaatgtagcaacaagctgtaattgcattatttcatataggtattacactcctatgtgcttgtttttactatatcaattccaaatatctatgtgaagtattttcattcattgtttatttttgtcatgtacatacaatcatttctcaggtttccgaatcaagtcataataacagtgaaacaatccagagtaaagggaaaaataaacatggttttctcaagttcaagctttcatacttatattttgcttttttcattgcaccacgagtggagggatggtgggagccacaaatagctgacttaaggactccatctgttagcaaggcttgtctcagtggcttgagagatcacatacaccctttggctgtttaagggaagaaaaaggcactgaattggattagtgattcttagccttaggggttgggaggagttagagctgggaggtggaaaaggaatccagtatccactgtgcatctcccagttctctgggctttgctggatgtttctgcgacaatctgttacagatctttgctcctcgatccaggtgcttaaatgctaacaataaaaatttgtgttgtgaggctggaactgtggaactgatggaaagtaaccctattttcctagtccattgccttatttttttttattgtaccccacttgataaataacttggcagccaatagcaacacaaagcacaacctataaagaagtatcccctttttctgtaagcttataatccttacgatgaactttctcaagaacaaggtagaatttaagtttttcctaagaatggccgtactgttgtttatgtgtgtgtgtgcatgtgtgtgtaggtaggtagggagacagataaatatagaagtaatactatatctattttattatatatacctattatatataacaatataatggtatatatcataaatatataaaaatatatattatatagatataaaatgtgtatataagaaaatgtatcttgccgaggaagagtgaataagaaaaaatttaccaagattaattatttgataactaagaaatcataaatacttgaaactactacttatatttgttcttgtttcatgcaaatgagaggatctgcttcatttgttattgggctctaattgtacttttggcttttggacttctctaaactgactatttttaccatcaaaattacattgttttgttaatagatttttctttataaaatcacaagattagaatttaacttcaagttagtataaacccaactttttaagaagaatttttattgaaaatttactcaattattactgattttgtgaaacctaatccacaattttcctacctatatttggatgaatagtgatatcccttcttctgatgatgacagcttagctactgaaactgacttgttcttttgatttacttttcttttggggctttttgttttgaaataattaggaattcacaggaagttgccaagaatagtacagagaagtcctatgtacctttcaactagttacccctactggtattaatagtatgttgtgtaattatagtacaacatcacattcaggaaattgacattgataaaatccacacactttatttggattttacacatcttgttttttttttttaattttttttggagcagagtctcattctattgtccaggctggagagtagtggcatgatctcagctcactgaaacctccacatcttgcactcaagcgatcctcccacctcagcctcctgagtagctgggattaatttttgtgctttttgccgagacagggttttgccattttgttcaggctggtcttcaactcctgggctcaagtaatttgcactcctcggcctctcaatgtgttgggattacatgtgtaagccaccatgactggcctagatttcacatgttctacacctgttctgtatacacttctccatgtaagcattgtatgtttttagttctgtgcaactttatgacatttatagatttgtataagtcaaaatatagaattattctatcacctcaagaatcactcttgctacccttttataagtccgctctgttccctctacttcccctaacatttgccattccgatgtggcagtcactagaaataaaaataacacataagatatatcattaagaataataatagtctaagctctaaagtcagactacttgattctgcaccctggctttacacttcctgccatgtgactttgaacttaatctccttaaacatcagttctcttaactataatgtgagtatattataccatgtacttcatggtgttatgataaaataattctgataattcactatgatagaaattgctatgatgtttgtccctgactagagaattacccatatcctcgaccagattataagatatagatatgaatagaatatggatattttcttataatctagtagagaatgtggataataggctattatatagcagtttatatagcagtataagagttagtggaggttgctgtggcaaaacctatgaagaaatttaacttagaatttggggaaagaatgtgaggaagtgataaaaactgatatagatgatgatacagatgatgactacatgggaggtaaagaaggtgaaatatttttcacagagggtagaggctggaattaaggaaagcataggtcctttaaaaaactgtcaattatggcctggtgcagtggctcacgcctgtaatcccagcactttgggaggccgaggcgggtcgatgacctgaggtcaggagttcgagaccagcctggccaacatggcaaaaccctgtctctactaaaaatataaaaattagctgggcgtggtggcacgtgcctgtaatcccagctactcgggaggctgaggcaggagaattgcttgaacccaggaggtggaggttgcagtgagccaagattgtgccattgcactctagcctgggcaacagagtgagactccatctcaaacaaaacgtaacaaaaacaaaaacaaaaacctgtcaattgtttgatatggctgcaactcaaagattgagagagaaggaccttttaagatatgctaactagtctaatttccaacctgagaaccacgtagcatgatcagttcagatctgcatttctgaaaaaccatcctggctgcagtgtaagttattattgaaggggatggtgacaggtatgtttctttataaatgaaacatttataaagttctaagaaggataatagtacattttcaaggaatattagtgcagatgtttgttacatgatttttgatagacacaatggaggtgatttatccattatcttcccgaaggctctgacaaagtttccataaagcttggctatattagtccatagaaaagtgacacataaactttagtagagactaatgacaatttttctttgaaaagatactctaatctcttattttcctcaatgacaacttatgaaacattttagaacttgagatccctatagttctagaggagattttttcgatgtgcaaaggaatattgagatcaatatattaccaaattctgtgcattatccattggggagacagaagaacttaacacatgaagacaaaccaaaaggaagtatgaataaataaatgtataaaatgaaaccactgagacaaatgagtcggtaaaatgaatgttgaaagacaaattccacctaacagttcatctatagtgccctacacatagttttatcacagaatttattacctactttgttcattattggttaacattcccatgtcctgtactagagaacatattactcaacaacaaagcttttattttatctgtaattacagcccctaatacagtatctcacacaataaagtactcatagaactttaatgaaggagtggagtagtgactgaatggtgtcaaagtatgtgggggtaaatatttttaactatattcaaggatgagaattttaaaagaaatacctaaaacttggcagaggtctggaaagtggttttcaaatttttggtctcagtatacctttaccctcctaaaaattgtgtttacagggcttctattaagactatattagatgtcaaatttcagattataaaacatgtattgattcatttaaaacaaacacattaatataaaaattgttggaagttgaatagtcttcatgaaattcttataaactaaccgaaggcaggaacatggtgggtggaagcacttttattgctttcaactgggcaatgatttgatgtgccagtcattttacaaatatatggtaagtatattgattcatcacttgattaatcactcacagtttcatgtactaagcttcatcttctgtgtaatctacgtgaaagcagataaccaaatttaactgttctttgtcacctaccagaagaggaaattggtatcctaagaatttctatcttcagcacaaagtttcactcaatagatgttgccattattctttttcaatcatagtgatttactgaggaaaactacaatgattaagcctgtcatcagttcttctaatacatggacaataaataagataaacatataatctagttaacctgggactgttgctgattgtgtctgttataccaggctaatactttcactctcagaatatttgggttttctaattttccatgatgtgatgattatgcattgcatgcctgtaccaaaatatctcatttaccccataaataaatgcatacacctactatctgcaaaaattaaaaataaaaaatttaaagagaatatctaggtttagatattaaactgtttggctaacccagccataatgcacaactttgtcagaagttttattaatcaatgagtctgacttcacatgccaaatgcacatctagatcatgtagtgaataaaataatagacatttcaatgaaagcttataaaatcatttaatgtcaccaaatggaaaaaaaggtgcagaattgtcaatagaatgctttagttatattatcccatttgtcccattcaagatcaaaactgactccatcaaaattcttaaaatcagagttttttgttaaaacaaaaaaatcaaaaaactatattagattttaacaatgttatttatatatcctaaaatatttctaattggagatcaatagagcctatattaaattctaaatttttcacaaaagtttacaaatttaattctgagtttgtaaaatgtattataatagctcaatgagcaactaattaaacataatatatatttctgtctggtttttcgttatgtttctattgtggttaaatacatgtaacctaaaattgaccattttatgatttttaagtataaaattgcttccatttcacatttccatggagctgtcatcaccatctatctccagaaatttgttactttactgaagttctgcttgattgtgatttttaagagtagaaaaagtatttttatacttttttgcatcaaaacgagatttaaatacattactcaaaaaataaactataattttggaactctgtgatcgaggcctagtaaataagttggtttttctttagagtgagtcttaaagattaaaaagttctttcaggtcttacataaaatgtgaaatactaagaaacaaagctgtcgggcgtggtggctcaagcctgtaatcccagcactttgggaggccgaggcgggcggatcacaaggtcaggagatcaagaccatcctggctaacacgctgaaaccctgtctctactaaaaatacaaaaaattagccgggcatggtggcgggcgcctgtagtcccagctactcggaaggctgaggcaggagaatggcgtgaacccgggaggcggagcttgcagtgagccgagatcgtgccactgcactccagcctgggcgacagagcaagactccgtctcaaaaaaaaaaaacaaaaaacaaagcttagatcagttgagggctctaagcaatgttaatctataattacttttcattaaacttaaattttaatatttttataagtgcttaaagtaaatctgcaggatacatattggttaagagacgaaaagtatttggctgcagaagcttgccacttttcagcgttaagcttgtcctcaaggctgagtataattattcccagttgtgttcattgttattttatccataatgagttccagaacctctttttaatatttttaacctcgtctttatctctaaatgtacatttaaaaatatcttaatagtatacaattaaataaaaagtaaacattcattgccagcatataatatttaattataaatattgcaaattcttatgtctttcatttgacatttcagtagtattttgctttctgagtagagttaatgatttagcaggatcttaaaactctttttttcttttcttttttttttttttctttttgctctttaactacatgaaaagtaaaatgaataaataagctatgcctaaaatagttaactgcatgcctggttttaaaggctgatggccaagcagttagtatcagcagaaatcccaggaaaggtaacaagttgcatatcaaatagtgggcatagaaaatcaaacgatggaaagctaggcccccgctcccccccggccatcagcagcacacaattttatagtggttttcattttgaaaaaaataggggactctcaaaaatcagaaagcaggttcctgagactgtgagttatcaagatataaaactgtgaaatcatcaaagagttgaaagtaaatatacaccaatagagacagaaaaataaaaactttagagaaatttaagcatctaactatacttagaattttttttctttacattttctaataaaataattcaatggatacttgtatgcctattttttttcattcaaacaatgtgaggcactatgttaggcaaaaggaatacaaataacacacataaagtctacctgcatggagtacggcgtctgtggtagaacgggcaactataatacaaagatacttattgtaagggccctgataggagtaggcacaggatactatggagcatgtaggattggaaccattgttcagtcatggccagtgatgaaagactacccaaaagcattgcatttaagttgaggtgttaaattcgagttaaccagacagagcagaaatgagaaaagcaatcagaggtaatgatgtggaaaagcctggagtcaggagatggctaaattggagtcaaaaaacaaataagcaaaaccagtgtacttgactgatgaatataaccagattgtaaattttaagttacacacaaaaatatatcaaaaaaggatattttttcatatttaaagtgaattactgtatagaaagatgccaagattattaaaacagctacaagtagtgagaacactgttttcatttcaagaataatatatctttataatacaaaaatagtaaatattaaaatatttgcttgcgatatttgggataatttttgtactgctctataatctatcacgagggctttgagcaggtgaacattactcctaatttttgcattggtaatatttttcattggtaatagaacaacatatgaatttgttcataatatttaagattgcaactgtaacatttctttattaaccttcttttagtaggcaagttatcctgaaaattagaaaagttgatgagcacacatgcgaaattgtcttcccagcactcttatatttgcccacataagtctaattgaaaagttagaacatttaccagtgagtatagaattatatggcatggttctatagcatgcctttaagcagaaatgttgaccacaatttttttgttggcactgctatccactgaccatttcctaaatagctgactgaattctctaacatcatggataaaatctgactcgttttatctggaacactttagagctacacacatttgggtggttaatatctaattgagtataagcccttacacctccccataccaaggcagccattgagcacatcttctatctgttgcctagtacttggctaagtgaaaatcctttttcatttacataactttttcattcacatgtagaattcagcaagttaataactgtatatttgcaatagcaggtgactgttcccctaattttgttgtatcatatattccaacgatttaaaataaaatttacaacacgtggctgtcttaaatgtaaacaagcttgcaatcaatttggtttaatgaaattaaagccctatagtatgactaaagagaagaaagcttttggttctttcctgaatttgtaatggaaacaactgttttggtctaaagagataatgaaaaacatgattgtgccaaaactctaggaaaagatttattcggtattagtcaacaaagtagaaaattctgattatctggggaagattatagagactgcattttaaagtggtgtggtttttcaggtactttatattgctcttgtgtgttaaggtgtggaataggatcaatcactttttcaatgaaaggaagatttaagcatagatgctgagccaacttctctgagcttttagtagaatgctaattaacagagatggtaatctaaatttcattgtattcttaaatttgggaacaggtgttatagcattgattattcaatgaaaaggcccgttccctggaaaggttatacacatgacttttgctaacttgttaattgatttttccccatggtattctgtttcacctttttattagaaaactgaaaaaaaaagtgccaagtgaacctgcatgctctttttcaaaaaattttaatggctctccaaacataaccctccaacattactgggaccctacacagtcctctcgctttaactttaaattagtgtctgtctcaattagaatgactctacattctgtaaaaatcctcgggcttctcttactcttgaaagtagcattgccttctttgttatagatagcagtacattgttcatttttttaagattcatttcaatgtaacctctgtttcatgaaggttttcctgataatccccctcatcctagtgatgtcttctgagttacaagtgtccttggtacctatttaccgcttaaaattatattagttagggtcttttcagctgtaggtgataaaacctcactaaaaataatttatgccacaaattatgtggggagttattaacccaagttagtgggaagttcaaggagtagcaataacttaagctcaactggatcccagggctcaaattatatggtcaagatactatctttgactaagttttgcttttctttgcatgaacttggctctcagccacttcatccccagtaggatggcactgatagtcaacagtcttgccaagcttacattcttaggaggtagcatccattttcccaaatatttcaacagtgtatctaagaaaattgctgattacattagcatattttgacttacataacctctccacagataaattactgtgacaaagaaaatgaagaaggccatattctcacccacaaacccagggtctcgggtctaatccaagaatgtcatatgagttgagaaaagggaggcatagttccataaaagaaatctcaactagttttaccaacaaacagtagtggagaaaaagaatgtttagcagagaaagatacaaaaaataaaaaaaaaaagataaaagctgtgcactaaggtatctgtatttatttgtactgatatatactatttgatttataaattgatattggggtgcgtagtaacctggatagctatcaaaacctttgtttctgacatacatcatttaaataactgtagttctcatttaaaaatactgtttaatgaagatgttacagaaacttgtaaattaagggtgagaagttgatattctgtcttcagttgttaactttgttgatcaaaagataaaattgtatctcaatatactaagaactaaagaaaagttaacagggaaatttgatggtaatcttctgaaccctcatttggtttatcagcatgtctcctcataggcttattctcattacaatagtttaatgaatgtattttgtactgtgtccttaggaatactgagtggtctttgaaagcagaacctatttctcggtgcccttctgtgtatgcattgcctagatcagtaccttatctatataatagttgttttaattgttgatccttttaaaagtgaaacattttcaaataaaagtacggcctgtattaaaggattattttgtttacttctgccttaagtagtctcactgttgacatttgagcagtttagaagctgtccttctaattggctagtcatttcttagctactgataatttacaagttgcatttgttttttgagctcacttcaaataatgtttgagtttctaggtaagtgttaatcctccttatcagatgaggtggtgggttttgagagtgaacataaaatttgagaaaaataacaatttttgaccatatattgccagaacaagtttttgctttagtcaatttagttgactaaagttcattttagctttcttttctcattttcaatagatagctgtaacattcttatatatttgagaaagcataacatggtgaaatccattctgagaagcaccctgccacaggcagcacggttattaagctcttggcaaatgtgactgatacatgtctgatggtgatacactgttgcatgtacacaaacttcatctttctccaaatatagctcattgcttctgcaaatacaggccatcagtcaggaagatagaatatggagatggtttaggaacccatcacccctaaagggagaatgtagaaaaacagctcaaacccttgcctgctagtgctgacaccatggtgtttgtttcacttgacgtgatcagagagcattaccagttacctgagatgctgttttgtttaccatgtggtgatttccatttcattctgcctagtatctagtccagtgttggacacatggcagaagagtaaataattgttccagaattaatgaaagattatctattggttaaagtcaccctgcaggacaggaaatagattaagtgcctttttcttttatactcatctgctattgaatttcacagtgatctattgtttgtcccaaatccatttcttgtttggcttttctactgaatgatgagaattaactttgtggaagaatgcaggtgggtgctatgagtgagcaaacaacttttgttacctctaagtcactaagcctcaaagcaattgtgtttcagagggataaaaaaacacattatttggaaagtcatgagtctaaatagaagagtaacatcaccagtaacataattctttccccgtcagtggaggttctactaatactggttatttcctagtatatctgaattatttttaaatgtatattctgtgagattcaatacagaaaaaggaaatgtcaattttcattattgtaacaactgtaccaaagggtttcttaattaatgaccaaaatacattaagatatgtacatattttatctaatcattagaagtcattttcatttctccagaaatttaacagctattaataataaatgactatggaagtacatcattaaatcttataaagaccttttttctgtacatacatcccatcacttttcttcaggtgaggtaatgaaactattgactcctttatcatattcaattaaaaagatattgattgagagagtttcatgaaagatactttttagatatttcacgatgacgtaagaagtagaaagatgagtgaaatatgatctttatgtcaagtctcatgagctcatgataagggcaagattatatatatatatatatatatatacacacacacacacacacacataaatctaatgaaatttaggattaatatgtattctcaaaacacataaaaggagatcaaagcagggaaatatgtaaaatgggagcagaaagaggccaacttcatgaaattatgagggaggccgtgaaggacacacagagatgtgttaaggggtgaatgggagaatggagagaagcgctgtagaaattgcaggaagaaggagtcatgcaagcgaagacatgcacagagggtgacattgagcccggctctatggatggggattaattcagcctgatggaaacatagattttctgtaggggactaatgagaattgacagtggaaaggttgcttggatccaaattgttcagtgcctccgacttggtaaagaggttttaagaaagttggaacatgagaaactgttttttaacatcacggaataatagaaggacactttaaagactgttttagtggaagtattcagagtatttatagattttttttgccttgttcatttagtttgatgcagctgaaatgcctcttctttacatctctgtttctccaaatcctgcctatccctcaagtccagtgcaaatgttgcccttcttcaagaagtcttctattgccccaccagactgaaggaatcactgctagagattgcagtgctggctttctgcatgtaattgcaaacatttttagtatgtcattttattttttttgtataaaatactatatatgaggataaagatctatgtaatctaaaacatgaatcgctgacattttaagggagacctagagagtactacgctgttaagaacatactgtgtatttcaaagtagttagaagagaaaacttgaaatattcacaacacagtgaaacgatactcaaggtgacagatgccccaaatactgacttgatcattatacattctatgcatacagaaatgtatgttcttttagaaagtattcctgtataattgcacaatgatcaagagggtgaagaaaatggtaaattaaagtaccatttctctgctatattatccttagtcagctcagcctcattgttcaattttccgtagtttccttttctccatgtagtttcagatgagaatctgccaagaaacattcaaggcttggaagggagaagtggagaggttagttgcagaaagattggtggatagaagcctgtcccctgagaggctcgctgttcgtgttgcaggcagcgaaaattgttggtgcccacactccatgagattgccaagatttgtcactgaccatgtgaatgactagattctagcagctatatccctcgccttactttcttagcccttccaacagtttttaaagcctctgtttctccatattgaacatttccaaactgaactacctaaagtggcttgtagcttttatttttcttaatgaaaatttgactgatacaacttctgttacaaaaactattcttaccatagttgaaggtttatctgatgagtaataccaaacatgattaatgttacgaaatggaaaaatatggtttttaatgtgagaaaaaactacaccgcattaaaatagtaaacctcagttcctgctacaagtgaaaataatttaaaaataacacttcaaggttatcatgtagactataaccccagtggggaatttagaagaaatatgtgtctcagaattaatttattatacgagtaaggagaatgagctggttacacacccactcaagtattaaaataagctcaggtggcattaattaccaagcactgccctaaaaatgtagttggaggccagaaaaagctcttatgcacttgttggtctttaatatctgggccagccaggcattgaaaggacaagatctgaaaggatataaatagagcactgacaagtcttgtgcagacaggttaaatgttttatttatctcaggattccccatatcatgcagattattcccctgttcctaggtttgttgaccattcaccaaaataaaattgtgtatcagatgggtaacttggctactagatcagggaagcacattcagctacaaattgtaggcatttcattcttatttgtgttggattactttgacttaaactgaacatgtttggtagaatgaacccctggatttaatcaggcaaaagtcttaatgtattcgttggttacacaaggtctcttgcagccttaaaaggagcaattagagtattcatttcagcatcaacttggttcaaattgcagacaaattgaagtctaatttattctataatttatcatcattatcactcacaatgtaactaggaaacttagtagtagtatttttagggtaaacatttgacccatctagaaatttcattacctatgcattgtattttctttaactgtttttaagagacaacactgcctaaaaggaaagacaactctagattgaaacaccacatctttaatgaaaacataacctcacttatttctggtacttgggaaattatgccagtgttaaagtaaagcatctgttattcctgagatcatgttgcattatttaatcaacctccaatgctttgtaaaactggtctcccagttggctgcaatgtaccgtgtattatatacaggtattaattcaaccaaaacgtgtataaaaatctgaattatgtctatctacacacacttccattggccaagaaacagaaagctaaataatgacacacacacacacacacacacacacacacacacacacacagaaagagataaataatatttatcaacattgaatataacagctcataaatcttataggtaagaaaatatttagagagctaacaaagggcacagggaaataaactggcatcaattacttctgtttgatttttttcctactttgtcagggaaatggaattgcatctaaataatggccttcccttatattttagaagcaaagttgtttacaaacctcaaacatgtaaaagctataaccagttcatttataaataatttgctgttaagataattgagatagtggcacttgcttgtgagagcattattggaaaaaatctggtagactcagcacatattcacaagtacaaattaaatactaaaacaaacaaaaagtcaacttttaaaattattaactgctcctgaaatttgccttactaaatactcacagaaaaaacaataaatatgttgggtcaatgccagaaattacaggcctactaatgaaaagaatgtaaagcttattactgttagcatagtaagaggcaaaaatggtgatgataatttaatttattttgtagccacaaaattattatataaaagattgaattaaggcattttggattgttcctttgctttagaaacttcagataagaaataactaatttaaaacaatgatatttcactaggtggtgagattttattcttgtctctatttggactagagtcccaaagtttaaaaagtaatttcctctaaattctaaaaaccattgtttgaggtctttactcttctggaacagacattttctcaggatctattaagaaatggcccaaatggtcttattatcctacagttatctatgaatatcttaacatccttgttcctagtctatacagttaaataagtattagcatattaaggggataagataaaggaatgatcaggggtacaggatttatggggaaagtatattaaaaataaaaattattagatttttctcatcatcaaaaaattaacaattgatgtacatataattttaaaaaaccttaattcttactactcgatgtttatgtaaatattctgatgacacaattatacagagcctattgctaggttccgtaaaaatataaaatgagatactcaattcatttcttagcattttgtatatataattacagtcaaataaatgttagagtggagactgatttgtattatattttaatatggtaatatttgatataaaatataaaaatacttgatataaaatatttgataaaaataatacttgatataaaatatttatgctcagattattattaaataaaaacattccaatagatatatccaaattagttttaatttaattgaagtgaattgatgatacgcatggatttacacggtgggagatataaaaacaaaacaattggtaactcccatgctagactgaaaaaaatcaagtgatttaaatgcctatcagtaggtatataattaaataaattacgataaaataattcattaaaaataaagatggatttgtactgattaaaaataataattgcaaaaatatttggttttaagacaaatttcaaaatgtactttgcttatggatgtgtgtgtgtatatacatatatatatatatatatatatgtatatacacataatatggttggaaagatcatttaaaaagttaacagtaattgcctctggagagcaattttcaggacatcagggtggcagggtttataaggagactttcctttagtctaatctctcctatgttgatttcttctaatcatgtgaacatggtttacattaattttctgaccatggattcataggtgactcaaatgattacattagctgtctttcaccaccccgcacccccatagcaactatcatgcctcaccccccgtttcacacagtccaggcacatggccacatgtgataaagaacacaaatttctcaagacaaaaatcttcctatttcttagtcacaattcaggtctgcttttaatatttaactattaattctacgtgctggagttcgcaatttacttcaacacattctctgtccggggtatacccttgggcctcagttatttgtggattagacagtagaaactttatatcaagtccttgaccaatctcttaattatttaccatgtcaaagattcttcagtgttgttgcttttattgcacccttgtggaccatttgctaaaaagcaatttgctattttggagataaattagctttattacttcctgttcatgcacattgaaaagcaccgtggactgttattttccctaactcatccctcatcctcagcatcaatgcatctattaaatctaaaggcgtttatttttcacatcataaaaaggtagagttaggttatttgtcctgactaaaaacacaaaatacttttgctaatttatcctgcagagttgctgggttttatttccatgaaattaatcatgacaaaccaacaagcaaagaatcacactgagtgcttttcagtttattgaaatacagtgttagtttattctttatgtatatggagtataagattttgagatttaatactgtactaaatttctagaaacatagaattattaaaacatttgatttttaataagagataatggatacaaatattcctcttaccttaaataactttgatgtgtttcagacccatataatgagccatttatgtacagtgtaatatcaacctgtatagtaatagcattagtaaaatacagagtgcactttcagggtacttaacaaactgcttgaattagtaaagaacgaaatcaataataatataaatgtttaattataaaaacattattgaaaataattataatgctgaaaattgtagttaaaccaaactgtttattatagactaaagtttattgtattctatttatttccttttaattcagttgtatttacttttttgtgataaatgttacattgctaagcagtagtaagtttttagtaatatcatgtcagtcatttcaaatacttttttttttactttgttaaaataaagctgactaattggtattgtcacactcattgggaaaacacacacaaagacacacacatacaaactgaggttcagagaagttaaatgatttgtataagataacagcaagtaactggaatctagtagtctccccttatcagcagttttgctttctgtggttgtagttacctgtggttacttgtggtctgaaaataggtgaatacaatacaagtaggtattttgagagacagaccacattcgtgtaacttttattacagtatcttgttataattgttctagttttattgtcagttattgttgacttcttactgtacctaacttataaattaaactttatcataggaagaacatatgtataggaagaaacatagtaatatagaaggtttggtgcatccatggtttcaggtatcccctgggggacttggaaggtataccctgcgaataagtggggatactgtatctgaaatacaaactaagatttgtctgattatacaaaccatcttaaaattgtcttacaatttagtgctaaaatgtaataatgtacaaatatgtacatgtaatctaatgtagctaaatatgttaattgaaataaaattatatactgtaaatgttcatagtaattatcattaaatttgtaataatgcaagtatctttatagcttttctcaactgaactgcaactagagttctgtgattatgcttagggtaaacatgtcatttttcccatttcacagctaaagtacaggggttggaacagtcagccaaggtgaggatgattttgaatgactccaaaggcccaggattacacagacagaaatctaagggttgtgtcttactagggagtcctctactcttgaaatccttttctttctttacttgtaccccaaattgatttttactctaatactgcaggcttgtggcctgaactcatggctttcaacttcacaaaattgaaagtagagaatatttaaaaattagtttcccacatatatttaacagtgttattaaccactgaatcagtagagtctagatctaaatggtatagatccagtaatttttaatgttcccattatgtatagagaaaagtctgagatgttgttttgcattgattggcattagattttcagatttgaaaagtttttggggtaaattattcagtttccatatattcagaagagttttgttgaaaccatccaaatgtccttaattacttaaggtatcttcttgggggggttacaaaaatagtcatctttgagttctgagacaaaatactgcaaaataatggatttattcattatctgaacggaaatgtaactgtttgcatgctaaaaagatacaccctctccctaagttagttcacaatttttaggcatgaaggactgtaaaagtatgagtcaggtcatggtgaaatggggaatcagctcccatttgaaacctccagaaataactctcctccaagtaagtggctacagaattcttaaaaagaggaaagaactttcagtttctcagtggccattttttattgcataataaacctgacaagaatagacttctattcctagaattgtcaatttgtcatatctgatgagcacaaagtgtcctatttttaaactgacgcatacaggccttgctcctgctatgcctgcattgtatagtaatggcatatttagaaatactgtacaatagaaatatttctgctaattttcagatctaaaaaggagacatttctcacatgtctaataaagagcaaggctctactgaatattagtcagaaaaatttgcccagtatcattggatattgcgatacatatttatcaagcagcttctacaagcaagatcatctaccaggtacttcatactgaaaggtgacataagacaaaataaatatttatcaagcagcttctacaagcaagatcatctaccaggtacttcatactgaaaggtggcataagacaaaacaacaacagtaaaacacccagaaaagtaaaccatttaatagagatataccctcggtgctataaagccacaaaagaaaagcccattgctttctcctgatcaggaaaagtgcagcaatattagggtttatgtttgtttgtttgtttaaggtttcacataagatgtgtagagcttttgaaatactgtgagaaaacatgggcaaagtgagctaggcaagaagcatctaaaatgcacataggcctggaaggagcatgacccacatgggagacaagaatttcaggagagagtacaggacacgtgtgccagcgggctgcagatcaggtcgaagagaaacgtgaggtccagatacagcaaaagtttaatactgcttgagaggttagcatacactttgtctcattccaaagcaataaagagtgttaagtaaggaagagatcctcgggtttgtgtttagaaaagttaggcagtaatatgcaggatgtattggaagtggacttgggagattaaaagcaagaaaatagtgttagaaagtagtttgcatggttgaagaaaaagttgtaagggctaaattcaaaacctgattaacgtctacacttcatgggtatttaaagataaatgtgtacaactttaaatgggataaaataaccagagaagaagagggaacagtgatgaaagtcaagggatgagggagatttaaggaaatacagtgttcaccagtgcacatattactaacaagtcaaattagatgaaagtggacaggctttattggatttagaaattctgaaggtgtttgattattgctggcaaaatttcgggggaaaggtagagagggaagactgactgcagtgggcacgaacggtgtctgaaggttgtttctatgaataagatatactaaaatatttacttgtattttaatcttggccctgatacttagtacttgattctgtctatttaaatggaaatatggttgaattagactatgctaatgttcctgttagtctctcttagtctaatctatacactactcctcagataagcatctgaaagcaccctccctctgtcaaacaccttacatttgtgaatgtattcctaaggattaggaactctgcccagtctcttctctgtcactccactttgtactttccacagtcagtattgggcaagaacggagatggattggaacagaagtaggcaagatgacagctctcctggtgaaaggtgacccgtgtcatcaatgtccctccacccatagcacctgtttgttccaccctattgtctagcaagagacagatatggaactctcaccggtgtaattaacgtaaggtttgctcattgcaatgaaaataggaaatagataaatagaagacaaaatatatactaatatctgtatacatttgtggggaataaagaaggaatgcttctcacaccattaatgtttattcctggacagaagtggaaatggtgtgggtttgactagaaagagaagtcttttacttttcacttgctataattgcttttctcctttttaattttcagtatttttcaaacaaaatcttcaacatgtaggttacttatgttgatatataaatgtgaaaattacagagtgttctgaatcaaaagcatgaaaatcagcaattgcaaacttgggagatcagcacaccctcatggaaatctcagtttagctattttttgcttatgcgagtcagttaaattctttgaggcccagtttctttaagatgaggaaaatgttaacaaaatttcacagttcctttaaaattagagattacatatttttaaacagcctggacagcgtagagcaggagcttagcaaatggtagatgataaaattggaaatcctagcagaagtaataaaacaaattgagcctactacatatgactgctctactccctacctttctgcttgccaattcctgagtcgaggaaggtttttgtgttctgagtagtaacctctgcagggaatttgaatcccagggatgtggtggcatttttatttttacaaatatatttatcagctatgtgtataggtgtgaaaacaaagaggagagggagaaatgtcctttaaatgacagcatccctagggaaaatgacaagctcatggtaggtaaataaattatgtttatgtatttgtatgttcatgtcagttttgttactattttcaagctggcatttgggggttcacagctttcagtttattacagtcactttatttataaaagtataaaacccaggaaaaaatttcccaagtggtgcactaaaccagtactctgaagcaagaaaaagcttttgtctgctttctttgactatttgcaatggaaaatgaatttgaaaaaagaattagaagcctttttacatggataaaatttaattaaaatttatttttagtctcttgaatatgcttcattcttaaaaaaggactgaagtagaaaactatataactaggaaagcatttttttttaatgttctgtaaattcctgacctaggaaaatagatacccatatgcatataccaatggacacttcataaatcatctaagaacaaaaaagaatgggaattctacttttatctttaactatttttacattttcagtactatagttatatgggggagattgggtggcctagccaaataattacccaatgaaagtgaaaaagcatcttccctaatatatgccaagatatttagacatagtttgacatgagcatagaggaaagttgttaatcaaatgagttctttttttttttctttttttttgttgttgttgtttgcaatttgctcttcagatccactttccacccttttctgttctggcctatcagtgttctaggaggctgggtctttgtcctgtaccaatgacctttcttttccttttcctccaggttttatttgggttgatgctatcagtgacaggagtagaagattgaagggcaaaagaaatgtaggattagaatattagttccctggtgtcctccagaccaagtcactgttagttgcctgtgttcttctactaaaggccaaaacttgatcaggcaactcttcatgtagctgtattttccagcatagtaacctgttaggttaaaaagtaaatgactcagctgggcgcggtggctcatacctgtaatctcagcactttgggaggccaaggtggggggatggacgagatcaggagatcaggacgatcctggccaacatggtgaaacccgtctctactaaaaatacaaaaattagctgggcatggcggcacatgcctgtaatcccagctattggggaggctgaggcaggagaatcacttgagcccaggaggcagaggttgcagtgagcgaagatcatgccactgcactccagcctggtgacagagctaactttgtctcaaaaaaaaaaaaaaaaaaaaaaaaaaaaaaagtaaatgactctgtattgcagaataggcactgtcactttgatggtttcctatattctagtatctctttggcaaagtgtcctattatttaatgataataatcattaaaatgtaattgttttctaccttaccctgtccaaattctgagacagtttatagtagcaaaattttagaaacaacttaaaccattagctatgagtaaagtatgctaagcctcataaataatatatagccatatagaataccttatagcatataaatgaataaagtagatgtacacagatcaacatggatgaatcacaatgtcatgatatcaaaggaaaaaaattagcgttgtatatagcataatacttgtataaattgaataaacataagcaaacacatcacatggcaatcatgtacatgtatacatagagggtgaattgggagaactcacatccagctcatcttggagaatttcaggtggttgatgaagactgtgccaattactaaaaaataaagttacatataggggttactgaaaaataattttaaaaatcagtatttttttaagtagtaggaaatgggcatttctcatattctttttagtttgtttttaaacttctcacgttttttgagtatattcacataatgtcaaaaatagaaaaggtgctcaaaaatatataactatttattttactttaaaattaactattatatcagtcttgcctttacatttcctatttgtctctacttattacttatatataatattatctacatattattttatacatattcaaaagactccattttatattcatagctctggttttaatcctcctgtgtctctgagccagcctttcagcatttcctctctttagcctagccttcatgttaagtgttaagagggctcttgtaggttgtttttatttttggtttatagtcatgcatctcataatgatgtttcagtcaatggtggaccacatatgtaacagtggtcccttaagattattgtatttgtttttacactgctgataaagacatacctgaaactgagaaacaaacaaaggtttaattggacttacagttccacgtaccttgtgaggcctcagaatcttggcgggaggtgaaaggttctttgtacatggtggtggcaagagaaaatgaggaagcaaaagcagaaatccctaataaacccactgaatctcatgagacttactatcatgagactagcacgggaaagaccagcccccatgattcatttgacctcccactgggtcccttccacaacatgtgggaattctgggagataaaattcaagttgagatttgaatggggacacagccaaaccatatcattctgccctgacccctccaaacctcatgtccttgcgtttcaaaaccagtcatgccttctcaacagtcccccaaactctcgactcatttgggcattaacccaaaagtccaaagtccaaagtctcatctgagtcaagtctcatcttaactcttctgcctatgagcctgtaaaatcaaaagcaaactagttacttcctagatacaatggtggtacaggcaattgggtaaatataaccattcccaacgggagaaatcggctaaaacaaaggggttttcagggtccatgcaagtccaaaatccagcagggcagtccaattttaaagctccaaaatgatctcctttgactccatatctcatacccaggttacactgatgtaagagatgggttcccatgatcttggccctgtggctttccagggtacagcctccctcccagctgctttcacgggctgcgtttgagtgtctgtggcttttccaggtgcatggtgcaagccatcagtggatctactgttctggggtctggaagatggtggccctcttctcacaactctactaggcagtgccccagtagggactttgtgaaggggctccaaccccacatttccatctgtactgccctagaagagattctcgtgaggtccctgtccctgcagcaaacttttgcctgtgcatccaagagtttccatatatcttctgaaatctaggcaaaggttcccaaacctcaattcttgacttctgtgtaccttcaggctcaagaccacgtggacactgccaaggcttggggcttccaccctctgaagccacagcctgagctgtacattggccttttcagccacacctggagtggctgggacacagagcaccaagtcccttggctgcacacaacacagagaccctgggcctggcccatgaaaccactttttcctcctgggcctctgggcctgtggtgtgaggaatggccgtgaagctctctgacatggcctggagatattttccccatagtcttgaggatgaacattaggctgcttggtacttatgcaaatttttgcagccagcttaaatttcttcccagaaaatgggtttttattttctattgcatagtcaggctgcaaattttccaaacttgtatgctctgcttcccttataaaacaatgtatttaacagcacccaagtcacctttatgtttttttttttttttttttttttgagacggagttttatcttgcttcccaggctggagtgcaatggtgcaatctcggctcactgaggcctctgcctcctgggttcaagcgattcccctgcctcagcctcccaagtagctgagattacaggcatgagccactacgcccagctaattttttgtatttagtggagatgaggtttcaccatgttggtcaggctggtctgaaacaccagacctcaggtgatccacccacctcagcctcccaaagtgctgggattaccggtgtgagccaccacgtcagtcccaagtcagcttttgaatgctttgttgcttagaaatttcttctgccagataccctaaatcatctctctcaagttcaaagttccacaaatctctagggcagggacaaaatgccgccagtctctttgctaaaatgttaccaagattcacctctgcttcagctcccaggaagtttctcatctccatctgagaccacctcagcctcgattttattgttcatattactatcagcattttggacaaagccactcaacaagtctctaagaagttccaaactctcccacattttcctgtcttctgagccctccaaactgttcccagttctgcctgtcacccatttccaaaattgcttccatgtttttgggtatcttttcagcaaggcccctctctactggtaccgatacactgtattagtttgttttcaccctgctgataaattcatatacaaaactgggaaacaaaaatttaattggacttatagttccatatgcctggcaaggcctctgaattatggtgggaggcaaaagagaaaatgaggaagaagcaaaagcggaaacccctgataaacccatcagatctcatgtgacttattcactaccatgagaatagcaagggaaagaccagcccccatgattcaattacctcctgctgggtcccttcctcaacgcttgggaattctgggagataaaattccaattgagatttgaatggggacacagccaaatcatgtcaattataatactatatttttagtgtacttttctatgttttaattaccattgtgttataattgcctacagtattctacacagtaatgcacatgctgtccaggtctttagcctagaagcaataggctataccatacctatagtctaagtatgtagtaagctgtactacctaggtttgtgtaagtatactctgatatttgcacaataaaattgcctgacagcacatttctcagaatgtatcccccttgttaagcaatgcatgaatgtatttttaagatgcagtgtcagctatttctgtaaaaacacaactcttgttctcaaagatttggtctctttttcatacctaccttgatgttcctgtaattgtttgcctagtcagactaacatctcactgatgaccatcagttgatgcttaaacatacttttgtaacttaattattggaggagacatgaaatgtaatgagttaagatttgaagtaagtacacttaaggaggttaaaaattgggagggggcaaagttgggagaaacagatggctgtgaagagcttgatcggataatctttttccaacaaattgagatttaaactatcaggtgtagccattacacttgaaataatccagctattgggatttcttaaaaggagatgcagacaaagtctgcacactgaattatcagaagaaatactgagtggaacaaaagggccaagaactacctgaacagtgaggatcaactttgataataataatgaaacaataggaaaagcaacctggaaaagtttataatacctcaattctagttactaaactgtgaattggttccaatcctcctcccggcctggttctcaaagggaacaggtagaagttctcacctctgtatgggactgaagacagagggatttaaaggaggagacgtaggagggcatgtcctggaagttcacgggtggagaaatggcaagccaccccatcttaggaagtagaaatgtgtagtgaaccggaaattcctacatcattatctggaatctggcctatgaaagagatgtcggctaatggggatttctggagtcagtgccattattgtcaaagtcccagccatcacaggatccatagtattccattaatatttaagcaggagaggtggaaccaaacctcaacttaaacctgggcagatctgatctcatggtcagcttagcttccctccctttgcctatctcccaacttttccaaccctgctcaatcctgctattaaatacataatagcaacaatagctaacattatttgtttgccataacttccagtatttgagagcgttacttcttcctcatcccacctctttggttcagttgagggttgccaggactgtaccctagctcccctaaaagcagggaagcatgtgacctcctccctttggatatgataattgggccaaagattgagatgaaacccacattagatcttcaagcatccttttctgggatttttctaagtgtagctgatagggaagatttcattctacttaagagaatgaaagagtgccagtcttgagtagcctctggtcatgttccctgctgtgctgaaaaattccatttgatgtgttatgtaataggagaaaatggcatgaatacagaaaaacaagattcagagagaaattgagagtcctgagaatatccaggtttcttgtttgattgtcactgattctacagtggtattctgtcatttggttttatgaagtaaaaaacctccctgtttttgaaatttttaattcttaatatctttcaagttggatctctgtcatttgtaatagaaattttcttataaacactccatatgtgcgaaatgctgaattaagctttttttattgatctttttcattgtttactttgtattttgtcattagttgacacatagtaattgtacatatttacagggtacagtgtgatgttttgatacatttatacatcgtgtaatgaacaattcaggtaattagcatatctgtcacctcaaatacttggcatttcttttggtaagaactttcaaagtctgctagctattttgaaatatgctttatttttaactgtagtcacgctactgtacagaacaccaaaacttattcctcctgtctaactataactttgtacacattgaccaacctttctccatcctcttctcccctctaccctctcagcctctggtaaccactgctctactctgcctctgtgagatcaactttctagattccacttatgaatgacagtatgaggtattagccctgtgcttgacttatttcacttaccataatgtcctctaggttcatccatgttgttgcaaatgacaggttttattctttttcatggctaaatcgtattccattgtgtatgtataccatgttttttcacccatttacctgattgatatatatttaggtctattctgtatcaacctattggctattgtgaatagtacagcaataacacaggaatacagatatctctgtggaacactgattttatttcctttggatatataaggttttaaaaatggattatctcatacaaaacttagaaatactcctatgggagtattttatgcaaccaaaacaaggatgtgcaaaatctcaataatggggaactagaaaagtcttgaatatgtgtgtgtaggtgttggtatgtctctgtaaaaatgtaggtgtatacgaatatttgattctttatataatacacatgcacagaggtaatctgaatatagatacataatgaggcaataccttgtgattaagagaatggatatgtagctgtattacctcagacattatacattctgtttcgagcatttgtaattccagcaatgtattattctggaaactcttctactacttggtatttcaatttttatatctataaataaggatgataactatacttatctcataggtttgttgagtattatatgagtgaatgtacatatattatttagaacaataaattgcaatgcataaaacaaggaatagagattgccaagacatattaatgttgttaatattaacaataattataataatagctaccactggctgggctcttactgttattccacatatattctaagcacagctggtatactttctgactgtgagccacacaaaccctacatagatgggaaccctatggtccttctaatggaatggaattgagtttctccagtaacatatatttagaaaaaaatgaaataatgtttcctatgtttaaattcttatatttcaaaataattttaattaaaaatgtaaaagaactatattaactttttgaaacaatatatgtggctttaacaaatttcagtaatttaaaaatataaacaattttttcagtatgccagaaatacatgtcccatgcaaagcccatattctatatgcacacatgataattttacccttaaaatattttgaattaaatatgtaagaatttctatatacaaaaacataaagcttcacatataaagctacttacaccttcatgtgttagcctctaaacatatgcccatatgcccactgaacttgtaaatatcatttccaaaaaagactgtctctagcgtagaaagaggaaatttgacccatgtcttggagaggagtcaaatcagaaactcctcctattacgtctttttcctttgctcgttttgctttgagttccagttgagcactttgaacacatatgtgaagaaggaaaactgctacctcacaattggcaaggtcttagtttcttttttaatgttgcctttggattgtactgtccttgaaatgtggaagaattgaggaagcaaacagtagaaccatatttagctctatatcacttcataactaataatttagaaatgaatctcaagtcaaataattaattcttcctatctataggatttcaaatgggcaaaacgatgttctcaccattagaattctgacgtttaaaattttttcacagattcccatcaatattgtaaaaaaatccttaaaaatatgttgtaaatataagcgcaagaaatcagtcaaaattggccatttaaaacatgttttgcttgttggtcaattcaactaaatttattttggcaaattatattaaatatttactaattaagcaactgagcaaagcactacaagttattgatatatttgaacatttagcctagtagatttttgttctaatatgttgtttttattctgatactcaaagaataaacactaaaggaactatacaacaggattccttttaaaagacattttcttttaacaataaatacagctttagattcttatatgtaaaattgcacttcgtattttaaataccttccagaaactgtttccaaactttaacattaagaaacaaacaaaaagatatgaaaaaaaaaattttgaggtcaggcgtggtggcttatgcctgtaatcccagcactttgggaggctgaggcaggtgaatcacaaggtcaggagttgagaccagcctggccaatatggtgaaactccgtctctactttaaaaaaaaaagccaggcgtgatgctgggttcctgtagtcccagctgctcgggaggctgaagctggagaattgcttgaaccagggaggcagaggttagagtgagccaagattgcaccactgcactccagcctgggcaacagagcgaggctccatctcaacaaaaaaaaaaaaaaaaaaaaaaaaagattgagaaaaagcctatgaatttctgagacttaaactactctgaggatgtatatgtttgtcaataaaataattgcctaatgtatatacccagtacccagtaatgggattgctgggtcagatggtattcctgattctagatccttgaggaatcgccacactgtcttccacagtagttgaactaatcattctactataaagacatatgtacacgtatgtttattggagcactgttcacagtaacaaacacttggaaccaacccaaatgtccattaatgatagactggattaagaaaatgtggtaatatacaccatggaatactatgcagccataaaaaaggatgagttcatgtcctttgcagtgacatggatgaagctggaaaccatcattctcaggaaactaacacaggaacagaaaaccaaacaccacatgatctcactcataagtggtagttgaacaatgagaacacatcgccacagggaggggaacattgcacacttgggcctgtcggggtggggggctaggggagcgagagcattaggagaaatacctaatgtaaatgacgggttgataggtgcagcaaaccaccatgatacgtgtatagctatgtaacaaacctgcaagttttgcacatgtatcccataacttaaagtataacttaaaaaataattgcctaatatgtaatgtattccttgattggattcctgacacaataagggttaagcaatagcagagcaaaagtttactgaacaagtccaagtcactagtgcagttaatttgtttttgtggagtccatctctcagcattgatttttgatctgggcatactttgccaggagctggagttatttgcagtcgaaaacattggctctgttttgtttattttgtcgggcagctcatgtctatgtacaatcactgcctggaataaaaaatggaaaagcctgttacaagtgaagaagctggatagcaaactacataagtaccttctttctatctggaaggattacatctaccctaatatacatatgcattcaacttgttttcccttttttgctataagtcaaatatgagaaatttattctatctgcattgacactttgcttgtgtcttcagctagagaagcaaatgtttttaaggccatgcttttttctacaatctatcagaatattcaatgtaagggccaaccaaaaggtaagatggaaaaactcaaggcagtattttccacatctctgtcagaatatacaatcaatccactcacacacgtttggctgactggtcaatatgactatttagaacataaagttggcatgcacttatgtccttagaaggtgtgtcttccctaatattttgagagctctttaaggaaaaagagtgcattttatttactaatgtaattcctattaagtatattgcccattagtatatctcactgaaattgacaatatgtgtaaatgacaatatgtgataaaagactgaacaaaaatttaaaaagaacttgaagcacttcatcaatgtcaattcttaaaaaaaaaaaaaaaaaaggaaaaaaaccctagacttgctattcagatcatttgcccatattacaagtagatgattggcttttttgctactgagatgtttgtgttccttacatattctgggtattaattccctgtcagatgaatagtttgcccatattttttcccattctgtagttgtctttttactcttgtttcctttgccatgtacaagcttattagtttacattaaccccatttgtttgtttctgcttttattgtctgtgcttttgaggtcttagtcatcacatctttttcacagatcagtttcctgaagcatttcccctatgttttcttctagtagttttatagtttcaagtcttacattgaggtcttcaatccattttgagcttcagtctatttagtgcttcaatacatttggtaaagggtgtagtttcactcttcttcatttggatatccaattttccccgaactgttttttaaagagactgtactttcccccgtgaaagttcttggcacctttgtcaaaaatcagttggctacaaacgtggatttatttctggcttctcttttctgttccattggtctatgtgtttgtttttatgccagtagtatgctgttttgtttactataatcttgtagtatattttgaaatctagtagtctcatactttcagtcttgttctttttgctcagtattatttttcactattaatgatcttttgtggttccatacaaacgttaatttttttctatttttgtatagaatatcatttgtattttgatagaaattgcattgaatttgtagattgctttgcatagtatgaacattttagcaatattaattcttccagttcatgaatatgagatttctcttcatttttttgtgtgtcttctttgatttctttcatcagtttgttatactattttttttttggagggaccttttacctccatcattaaatttattccaaggcattttattttttttttgtatctatactaatggggttacttattcagctactttgttatttgtgtatagaaacactgttgattcttgtatgttgattttgtatttgcaacttgatcaaatgtatttatcagttcccaaaggtttttcttagggtttttaggtttttctatatataagatcacatggtctacacagataatttaacttcctctttccctatttggatgttccttcttgctttctggtttcctcattcagtatgatgttacctgtgggtttaccacagatagcctttattgtgttgaggtactttccttctttgcctaacttgtcgagtgattttatcatgaaagaatattgaattttagtaaatgctgtttctgcatctattgaaattattacgtggtttttggcttttattctgttgatggtgatgtatcatgtttattgatttgcatatcatgaactagccttgcattcctgggataaataaatcccacttgatcatggttttggccaataaatttgtaaaaaatgttcagcattactaatgatcaggtaaatgcaaatgaaaaccacaataagctgtcatctcacccaagttacaatgactattatcaaaaaggcaatacataacaaatgctgggaaagatgtggagaaaagggaactcttgtatgctgttggtaggaatgtaaaccagtgcagtcactatggagaacagtatggaggttccttaaagaactaaaaatagcactaccatatgattcattaatcctactactggatatttatccaaaagaagtaagtatgtcaaagagatattctcaccctacgtttattgcagcactattcacaatagccaaaatatggaatcaacccaaatgtccaagaggaaacgaataaagagaatgtggtatatatttacaatggaatactatgtggctattaaaaagaataaaaccccatcatttctggtaacatgaatgagctagaggatattatgctaagtaaaataagtcaggaagaggaaattaaacactgcatgtcccactcatatgcagaaaaagttaaattcacagaagtaaagactggaaccgagaattctagaagttgagaatggtaggaagaagcagggagggggatagggagaaatttgttaaaggatacacaactacagctagattggaggaataagttatagtattctataacactatggcataactatagtcaagaaaataccaaatattttcaataagagaagatattgaaagttcccaataaacaaaaaatgataaatatttgagaatcttgatatgctagttgtgctaattactatacattttatgtatcaaaacatcactgtatgccccataaatagaaacaattattgtgaatttaaaaataaataatattgaaaaatagtcttgctaattacaaattatttcgcatgtttatatagaagtatctcccaaattacttctattaatttaaacttagtaaaatactctggatttatttattcaaccatttagttttatcctgatcaaaatgagtcagaatcccactgaaattctgaaacaagagaaacatcaataaggtagaattgtcattaggagaaaattcagaatttattggctatcataaagatgaaaatgtcaatgttgcaactttattttccctggaataaatctcaggtattttactgacacaaatgggcacagaagtctttgaataatgagcagatactgaaagaaaatattttttggtgacctgcagaacttccaaaaccacagtatgtgttgtaaagttactttgggttgaatatgaagacctacaatatagtaagatatttattgcttaaaagataaaaaatgaagaaagcaaaattatctggagagaaatttcatttgtttaagaagggggctcactgaagaaggaaatttttagtgaaacattaagtttttttcctacagagcaaatagttttttgaagaaaacagtctggagacttgattcatttggctctgtttactcaaggttatctgaagtattgccaatactttatgttggttacttgattacaaaaattgtttgtattttcaacctttttataaatgagtctttacagcaaacctataccacttctcattcccacaggaatgattcttggaatacctatatgtatgtcaggatcctctctcacatcaataagagttgtaatctacctgaaatgtgttatttttccatgcatttggagcatgcaaaagacataaaaagagtatttttttctgaactgttgagctatatgccaatctaaaaaatgaaagctacttctgtaataaattttttggtatggaacattattactcaagttgaatcttaatattacagagtcacaagagaattgtaaaaactgtgatctcaatgaattaatttatagtgagaaatataactatcaagtaggctactcatgttcggagtcagtgttttctttcctcatcagcaaatctaatggggagtcagatattattcagaaagtgttttggtaggcatgaactctaagcaagtggagttagttcattcacctgaacagatgattataaagctatgataacataaataacgcatcagtctctattatactaatcatctctgctacatgagtaagacccaggcttttgtgggataggctactctcagccagatagcaccataagaacattactgattttttttaaaacatagatgttacataaactactttcatttttgttctttccttagacaaaaagcaaggcaacttcctgtgataaaagttttcttagttaaaaggaacaacattcagttgctcttctctaatactcatctctctttagctgaattttggaagtacactggcaatctcttgtgtgatccttctactacaaatgaaataatactcagtagtagttcaacattccaattatgactttttcattgtaattatttttaaactgatatctgaaattgtacacatttatggggtacatggtgatgctttgatacataagctaaatgccctaattattatatattgtatctgtaatctcaaatatttagcaatttgggcaattaggcccaaaacacagttcaataatgttcttatctatgtctttccacttaaggatttaaagaaaccaagtttctaccttcagaaaagatgttaaatgagaagaataagagaaattgtctcatcgtttctaatttattctcaatatatgctccaacttagaagttatttgttatttaacatgcacaatcaagatgggactctgtcctttttagaaaaggaaagttgcttagcataaaatgcaagatacaggtgaataatttgaggacatatatcacagctcatgtagcctgaaatttgaaaaagggaaacagttatgttaaaacagaaatcccacaaacaatcatcaaaaatttagtaaaattgataacatagtatcttagatcattctattaaatgtttattgcatgtggcaattggagagtgcagaaaggggaaagaagttaaaatataagcagatgagaaaaggttaaaaaaaaattctaaaggaacaatatcttccctaaaagcaattcatcctagaaaatgatagaaattctaatctgtgggtaggcaatttgatccaaagcacatttaaatgtaatatcattgaacaagctctcttcatgcccctagtaagaatcgaagtgacagatataaagtgttttagctattagactttcatgaatcatactccaaattgtaaaatattttgttttatttttatcaaatctgtgtttcatctaggagaacagactggtttaaaaaacccatctagttaaaataaaatgaagtgttatataaattaaaatcaagtcacttccctaatatgcttttatcagcacttactttttaaccctatcaacggcctcaggattatatgtaaactttctttaacatgaaaatcaactataaaattaaaaatcctcatctcaagatatccttttgttttttacttacccatatgactgagacaataactgaataagaattacagaaaatggataagatttcatataaagatttgaaaaaaaagttctgcgttagaaaggaatgaaatttactgactacattagttttctactgctgcataacacgttgccacaaacttggcagcacaaacaccacaaatgcattatctcaaagtttctgtggttcagaatctccagcgtggattaaggatctcctctgttgagcatctcacaagactaaaatcaagatgttgtctggggctgcagtcttatctctcatctgaaggtcttccaaggtgatttaggttgttggaagaattcagtttactgaggttaagactgaagtcttcattgtcttgctacctgtcagccagagtgactttcacctcctagaagctgtcctcaggccttagtcatatagccccctctcacaacatgactgcttacttcttcagtgccagcagggcaatctatcttcagttggttataatagcatcttacataacataaaataatgacaccatcatctatactatctataccatcatctttgtcatataaagtaacctaatcaagagagtgactgttctatatgattcagaggttctcccaacatttaaaaggaacgctttataagagctgtgtccaccggaaagcggtattacgaagtacatctcacgatcctgtcaaccagagtgatttatttgaatcttacaaggctgtagtcactatcccaattataaattttgaaagctctgaaaatcaaaaccttgtctaacttatttggtgaaaaattttgatcagaacttacacataatttatataacttagtccattttgtacaactatttaagtttgcagtcgaaatactaacatgcttcagaatgaagtacattatgtatacactattatataatcattattttgtgtgttattaaacaactcactgaaggtgttcagtaatatactgaatatgtgcagcaaagtagtacctttctaaagtctaaacaatctctaaccctgaaacacatctgcccccaagggtttcagataagaaattttgggccaaatttattaaagttctttaaaaaggagttcattgagaaagggtttatttcaagaatatataaaccttggggtaagctcaacatttgctgatttaaatgaccttcaaaaggataaggatgaggaaagacaaagaaaaaacaattgtttatacatcaaatctgaattcactggtttcaattttattggtgacaactttgaaaaatagggcaataatgacagggagatccatattaaatacaaggtaagggaaaatatttattttactaatttgttcaagttactaaatgagtgaactcatagacagattggatttgtactactaaactgtagtacaaagaattgtctctttcattttcccaaaatgcatggtacatttagggcaagacatttttttataagcttgtttatctcatctttttccccataagcacagtatctggctcttggggcaaaacctgtttcacttaacagccaatttatccatccagatttgagtcaactaataaaaattttacatgttcatagctcccccgtctcagatttcaaccttaaatcagtaagtagttctatttattgaagaattaccatatttaaagaaagtgtgtatcttggtgacaatagctaggaaaacggaagtcctcaatccgtgtctatcaatactaaatgtaaaatgtgaggggggaaaatgcttataggcaagaaagaaatgtaaattggtctgtcaccaaagtccctctcctttgaaatgtcttataatttacatgtaatatatgtgaatttacaagcagcactataacttgcactttgaaagcaatgcttgagttaattaaatgagctcctaggagagcatggatttctcatcagatctttgctatagtcaggtttgagaatttaattgaggatattcgcttcttcataatgaacagagtaattttatagaattttttttaatgatttctacaatggattgttaggcagcttctaaactgtaagttaaaatgatatatccctctttgtctaaatactgccaaagcagtcagtcaaggcagttcaactgctgttatttctattaaaaaaaaaatccatcaagttgtttaagtacaaaacaaaatcaaaaaagccgttaatgaatatttttacccttcagtgatgataaatattttattagaatgcaaacaagcagtgaaagcacaaaaggaaatttatcagaactgagtctttgcttgaattttgagtgattactaggtatgttttcaaacagcactgcctgaacatagcttttaagtttttcaaattaaaatagcagatgtccacagtagctgtgtgtattagaattgtttaatttatggagctaaaatatatggtaggccaaatctaaacagtgttagaattttgagattggtagcctcctcttcctatggaaggagcttgctaaggggtgtatcagcttcttaaataggccattggcattcttagaggtttagcgtggatgggattaggcaaaggtggagttcaatttggaggttctgataatgcaaaagaggcaagagaggatggctgtggaacagggggtagtatgggaccaatggatatgaaatggtccttcagaaatcacattaaaaatgatgtaggtttcaatcaaatcagattttctgatctacatctactggtgaagttactgagttgggtgagaaagaatgaagacctgagttgttgttaaattaaattgcttattatgtaagcaattgcctgcctaaaatgatgtcccttaagtgcttaaaaggtctgaacattaattgcattttctataatgctcgtttagactaaaacaaattaaatcaattaaacaaatcttagaagatgtattgtgtaaaaatcccaagtcttttttagtagaccttaaataaaagttttgtaaacataatagatttgttgcctgatgtacacagcaagtcagtgtgttgagaaactaggttgcagcagaaaaaaaggtttaatcttagtgtccctgaatgaggagatgggaggacacatcaactctatctcaacttatatgggtttagagtttataagggttttggaatgggctgcagtgtgaagatctctgattggtggaagagtgctgcgtgaagtcatgggccagggagatgaagaagctgtattctcatgcagatcccattcctctgtgggggtcttcaaactggtaggtagaatttggggtcttcaaaaaatcttaagtggtccttaagtaaaatccttgtgattctaatgtcagaggtcctgtctgaagggacaatgagtatcaaatcaattattaaacagtcttacaagcctaatgtcagaaatcctatctataggaacaatgtggatgtgaacagtatctagtgctacaagactctcggcaagaagaagtggtccaaagtacagcctgactaatactaagttatgattatatttctgtccagaacttggcaaacgattcttgtcaactgcatgaggacaattccagttctatagcttaaaagttagatatgcagactgggagacttcttcagaaaaatctcttgcatgcttccttcaggctagttgtctgtcccctcaaggtcctaggtccatagtcttttcataaaggtcagaatctctttggaagcaaacagttgcagtgtcagtaaattactcccttgaactgatcttggggactgtgggattaatttggctttgaacacggaatactgaaaatagaagcatcagtctttatttatccagtttctgtataataaattccattgctgctttatccattttatatacatacatacacctatacacacacatagatgtatatacgcacacacatatcacacacatacacacataggtaatgaggtagtagtagaataaagaggtaggatgtaaagacaggaataaatttatccatgactccaaataaatgtgtgaacttttaatattccatttagctattcagaggctccacaataatacacgcataaaatacaaatatatacacacacgtgtatatacacacatatatatacacatatatgcatgtgtgtatatatatgtgtttctgtattgtagcacctctgaatacaggtatgtgtgtatgtgtgtatataggtataagtgtgtgtacatatgtgtaagtgtgtgtgttattgtggagcctctgaagagctaaatggagtattaaaagcccacaaatttatttgcagtcatagataaattaattcctgtctttacatcctacctctttaacctcttcatttaaaaatgaattgtaaggtatgaaaaagagatagattaaaacaagtgtgtcctaataagcttttggcatattaatttgcattttattgctactctttctccctccaccttcttaatttcaaagagatagctagacctttcatattttttttccctcaggaaattttccagatcacaaagtagaaactgttggaaaacaaagctttctcctgtccaaaaacttaagttcatagaaatgatgatgcaaagcgccaggcgtaagaggaaagaaagctaaatgcctgccctttaaggcaacacttgagaagggcaaaatttctggaaaatggaagaaagatagtttagtaagtttctagactgtcctggacccatgcactagttaatggaccttaagagtgggctgataaaatcttagaggtgacagttgtgcaaggtacccaggaagctggcacatttgcccagagatgccagtctcagcaaagatgcctgcactccactagagacatggaagactggaagccaagagcaacaaggctgcaaaacaccaggaaaacaggagatcagcaaatgaccacagtggactggatagcaaaggcccttcctttcattatcaggcagcttataagcctctctgactctgttcagggcctccaaaatacccaccagaacgtatttctttagaaaattgtctgtagaaaacccctgtagaagtacaggagttcagtatctaatttaacccagacattttgaaaaaaaaaaatgtgtttcttgcatagttaagtttgtggaccaaaaagtatgttgcctggaaaaaatgtcaaagttcaaaagagaagagttccctctgtcccagtgcccaacaaaaaataagaaaaaaaaaaaagagaaaaaaaataaatctaagtacagatagcttaatgaaaaaatcgcaaacctccaacaaaatctatacagaaagcctcactgaactgttgtaaattacaaaaaacattcctaaccatctacttagcaccttactggagctcggcatgttaaagggaaagtctttccagaagtgtttgaaaaacatcaacatcacaaaaagcacataatggatatatagaatagtacaacaaatgtataaaataaatatacctgcatctattttgggaatttgggggtttgggggtttccatatccaattccatatggtctaaggaccggaagtacacattgggcagggctgcctaatactcttgaaacagtctccatggtatccttgattgctgtacacggtgacacaaattccttgtatatcactgtaacctgcaaaagggattcactcaactgattattactacccagtaatgacaatttatttaaaaaaatattttaaacatttttgtgtgtttcataggaaggtttcgcttttgtttgtttttttaaaaacctgagtcttttaaaaagagacctgagtagtttttaggtacttgacaagttgcatagtcctgctgtcaattatgacgtattataatgaatggtaacacaaatgaaacatctgtttgatcattcagtgactacatctgttatgtcacatttgacacattgagcaggagaacataaaaaattcaaggaaaatttgtaaatgtgagtgctagatcattgattttgaaggatgagatgtgttaagattactagacccattcagaatttattataaaagcactaaccctgtaaattggccttctttcaccactgaggcccactctaatggatactatgtttgtaaatgcaattatatgcttttaaaacaaagtttaaatataagttcttaaaatttatattttattaatttaaatatttatgaatctttaagttgtatcaaacacctttttaggtgctaggatgtagctgtgaacaaaacacctcttgtggagtttacattctaaaacaagagtgtgcaaacacaaaagcaaaacaaaaaaaaattactcaggttgcaacaagtaatctgaaaagcagagcaaggtaagtggataacagctagtgtgccaatttatgcagggtgtttagagtatatgattctgttcattatctactgcaaaacttttaaataattgataatacaaaatgaaatcaaatcccctctaattcagaacaagtgaatagagtcagagctaaaagtctgatttgaaaggagaaatgcttcgtgtaggctgtctggagaatataaaattagaactaaaattttatattccagttttttcttaatatctcaggcaatgtctgataatttcagcaagctctccaatctacagagtatatagtaaatatttactcttgcatcacatttaacaattaggaatttagacagttagcttatttactgcttccgaaaataaatgtaaccagtgggcctagcgcagaggctcatgcctgtaatcccagcactttgggaggctgagacaggtggatcacctgaggtcaggggtttgagaacagcctgacaaacatagtgaaattctgtctctactaaaaaaaaaatatatatatatatataaaattagccaggcgcggtggcacatgcctgtaatcccagctactagggaggctgaggcaggagaattgcttgaacccaggaggtggaggatgcagtgggccaagatggcaccattgcactccagactgggcaacaggagtgaaactctgtctcaaaaaaaaaaaaaaaaagaaaaagaaaaatataatgagtgccattgccctgtctagaaccctcttcctttaggatcaatctcctacacaacatttacagggctgcagcacaaacatcattttatattgtgcctccaacccctgccacagttgatttacttggagatgggcacctcacccaagctggtcaaagacacttactcatgggctttggagggttgggaatgaaagatacatgatcatttactctttaaaataaaagttgtaaataccaagctggcagcagccatatcctgttaggtgaggacctctgagaagcagagaaagtcagactttctgaatgagtaataaaagaaaaagggaaaaaaattatgaaaggaagagaatcataagatgtggagagatccaatggcatttgtattccaggctctagttgttcctgagagcaggttttctatctttggataccataagatatataagtaaacataacaaattttatgtttaagctagtttgttttaggttttggtaactgtaaaccgtgttttaattaatataaatacactgcgtatcaatatactagtcttagttcttcagaaaaacagaacaaattgggtgtgtatatgtatatagacagatttattataaggaattggctcagaggattctaggagctggtaagtccaaaatctgtggagtaggctggcaggctagagacctagggaaaagttgatgttgcagctcaagcccaaaggcagtctggaagtagaattctcccttcctctggaaacctcagtcttttttatcttaaggccctcatagactggaggagacccacccaatcattatggagaataatctgcttcagtcaaagtctatggatcctaatgttaatctcttctaaaagataccttcagagaaatgtaatgacatatttgaccaaatttgtgggtaccatggattagccaagttggcgtgtaaaattatcttaaccaaatctagtaattatttaactttgctgttattgattgaaacaagaaaattatgagccacacatgtgggcagctgaccttttagaaaggtgcaaaggcaactgagcagaggaaagataatcttttcaacaaattttactggaacaaattggttaccagtatgcagaaatatgaacattgatccatccttcattttatatagaaaatttcacccataatatattatatagctatatataaaacctgaatctataaagttctggatgaaaaaatacaagaaaatctaggtgaccttgtgttactcaaagaattcttggatctcaaaataatcttcataagtgaaaaaaattatttaattcattctgtttgcttatatgtatgtaaaccttagaaagtacaagctaatttatagtgacagaaagcaaaatgttggttgcctaatgattttgtgaagtggggccaaggaagattacaaattggcctgaggaaagttttagggttgatgaatatgttcatcctctatattgtggtgatggtttcacaggtgtatctatatgtcaaaactcagaaaattatgcaacttaaatatgtgcagttttattatatgccatttacacctcaataaacctgttataaaactgacaaattatttttatagcctaaatagtaggtgatgactgcctgaattagggtagtaacaggggatcatggaaagaaagaaatggattaaggatttatgtatttttggtagagccagcatgacttgtttgaaataaagaaaataatgggataaagatggttcttacgctagaggagctgtgtaaataattgttccaatgtaacatatttattctttagaatccaaattctatgcagccgcctcagtagtagttacagtggtaagagaatctcagtgaatagaaactcttagttaatagttgtttttttcttctctacatttcaatgggtagaccttagttccttggtaaagttttctatattaatatactatataagattttatttagataattaatttcactgccaaacaggagggttgaaaatcactttactagcatctgggaaaatacattgattattcttgtattcttccttggcaaaaaatgaaaataattatatgaaaatattgatattttagtcaggatagattgatgttcattatatgtccagctcaattctaaaccatttaagtgtcttagattgtattctcataatcctataatatgggtagtattaacctcagctgataaaggatcaagatcagaaaggtcaagcacacaaatggttgggatgatacttaaattaggtctgataacaacatttatatgtgctcatctacagcacagaaaattctcctagactgaataatagaaaagtttaaactatattttctgatacatatctttgctgcaaagcagtaatgaaattaaaataagaacttagcgaagtgtcttacagagggaccttgttaatttcaaacttccttgaagttatcactaattagtataaagtgcctgtgtacagagttattacaattcatatttgtcaagaataagcaatcacttaataatgggttattttaataatcttagatccatttattatatattagattttcttttaaagttactatatgtgtatatgcatatatgtgtgtacgatgtgcatgcatttgtttgcataacaaccactatcaccaaaactgtgtccccactatgccgggtatccagcagtgtgagaatggactaatgcatatgcatttgtttgcgttcacatcatacacacatatatacatatacacatatagtaactttaaaaaatctaatataaatgtatcaaagattattaaaataaccccagttattaagtgattagttgagattggaacacataggtttcagaggtatttagaaattgcttcaaaaactaggtacaggtactccacgatacaatacttaaatgttagaagacttacttgaagagcatacgtattttcaatttatgtagaagcaagagaaaactcagtaataaaatatcatacatatagacagactatcatgagagcaatagagcaaattgattgtgtttacatggtttttttctatattcaggatgacaagtaatacctacaagtctataggaattatccaagtttttcaatatctagttcaaattgtaggtgaaaaatctgaatttacataaacattttttaataattttctactaacggggtttgcccttctgaactatatacttaaaagtgtttaaacttttactaagtactgagaatatttcaaagaaataggaaacaaagttgtttttcacaacattgttaataatgacataaaattagcagcagtgcaagtgactaataaggggggattgattaggaatatttggtatatcccatatgctacaataatcgacatccattaagcactgtgtagacaatcatattgagaaatgactgtatccaacataagatttaagaaatgtaaaacagcatggataatgttatcgaaatttcattaaaacaagctagataaaagtagtatacagaaatacatttaaaacgtaacaatggttatcaatttctgaagtgatgatagattatgctcattttcttcacattttctctttgcggtgttataataaacacgtatttatcttcaaaatttttaaaggaatagattaagaatctgatgtaataatgacagtaataaacctttaacatataagctaaaatacttcagtgtgtgtatttagcatcattatattctaattttaggagctcaagtacatttgaacactgctgtgatctggaaatttacaacttgcaatgtagtcccagagcagcaacagcagcagcatcaccagggcagtactttttagaaataaagaatctcagacgccatccagagcaactgatttagtaactgcatttttaaaaagctcctcagatgcatgtacattataatttgagaagctctgctctagaggacaaaaactctcttaagtagaaatgttgtttcctgatttttgattaaatgaacactgaatatacaatagaacatttaacaaaatattttataaaacaaaacaccagctaagttgtattatgtaagaaactcattagttcacatgagtagtactttgagtcatcttctagcagtgcaaaagacagtaagtaagatggtcttacagacaatagtctgatagaaagctgcaatgttaactctatagacaaatttaaatattttaagacttgcattaagaaaagaaataggcagagtgcagtggctcatgcctgtaatcccagcactttgggaggccgagggctggcagatcctgaggtcaggagttcgagaccagcctggccaacatggtgaaaccttgtctgtactaaaaatacaaaaaatagctgagcgtgttcatgggtgcctataatcccagctacttgggaggctgaagcagaagaatcccttgaacctgggagacagaggttgtagtgggccaagatggtgccactgcactccatcctgggtaacagagcgagactccgtctcaaaaaacaatgaaacaaaacaaaaaagaaacaaaaagacacgttaaatgaatttaatggtatatggttgatatggtttgactttgtgtccccatccgaacctcatcttgaattgtaatccacacatgccaagggagagagggaggtgattggattagggtggtttcccccatgctgttctcctgatagttttcacaagatctgatggttctataacgagctcttacccctttgctctttgctctttctctcaattgccaccgtgtaagacgtgcctgcttccccttctgccatgattctaagtttcctgaggccttcctgggcatgcaaaagtgtgagtcaattaaacctcttttctttatacttacccagtctcaggtagtatctttatagcagcgtgagaagggacaatgatacatttaggccaacacaatcaaagtattgtccttttaatagcaatcaaaaattattaatggggaattttacatttattgtacttattgttcaaactctgttgtgtatatcttaaggtcagactagccacgtttcaaatgctcaatacatggctagtgtctacagtattggaacggcgcgggtagagaccatggcttaatttgtaagttataaagtctattaagactgagccttatgtctttcagtttgtactctatcactgtgttcattatattctttggatgtgggaagacatgctttgtacaaatggctccaggagttttcaaaatctttatgaagacatgatgacattccagctacacttaataattgcattattgtttacatatgattgtgctgcccgagttcccactcagtggtccagtaacaaccacactcactaaaactgcatccccactgtgccgggtatccagcttgaatttatacaagttgtaggttgtggtgattttctttccccaccagtagagtagagagatctccaggatccagaaaaggccgtgctttaggggcaagggtgcaaggaaaacctggaccagagttttcagttctcagtaacaacattttcagtaattcttgttctagaaatacaggatatcaatggcatttttcgctatagccatcgttttgctataacattttattacattagaattataattttctctaatattagattaatttgaagaataagtatggctgcttaaggaacaaatactttgttggatcactggaactattatgctgattacaagttgaggaatttatatttagtcaatgcccaaatgtattataacttaaaataactcagagatgccacattttttccatttatataatttgaagaaatatttattactactgaaatttatgaccacatggatcttccagggtaccttattaatttttaatttattctttaatagaaaaaatgtgcacatgctaatttagctaatatggtataatgtggaatgccaaatgttgtgtctaacacagaatctttttcctggtagcactaaagctgctttatcaggacagactcatattctgtcctcaattccaagatacacaataattgaataagaatatgtaattatgtttagaaaataaaccttgaagtgatacttcattgaatatatagttcgctataagaaggatttcattttcagaagtgtaaaaatgtgaataataggaagaaaacttttattttcaaatcaagaaactatgtattaattgggaagttaacacagcagcagatgctaatttgcataacttgccttactgtattctagcaaaagaaatatgtgaaattcaaaactgaacaattttgatgtgacctggagttaagaaagttagagagcatctacatatttaaggaaaatgtctgggcatttttgaagagtagtaatcgtggaggaggagaaacgtaaccagagagcaaggcaagacatgtgaaaaaaatacacattaatgatactataggaataattgaatcttcaaacacaaattttgattttattacgggagcattgaaactacaatttttttttttttttttttttttttgagacagagccttgctctgttgctcaggctggagtgcaatggcgtgatcttggctcactgcaacctccacctcctgggttcaagcaattctccctgtctcagcctcccaagtggctgggtttacaggtgcccagcaacttgcccggctaatttttgtatttttagtagagccggggttgcacaatgttggccaggctgatctccaatttgtgacctcaagtgatcagtctgccttggtctcccagagtgctgagattacaggtgtgagccaccgcgcctggcctagagtacgatgtatcttgtaacaaaacacaatataaaacaaaatgctagtggatttttctttttgttctttaaaaatgattgttttctaatcattctcctatatggtggttgggagtaaaaacctcaccttagaagaagagcacaattatcaaattgttaactgtttttttttgtttttgtttttgtttttttgagacagagtgtcctgctttgttgcccagcctggagggcagtggcgtgatcttggctcactgcaatctccacctcccaggttcaagcagttctcctgctgcctcagcctccccattagctagaattataggtatgtgtcaccacgcccggctgatttttgtatttttagtggtgacagggcttcaccatgttggccaggctagcctcgaactcctgacctcaggtgatccgcctgcctgtgcctcccgaagtgcttggattataggcatgagccactgcggccagtcaaattcttaacttttaacttaaaaagttattttcccagtctacaacagaaagtgaattggagatgcaatggggaagaaccaatgggtttggtctcttcttgactttttagctggagagtaggctggagactgttagaaatgagcaaagagactttctccgaggttggtttggatcctgagctgtacattgcttcctttgctttcctattgcttctgcaaagggaaacatactaggtcctttttatgtctgggaaaccaagagtagattaaaaggcatcatgcttcacaaaattcatgctaccacaatagcacagagagaaggatgttgacaagctccgaaacagtcttacagagtctccatgctctttggtggagttcggagacagccgcaatggcatggatgtgtcatcagaagaattacaagccttggactgctgcataaaactaaagatacagtgtgaagacaaaagcagcagaaaccagggcatgactgggaagtggacttttttttcctatcttagcctcagctccagtcagaagggagagctgaaaaaacaaattctgaatgtgattaacattaaggttctccagggtattaagattaaaatccgttacaggaatctttattttttataattagttcagttttattttttgaaaaatacatggtttttaattgatatgtttatatctctttgaatgagtgccaagtaattctaataatagaattataatgctttaataataattagaataattattagtatcataattaaattttgtgatgctattaggatgtgacacatttagagtagtagaaaaagccaaattctctagaaattatgttgtattattttatggatttaacatattttatccttgaatcatagttgtttttttaaaccaaaggtcagtggtatgataatatttttaattgtatgaactttattttaaatattttaccatgtgtacctctcttttctctgtaattgcttacaagcattttgttttgttttcattctaaagcaattaataaattttgtaaatagcttttcagctgtttactaaaactcaccttcctgagttatgtataataaaagtaaatggcatttataagacgtgattatgtggaaattgacttttaatacaaattgcttctttatttttacacctcaatggctaatgttgatagtaaagttgtatatacaagttaaataaaattttggctctgtttattgtacccctggtaaagaagcatggtgtttgacccatagtgagtactcaataaatgtaaattgaaatcgataaatttcaaagctattaaaatacgtgtaataccatgcactcataaaaaggaatgagatcatgtcttttgctatgtcatggatgaagctggaagccatcatcctcggcaaactaacacaggaacagaaaaccaaacaccacatgttctcactcataagtgggagctgaacaatgagaacacatgggcacagggagggaacaacacacaccagggcttgttagcgggtggcgagtgaggggaaggaacttagaggatgggtcaataggtgtagcaaaccaccatggcacaggtatatctgtgtaacaaaccaccatggcacccatatacctatgtaacaaacctgcacattctgcacatgtatcctgaaacttaaagcaaaagaaaaaaaaaatcctggctttggaagttgtaattataatttctctgatattgcttaatgtaaaaattatgaatatccagtatgatagcaacaacagatcctactgtataaccaacatctttctcactgaaactgaatactgccacacgcaggattcacatagtatacttgtcatttctagttgaatgttattgccacttcagataaagttgccaagcttggcataaagaaaagggggaggtaaagggactgctagtaggacacaactaggcagtgtccacaccccagagtaccaaggtagctgtgcaagaagaatacattctattctatgatgcctcacgctgaacagagggctaattgatcacttacctcttgctgtgtggtctgattcagacagcagcaaagagggactcagtggatgtcagtcctggagtggtgattctcgtatccttcttgtctatcataagggaagaagtgctgaccagcgcccatgggaacggtaatctttgtgaacagctgtgaaaggaccacagcttaagaaactcaagggtggtactaaaaccaggaaatgtggaagaagctttgtttcctgccatgcttcaggtgggatttgaaccagaaaaaaacattatactactagttatcgctaccacatttattatactctcagacggttttcatataaccattatctgtctgggagcagtggctcatgcctgtaatcctagcactttgggaggccgaggtgcgcagatcgcttgagttgagaaattcaaaactagcctgggccacatagtggaacttgaactctacaaaaactacagaaataaaattagccgggtgtgggggcatgtgcctgtggtcctagctactcgggaagttgaggaataactatttattatcttatgagttggcattgttaaggacgaaaacacagactgaagtaagttttctcacctcattttgtgttgcatggctcaatatcaactttaaaatgctccaactggggggaaaagctgattttctatcaccacaagactacaattttgaaatatgtattttctatttcttgtgaaaattgatgcacgcgtggatatttgtgctttcttttaaacatgatttatactcttactttgtctagttttgcagagcatcttcagttctgccaacctctacatttataattttattataatagtgtgccatggcttgaaaatgtcttattggtcagtgaaggtagacatatggaggtttttacttatgctataatcaacgaaaataagacttgaatgaatcttaagatgagaaaagctataaaagattgagtcctgaaatggagatcagaaaattaattttaaaccttcattgccatctaaattattgtagtctacttatgcaacttcgagtaacctggctatttctcatttcaaactaaataggaaagcctagatgagcagttcttgactaccttttccagctattaaatatggtgtgtgtgtgtgtgtgtgtgtgtgtgtgtgtatatgtgtatacatatatacacatatatttttatgctagataatattcatgagcatgagagacttccatggggcaaggaaatgtatgtaggaaagtgagtaaaagtgttaggattacactatttccctgtttgatatatttttctagagcaaacaattgtgacagcaatacattattgttagtaaagacctacaacgaatcctaccacacttttatgatttagctctactggaatatctggtctctcttatcttacccagttctagaattccgtgattctgatctacttctttaatgaaggtttgtccctaagccaagtatttaagctactcctagaaattagtgccatagggaatgacattttctcattcaacaccctgtctgtgtatttaatgcatctatcataagcaataatgaaatattcagttgccaaaatccaatgagggttttgggagtttgacaactaaagtctataaactgctttaaatatttaaggagacatttattctcttaaattcatccctgtgaggatagatgcattgttttatgtgccatgttggtgaaaattagactctttaaatagaattttattaatgtctttggttcttattattctacttgtcagtttaaaaaatcttctaagggaaataccattaaacatgttctcccatcccactccccactatttatgtattaaattaataggaagtattcttaggttatgaagtcaccctattgcaaattcaagtgtaacccaacagcataaggtagataacataactgaggttgctacaactgagtgatgactgcaggtttttaatttatattaggctatttaaagaaatccccattgaagaattatgacccttttgtctccttgaaaaactaggagtcatccatttatctgcatctccggtttaggctgtcaacatttctcaccttgattattgcaaagtcctcttaactggtgtctcaacaccagcctatcactcacctaatctgacattcacactgcagccaggggattagactgaagacacatatacttactctgcataaaatgattgagtggctgcatgggaaaaaccacctcactagtatctaacatccttcctgatttaggctttgcctaactctacagtcccagtgatgttcaccattttctctactacagccagaccgagtagaggagatcccacaaatgtatcacatactttattctgaagatctggggtgtggggggaccaaatggccctgcaaactggtaaaaagcacggtccctggacattcaccataggtttgcatcttatccatgctgccaactaactgtgctgcttggacgcattttgaactctctgtgttactgtttcctcgtctctgaagtggtaattaagcagtgcctacttgatagtttatgcatgtaaagtgggtagaatcctgcctggcatatagtaggcactatgtaattatcgatactgttgtttcccttattctggaccactgtttgacactccccaggctagttctaactttttaaatggtttctttagctctcattttaaatatcattcacgtgtgcttgcgcttgcacgtgctctctctcgctttcttgtgagttctctcgctcgctcgctcgctcttgctctctctctcttggcttcccatgtagattgagtttttttttttttatgtgttacctctacttctcatactgtatggcaaggcacatttttacttagctgcctttcctaacaaattctaaacttgtaaacacagagattgcgtttatcttggtcgttatgatattgccactgcccagtacagtgcctgaaatgtatgagatcataatatttacgacaaaaagaataattagtgattttattaatagcagatgtttaacttattgaaaaacaatgtgaacatacataagcactctaagtgtatgaatatacggttgggtaaactgctggtgaatttgtgtgcatgtgtgcgtgtgtgtgtatgagagtgaaacacatgcaaatagcaaatgttttcaaaatttccaagttcacctgatacatgaagacaggagttaataaagatttttaaagtaacgtctaaacaagtaagaaaaataactttgaagggctgaggcacattatcgaattttttggaaacataaaaaatgctgtcaggaaagtgtcttgctgaaaatatgtattacttagcttttgttctatctctgaagtgtcccacaaaattcttcagaattaatctattacattttttgaataaaaataaaaattacttctgagaaattcagatgcttattggtaatagtaatatattcgagtagaaaataaattttaagtttagaggtataatacaccctctccaagttaaagaaatactatacctgtgtgcgcacgcatacataataattcacacactcacataaacacacacacctggtttgctgaggactttcaatcgttgcaggtgtgcgtgtgaaaaatgttactttccttgtaatcattctccaaatgtgctgtgtcatcatctcctttcctgctaatcagcggtatccaaaatgacatgaccagattgtgtaatttcttgtcacttttttcttatctaacagcctctttcgtattcttatgattcagttcagtttattttaaaattgtaatttcaccctcttcgaaaaccctactctgccccatcaaaactgcccatgacagctgtctgtggtttgcacttcactcaaacttttttccttttgctctcttaatgagtgctacctcctctggtattagggaagaaaggaagcagaaggaaagtaccagtgttgccaccacgtcctatagtttttttcttagtaggcttgacttgctgatctagatgattgtcttgcatgtgggctcactgtagataggtgctggctatagtgtgatgatggagttctggtaggcttctcctatgagctttagcaatccccttagagatttggcccccagagggtggctgcaaggcttacttctctgatatgcaccccaaacagaagctgtccaagcaaattcttacttacaatgtcatactctgcacgagcaagaggatgtgtccagaatcacatttctattaggaactgagaattccagaagaatattcctggaccctggcaactagatcacctgcctctgtgtcaactctctccaattttctctctctctttccagtagtatcactgggaagtgttatcaagccctttgacttaataaccttcattttaaaaattacattctagctgctgcttttagacttgtccagtagttaccattctttctttagacctgttttcttggctatggggaggagaaacaattccaaaaacagaaagggcaggtggaaaggaaagaagatggaaaagaaaaaaagtggaagggaaatttaagagttcctcttgtagtctttcataggtacctcatagatggtagtaggagagggctcagggagttggtgtttcatggtgggacacattctcttaggttaggctactcagggagccttacagaatggccattgaccccagctgggagtggttccctgaatatagaatgtgacacacttgaaattcttgatcctcagcttataagtttagctgcagttttagaatattagaaaagacccaactcaataccatgctatgcttgtagctgtaactccagttacagatctcagagagaggatggacatttgacaagctttcgacagacagctgtgtcaaaattgaaaaacattaaagtctaattttatgggcatcatagcattttgataggaagcacagacttatagccagatggctagatgcactaccaatcttacagtcctttgtaaaataaagataataagaatgattatacagagtcatggtacggattcaatgacttctgtaaagcatcaagaacagtgtctgatatatgggcatttctccttttttaagttcagggatatgtgtgcaggatatgaaggtttgttacataggtaaagtgtgacatgggggtttgttgcacagattctttcatcacccaggtattaagccttgtatccactagttatttttgctcatcctctccctcctcccaccatccactctcctctaagccccagtgtgtgttgttcccctctatatgtccatgtgttctcatcatttatctcccacttataagtgagaacatgccatatttggttttctcttcctgtggtagtttgctaaggataaaggcttccagctccacctgtgtccctgcagaaaaaaaaaaaagatctcatcctttttcatagctgcatagcattccatgttgtatatgcatcacattttgaaaaagtcagtctatcattgatgagcatttaggttgattccctgtctttgctattgtgaatagtgctgcaatggacatatgcaatcatgtgtttttatattataatagaacaatttatattcctttgggtatatatccaataatgggcttgctgggtcaaatggtatttctgtctttaggtctttgaggaatccccacactgttttccacaatggttgaactaatttacactcacaccaacagtgtacaagcattcctttttctccacaactttgtcagcatctgttattttttgacttcttaagcatagccattctaactgatgtgagatggcatctcattgtggttttgatttgcatttctctaatcatcagtgatattgagcatttttttcctgtgattgctggctgcatatatgccttcttttgagaagcaattgtttaagcccttggcccaccttttgatggtttttttttcttgtaaacatgtttaggttccttatagatgctcgattttagacctttgtcagatgagaagtttgcaaaatttttctcccgttatgtaggttgcctgttcactctgttgatagtttcttttgctttgaagaagctctttgctttagttagatctatgtgggcatttcttctgtttgttttttattttgttggttgcttgtcactccccatgtttgccctgctcccaagatctactaactcttcacacagaacctctggttgcctttgtgaaagctgcaaataccaggatgcaatcactcttgtcagacccaaacgaattgcagctgaaaaagcacaaagtagaggaactcatgcttacatgtctgagacaaggattgtctcgaggcttttctaaaataaccccacaaaaaatcccttctttaggactgcagcaattcagataagatgctttctaaagaacacttgcctaataacaccatcttctccagtgaattgacagcaaccttagctttgaacctctgaaaccaatgaattctgtttccaagaagcttatataaacttcccctttttgcccttgctctgagctttctcttacccttccatctttgggtagatctgtggcttgccatggatgtgcatactggattatgatccttcttgattattcccaaataaattcattatattaggaggcatttttctggttttgttttgttttgttttgttttgttttgtttcaggctgacactagggatgcctcttcagtgtcctttgctcagagcaaatcactctattgttcatcctactaactaattgttggagtaaacattgcttcatgtcctaaatttctctgaataattattgactaactagtgctaaatgagtacaatctagtaggatagtcactttaatagagagtaaacccataactccaagttgaaatctcgcccatcagtactgggtgagggaatggatttttgtagatttctgagaatttttaaatcccagcactaaagaagtcatctgtgggaggggcccagtgttatcctaaggttatagatagattttggtaaaagagtaaaaaaatgcaggctgggtgcggtggctcacacctgtaatcctagcactttgggaggccgaggagggcagattgcctgagctcggcagttcgagaccagcctgggcaacatggtgaaaccctgtttctgctaaaatataaaagatattagctgggcatggtggtgggcacctgtaatcccagccacttgggaggctgaggtaggagagttgctttaacctgggaggtggaggttgcagtgagctgagattgtgccccactgccctccagcctgtcgacagagcaaaactctgtctcaaataaaaaattaaaatagaaacagataaatctaaatggaaattctttaaaattcaagtgttttatattaatgggaggaaaacgagagaaggcacatagcccctgcagttgttatatgggtactaaattgtgactctgtcaacaagtagttgtgttaccttagtatatcatttcatttccttgcaaaaaggaaacaattgtatctgacttgttactctctagagctgtgtaatattagataatatgtgagaaaatactttgaaaaatacaaaattctctatagatattatgattttcactaccatcatctcagaactctgagagtgtttgtagatgccactcttgtctcatttctgccttccagcgatgttgtaattttcgaatgggataatatgtaaaactatgaagtgtccaacatgtaataaatagttaattattacttgctattcatattgtgatttataattattgattttattacataattttcatgctagaccatgagttcttattactctgttttactcagccctgcaccactggtgctcagaatatcttaaagatttaatatatgattgttgaattaattggctagttattgttaattacatcaataccatagactacaacataaaaacgaaaacattaagtatcacagtggagcaatagagaaggtaaaaattcagaagccacctggtgataaaaagctaaaactaacacagaaataaatagactacatgctttttgtcacattatgggatttttccaagaaatacatttctttctcataggcccctcaccaggcctctgcagtcactgcatggtgttctggcacatgtgaaaagcctgctgcaataaaatttcaagggcttctgcctataaaattttatatactgcagactttgaatctgcattactttgcagaaacaatggattttcgtttcataatttggtagtcgttaagaaaaaagaacttaagaaaaacatatgtaacaaacctgcacgttgtgcccatataccctagaacttaaagtataattaaaaaaaaattagtaagttctttaacttgccactgtggaaaaataaatctatacaacaaagtatgaaacacaaatcattacaaaggaaaatttattactgaaataaaagtgtgataaattaaggaattctgcagtatataaaatcttaaggccctcggatcttcttgtatgctaatcacactgcttaaagctttcccctaacatgcaagggtgttgctaggttattaaaatatgtatatgacatgtttgactacacttttagaaactcaaactcattatcaagctaaaaatgttgttatatttctatctcctactcaataactatttttaaaataaaaacgttctaaatctcagcaaaataagatttttgtgagataaaagtatgttttctgatgttacacaacaataattgatactaatccaccagaagtactaggcaaaaatttgcttattgaattccaaaatgaattatgttttattggccgtcgctcagacaggagaaaataatgtatcttgttttctctaattatcttctctgtttaacttatctcagagacctaaaagctaccaatggtgaatgcctttacatgttcatgggagctgtttttattatagccatctgagataatgtttgtccttgtccttctgatccaaaggacaagaatgtaactaacaatggaacattttctaccacatgagcagtttgaggatgttgatttctgaaccagccggtcaagtttacagcatttatctcttagttaatacatgaccttgatattttggggcacatatggcaacatgcagtctcatgctgatctagttacttttgcaataagaataacttaactgtgtttttgtcttctcactctgaagctattattcactagttccactaaacaaaaagatttcaaagtccacattaaaaatctagattacatttcttaaaaataggttttcctcgttgttcaaaactgtttattttattctacatccttctttttccagaaatgggatgggttggtgattacagtataaatacgtgtatgtacctatgtgtaaacattttcgtactgatttttatgtgtctgttgacttttttcaaaaatccatttatcatcaacctcatgacctcgcaattaccaaaagcttactgttttctaaacataccaaacaccttttcattaccgcttttgccctttttattggtaaaacatggattctccttggtactctcgaaaaaatcagatttccaactattatgcttctactgaagcactttatttctgcttcatacactcacagccctttgtctttatgatttttgatacttatatgtttttatttctattatttgggtacatttgactctcacaaaataagtacaaattatgtaaataattgttgaataagttatatcactacacacacacattataaaagtattttaaagtggttccctcaatattcagcgaatttctgaatattgcttttctacaaaagaacttaactacctggttaagtagcaagtaagttttttataaaagaaaagagaagttaaaacataagctaaaaccactaggcaaaaaatgttacaaagaaggattatatactctaatatatatatatgattcaaatatatggctacacaaaacaatcattgcaacatatgtttaaaaaatacttattcctggatgatggacacatgaatctaaatctctccactaattattttccccagacatccaggaaggaatgcgaacgggaaacatatgtaatcaagaaagtcagcacttatacgagaaagaaaatgccatgaatttcaaattaactctaaacagaaaattacacacaaaatcacatcagtgctttgaccagagctccaatggccactgcaaaacctgtgagtgtgggagggaagggaaagagaatccatgaaaaatgggagaggatagtgaaaagtttagagtatagagaaagttatctgtaaaaggataaagtccttttagaaagaggtaaattaatgcacagagttctgtggcatggtggcacagcgccaactacagtaaagaaataaattactaggtgtccacatgagaagaatacaaataaaatgttaaagtaattaaaggcatataaacaaccaagagaaattaagatatataacctttttttgtattccattccaaccactgtctctttgaccacattttttattgtatctgctattcactctctctctctctatatatatatataaaattccataaatatacatatttatttatatatttcttttaaatatatatataaaatatatgcattttatatatacttatatatgtcttctatatataggaaatacatatacacacatatataggaaatatatatatgtatatacttataggaaatatatataagtacatataacctctatatagggaatatatataaatattttatatatagggaatatatatatatataaagagattatatgtacatagtaagaatatatgttccttaaaaagggtgaaattaaaactagagacaagcctcattttatcgcactctgctttattatactgtggagataccttgtgctttacaaattgaaggttgtgataaccctgccacaaacaagcttaccagtaccattttcaaacagcatgtgttcactctacctttatatcacattttggtaattctcacaatattccaaactttattattaatattatgtctcttaaggagatctttgatcagggatctttgatgttactattgtaatttttttgagttgccacagactgcacccatataagactgtaaaaattgctgaacactgcatgtgttctgactgctccactgcaggccactttttcctgtccctctccctgtccttggccttccttattccctaagagacaacactattgaaattaggtcagttaagaaccctaccgtggcctctaagtgttcaaattgaaagaaacagttacacttctctcacattaaatcaaaagctagaaatgattacacttaggcgggcatggcgaaagccaagataacctgaaagctaggcctcttgcatcaaaccttagccaggctgtgagtgcaaaggaaatgcttttgaggaaaattaaaagtgctactccagtgaacatacaaataataagaaagtgaaacagctgcattcctgatgtagagacagtttgagtggtctggagagaagatgaaaccagctacgacattcccttaagctaaagcttaatcctaattctcttcaattctttgaatcctgagagagatgaggaagatgaagcttagtacctagcaaaagttgattcataaggtttaaagaaaaaagccatcttcaaaacacaaaaatgaaagatgaagcagaaagtgctgatgtagaaactgtagcaagttatctgggacatctatctaagatcatggacaaaactatctgaaaaaacaaattttcaatatagatgaaacagccttttactagaagaagatgccatctgggactttaatagctagagaggagaaatcgatgcctggcttcaaagcttcaaggcccaggttgactttcaacctgtattgttaagttgtaatgcacctgatgattgtaaattgaagccagtgctcatataccattccaaaatcctggacctcttaaaagttaggctaaatctattcttcctctgctctgtaaatgaaattacaaagtgtggatgacagcacatctgtttatagcatggtttactgaatattttaagcccactgtcgagatttaatgctcagaaaaaaagactcatttcaaaacatgacggctcattgacagcatccctggttacccaaaggctctgatggagatgcacaaggtgatgaattctattttcatgcctattacacaacatccattccatgaatcttgaatgttcttaatggcatctagagtggtgaatccttatcagaaggtttttaccttactttgcccaggaatattagaagaatcaccggctgtagctgtatggcagctatagtcttatgcaacatatttcttaataaaacttcaaaatcaaaattactccttgatccatagcctgtgattctgctgatgttcttatgcaaagtaaattaaaaaccttttgataaggattcaccactctagatgccattaagaacattcaagattcatggaaggaggtcaaaatagcaacattaacaagagtttagaagttgatttcaatcattatgagtgacttcagtggaagaagtaactgaagatgtaaaaatatcaagaactagaattagaagtggagtctgaggatgtgactgaattgctacaatctcatgataaaacttgaacggatgaagagttgcttattattggtgagaaagaatgcagttccttgaaatggaatctactcctggtgaagatgctgtgaacatggatgaaaccactacaaagtctttataatattatataaatttagttaataaagcagtggtagtgtttgaaagattgattccaattctgaaagatgccttacagtgagtaaaatgctatcaaacagcatagcattctacactactaagaatttttttgtgaaaggaagagacaaacatgtcgcaaacttcactgttgtcttattctgagaaattgccgcagccactgcgttgttcagcaaccgtgaacctgatcagtcagtagctgtccacatcgaggcaaggcccaccagcagcaaaagatgaccatttgtggaaggcttagatgatagcattttttaacaatgaagtattttttaattaaggtatttacattttttagatgaatgctactgtatgcttagtggactaaagtaaagtgtaaacatgaattttataagcactggatgccaaaaaatttttgtggctgtattgcaatatacacttcattgcagttgtctagaactaaacccacaataattcccaggtacacctataattatgttcatttataatttaataaagctttctagaaatgatcccttagatctatatattgaaaaactacacttctgtagtttacctgaaacgattaactccaaaacatatcttagtgaaactattaaattttaaagataatttaaaaatatccttagaatcctctaggaaaagagattaaattataacagtgagaaaattagactggctgtagacttctcaggaataactcacaaagcaaggagttaatggagtggaatttcaggaaacacaaaaaagggtaagccaagcattttaggtctaggcaaaaaattttcttcaagaatcaagtgtacagaaaaagaatatgcaagaaccaaggaacattatatacacaaattgtttatgaataatctatcatataatgagtttcatctaaataaaatgtcctggtgaaacttcagtaagggaattgatgattagcattaatatatttatttcttgaaatatgacttaaaaggggtgaggatatgagtgggtgaacaatatgtaagttttatacattctggcaaaataaagtattcaagtgtaaaatgaaaagagaagagagataagtgaaaatagaaagatattaattgtggggtacgtcataggtgagtcaaagaatactactaaaaatgaaagccagttagtacaatgctaaaaatatgaggcaggggtgggaggaagcagctttagggaaatggggactatataaactataaatacaaaaataatccatagaacaaacttgtaaacttttctaaataccaaagtaattttttaaaaggagacaatacattgagaaacacagtaaacaaaatataattcaaacagaaagtataccaaaaaatgaaagcaccaaacccaaacacatccgttctgtgtaataggttgaactcacctattacaataaaaagattttaaaattggcacataaaaccaaaatctatgttgtatgccagacccatctaaaatacagtcattccaaaaagttaaatgaatggaaaaaacacatcagtcaaatggaaacaataagacaacaaacctaatatgagaggaagtagaatttaggccaaaagcattagatgagacaaacggtgttgtttcatgttgctcatagccacagttcataagttacataaaacattactgatatctgtgcactaaaaaatacaaccacacacatacagaacataaacttcagttggtgcagggaaatataaagacaaaataacactaacaatagtgttgccttttattctgttgaattgtcttattgatctggaagtatttgttatttattaacatataattccatggttgatttcatgtattgtaaatattatctatatgactacatgactagtatttttacttctacagtagtatattttgataataaaagtttctaattttattgaatccaatttttttattgttagtacttctctatcatgtttcagaaatctcccttcaccgcagctcataaagatattgccctgtgttattttatggaaactttcctgttccaccttgcactttttcatctagtctccacctcatatcatgtatcatttgaggtaggaattaagttttatgttttccatatggatatgcaactaatccagtactatttcttgaaaagattgtcttttcctcaccaagtttcattgccttctttgtcacattttaagtgcacatatatgcaaaaataaatttatagatttttaattttgttccattggtttatttgtatatcgttgtgccaatatcatactgccttggttattgtgcctttataataaatctttttacttggttggccactttccaaaatgttcttcttcaaaatcattttgcctgatctgggtaatttgcattttcataaaaattgtaaaagtttgccagttttcacacacaaaaagaatgaggtttgtttgggagtacattgagtctatatatgaatttggaagataactgttttaaaataatgagtctcctagtatatagtgtatttctcttttacattatttgtcttactgtagtcagtaatgctttcttaaaaatctatttctaattggaaattttaaaaattatatatttatggtgtacgtgatgttttgatacatgtttatacacacactgtggaatggctacaccaacctaattaacatatgtagtatctcacatactatttttttggtgacggaaacaatacttaaattgtactcttctagcaaatttcaaatatacagtatattaactgtagtcatcatgaggtataatacatatcttgaccttaacttctcataagtgaaattttgtttcctctactcaacatattcccatgccccaacccccgtctggtaaccacactttcactccctgtttctatgagtttgacttctttagattctgcatgtaaatgagatcatgtggtatttcacctactatgcctgtgagtcaataatgctttatagttttctatcgaaaagtctagcacatcttctgtgaaacctttttctaggtattcagtgattttcactataccatatatactttttaaaactcatttttgttttatttctggaatgtagatataaaataatatgggttattgaatacatgtattatgataatactaagtccacttaacaactgtaattatgtaattgtacaaagttaaaatccttctcttccaatcttactttgtgtgcattcattcattcattcattcatgccttattgcactggctagaactgccattataatattgcataaaaatgctgatagcagatacgcttttcctctttctgaatctttgttaatgttagttcttggtttcttttcacacaccttttataagattgataaaacttttacattcccagattcctaagttttgcatcatggataggtgctaaatatctattgtttttgttagcttagtgttttattctagaaatttgtccatttcaaataattttcgtatgtcttgtcataaaactattaatatcctttcctgttatttcatatctgagggatctatattgatgattctattttggttcttgatatgaatttatatcttctctttctctttttttccattggtgattcttcaaaaattttagtaattgttggaaaaaacaaatttttgctttattgatctcttttctatgtaattgatttcaatagtattaatgtctgctcttattttttattttttagtttattatttttgtaatttaaacatgtttttgagagttgatttttaatcttttttctaaggtatgtatttaaacataaattttctttgaagtatagtttagctgcatctaacaaatttttctcacatttttgtcataatttcaatttttttccattttcattataattttttctttaacatgtgggtacttagaaatacattgtcaaatttcaagtgattactttctatgttttttctattgctttaaggctttgatttactctgtttagagagatacattgttttaatctattgttatcgagaatatggaaaattttagtaaataatgtgtttactattacaattagaaaataatgtgtaccatagttgctgagtacagtctttcatatatgtcacttaggtcatattgttgaaatatgctgtttaaatcttcccttctgattttctttctatttgcttcttccattaagagagaaagtaaaaaatattccactgttgttgtcaatttatctattatttttgtcaatttcagctttatatattctgagattacataatttgataaacactaatttaaaattattttatcttcttgtttaacagttgtctaataaaaggtctctctatttctggtaatcttgcttacttgaagtcttgtctgatagcatagataagcaagctttctttggtcagtgttcacatggtgaataatttcatctttgattttcaagctgtgttatattttgatgcctctcttgtgtgttgttttcattttcaaggctgacggtccttgcattttaatatattttctgtttaatttcctactgaaatacttggattcaaatcatctacattttatgttttactatttgtatcttgtatactccttttttccttcttcatgtaaattattttggattgaagttctttttaaataataattacctctattcccacttcatagtttattagtcatatatgcctttactattcttttacagataaccctgaagagcttaaaatatacatccttgactctttgaaagaacaaaaagaatttgtacagtgaccatatttcaaacaaatgttggaacacttttccattcattccacctgtgtatatatatatatgtgccattgtttccatgtattttattatgtatatatcttttaatctgcaaatggctttgttaacatggttttatacagtcattacttgaatagattgacccaccaatttatccactgctctctattccttcctgcgtctctaatgcttatttagagtcatttttattctgttgacagaaatttctttaggatttttaatggaactgctgttgatgaatcttcttttttttgtctaaaataagtttatttttattttgaatttttttctgtggttaggtagagaatttcggtttctttttgcttccttttattttctatattagttctttgatacagttcttgaatttgctcttttaagttagtagcaaacaaacatcatttttaaaacaaccatataactttttaattagaatatttaattatgttttcctaacccacaaatgcttttgcaatgccgttatttaaagttttttttccggaacttttatctctcacatatgctttcactgtaatgcatataagcttagagagattattgtgattttcttggctttttgggtttcgggtgtatattttcggggactttaggtgtcaacagacctaaaagcaaagagaaagtgtgggctgtcttcccactgtggccagtaatggagagcttgtggactgctggtctccttctagaatcatacagtttcccatttccaaaaactagaggacacagctcattggttcagagccttcttggtatcctgagatgtgaacctttattttgccagccaaattcttcccaggatcctcactccacagctcaaatgctggcctgctttttctctgcccaaaggtgaacaactttctcaccaattatttctgctcagactctcacagaaactgagttctcagaaaccacttaactcaggagatgtagatatactgacactgtcagtctacgtgaagagctctattcaggctctagaatcctcatagttatttatacaagaagaacttgaaggttaatgtacttacgtatctaccattcaaattcttcaattgttgttttgtacactgttatttagttgggtattataacagaaacgaaagaaaagaatgtactgacctgcccagttggcaaattgcacccaagaacccctcaacccacagagacgcttaatattatattaacaaggtcaatataatacctctcagtgtactggaactgtaatttactaagtaattagatgtctgacaatacaatattctgggtaaacataaagtagtttagtagccactgaatttgcctcattgtatgtaaaatcttcttaaaaatgttttgaagtaattttctagatagttaatttgctacttacccaactttaactgtcccagttcttatcttacagtgcctctcaaaggtcaaggccagaaggcacacattgaattttcaaaatgctcacttagccatactttatgggctgtagctcattctaattgctcaagttacatagtagttacttcatggtattcttccttaggctttatgaaaatgaatactacatttaggtggctcagtgataattgataccactagagacacagattatagggaacataagattctgctgcctttatgtacctgtacatttctcctaaaatatattcagttacttgcaaaagtcttggtaatatgtcttgatgtagcatattgtatttcaacaaaagtgaaagtagattcaggtgctggttctgtcctgtgacatgataggaatcaaattatattcccagtctttttttgcatcaattctcatgcctatatttaatatttagaagcatatgcttggtcagcagcattctgaactacagctttgaataatcctctgattagttattttccagatttccaggagctgtaagatggatttaagtaatatgttgattggttagtaaactacttgttttataaatcagcagtggattccctttgcgatatattcaccctggttatttatttcttacttgaagaatctacaaataacgcagatgagttaaaggaaacagagtagtcatatagtaaatcagcaaaacaaaaaatctgaaataaatgtatttagttttaataaatgcagacagcatcttgctatgttgcccaggccggtcttgaactcttagccttaagtgagtttcccatctcggtctcccaaagtgctgggattacaggtgtgaagccatcatgcccagccaagaaatttatttagaagacaaacaaacaaaaaaacacacttcagggactacttgaagtcagccaaagaacacaaagttattttgaacatgaattatttacaaagtcttacaacaggtgaggttgggataagtaaattggtgtaatcctcctttcaaggagtttaatgctaagtaaggagtcaatcgtgtaaactactctatgtgacaggtagaaagatggaaatttttttttccacagtgttttttaactttttattattattttgtcttcatcttttaagtccagaaatacatttccaggatgtgcggttttgttacataggtaaacatgtgtcatggtgctacacagtcatcccatcaccgaggtattaatcccagcattcattagctattcttcttgatgctctcccttctccccgccaccctctgacaggccccagtgtgtgttttccctctctacacgttaatgtattctcatgatttagcattcacttataggtgagaacatgcagtatttggtttactgttcctgggttagtttgctaaggataattgcctacatttcaatccatgtccccgcaaacaacatgatctcattcctttttatggctgtagagtattccatggtatatatgtaccatattttctttatcctgtctgtcattgatgggcatttaggttatttcacgtcttttctattgtgaatagtgctctaatgaatacacacatgcatgcatctttataatagtactatttgtattacttttggaatatacccagtagtgggattgctggatcaaatggtatttctgcttctaggtttctgagaaatcgccacactgtcttccacaatgggttgaactaatttacactcctgccaacaaggtaaaagcattcctgagggccgggcgtggtggctcacgcctgtaatcccagcatttagggaggccaaggcgggcagatcacaaggtcaggagatcgagaccatcctggctaacacagtgaaaccccgtctctactaaaaatacaaaaaattagctgggcgtggtggtgggcgcctgtagtcccagctgcttgggaggctgaggcaggagaatagcgtgaacccgggaggtggagcttgcagtgagccgaggtcgcgccactgcactctaccctgggcgacagagtgagactcctcaaaaaagaaaaaaaaaaaaaaaaaaaaaaggcattcctttctctccacaacctcagcagcatctgttacttttttttgacattttaataatcaccattctaactggtgtgagatggtatctcattgtggttttgatttgcatttctgtaattatcagtgttgttgggctttttttcatatatttcctggccacatgtatgtcttgttttgagaggtgtctcttcatgtcctttggccacttttcaatggggttctttgctttttcttgtagattttttaagttccttgtaaagtctggatattactcctttgtcagatgaacagattgcaaaatttttctcccattctgtaggttgtttgatcactgtgtttgatagtttattttgctgtccagaagatctttagtttaattagatcccatttgtcaatttttgcttttgttgagattgcttttggcatctttgtcatgaaatctttgcccatgcctatgtcctgaatgatactgcctagttttcatctagggtttttatagttttgggttttacatctaagtctttaattcatcttgagttaatttttgtatatggtgtaaggaaggggtccaatttcaattttctgcatatggctagccagttctcccagcactacttattaagtagggaatcctttccccattgcttgtttttgcctggttcatcaaagatcagatggttattggtatgtggctttagttttgggttctctattctgttccattggtctatgtgcctgttctttcaccagtaccatgctattttggttactgtagtcttatagtatagtttgaagttgggtaacatgatgcctccagctttgttttgttgttgttgttcttgttttgtttctttgtttgcttaggattgccatggctatctggctattcgggctctttcttggttccttataatttttaagatagttttctctttttctaattctgtgaagaatgtccatggcagtttaatgagaatagcatttaatctctaaattgctttagtcagttcggccattttaaaaaaactgattcttcctatctatgatcatggaatgtttttctacttgtttgtgtcatctctaatttctctgagcaagcagtcatttgtagttctccttgaagaggtccttcacatccctcgttagctgtattcataggtattttattcttttatgtctctgccaggtttggatattaggatgatgatggcctcatagaacgagttagggaggattccttccttctcaatttttttggaatagtttcagtagaaatgataacaactcttttttgtacatctggtacaattcagctctcagcctgtctggtcttgggatttttttggttggtaggcaatttattaccaccttaatttcagaactcattttggtctactcagggatttagtttctttcttgtccagtcttgggagggtgtatgtatctagtaatttattcttttcttctagattttcttgttacttacataaaagtgtttataatagtctctgatgacttttggtatttctgtgaggtcagtagtaatatggccattattgtttctgattgtgtttatatgaatcttctcttcttctttattagtctagcttgcagtctatcttaattttttcaaaaaaaaaaccagcacctggatttgttggtttttttgaagagtgtttatgtctctgtcttctttaactcagctctgatctttatttcttgtcttctgctagctttggggtttctttgctcttggttctctagtttgtttagttgtgatgttaggttgttaacttgagatctttctagctttttaatgtgggcttttattgcagtaaatttccctcttaacactgtggtagctgtgtcccagagtttctgatgcattgtatctttgttttttattattttcaaataacttcctgatttgtgccttaatattgttatttacccaaaagtcattcaggagcaggttgtttgattttcatgtagttgtataattttgagtgaatttcttaatcttgagttctaatttgattgcactgtggtctaagcaactgtttgttatgatttcagttcttttgcattttctgaggagtcttttacttctgaatatgtgaacagtttttttagtaagtgccatgtggtgatgagaagaatgtatattctgttcttgggtgcagagtttgtagatatctgtcggatccacttgatccagagctgagttcaggtcctgaatagttttgtaaattttctgtctcgatgatctgtctgatattggcagtggtgtgttagtctcccactattattgtgtgggagtctaagtctctttgaaggtctctaataatttgctttatgaatctgggtgctcctgtattgggtgcatatatatttaggatagttagttcttgttgaattgaaccctttaccatttgtaatgcccttctttgtcttttctgatctttcttggtttagtgtctgtattgtcagaaactagaattgcaacccctgcttttttaggttttccatttgcttggtaaattttcctctttctctttattttcggcctatgtgtgtctttgcatgtgagataggtctcttgaagacagcatatgaatggttcgtggttctttatccaacgtgccactctgtgtcttttaattggggcatttagcccatttacattcaaggttattgttatgtgtggatttgattctgtcatcatgatgctagctggctagtttacagacttgtttatgtagttgcttcatagtgtcactgttctatgtatttcagtgtgtttttgtagtggctggtaatggtttttcttttccgtgtttagtgcttccttaggagcacttgtaacaccggtctggtggtgacagtttcccgcagcatttgtgaaaaaggactttatttctccttcacttacaaagcttggttttgcaagatatgatattcagggttgaaatttcttttctttaataatattgaatatttgccctcaatctcttctggtttgtaaggtttccactgagaggtccactgttaatctgttgggcttcccttttttcatgacctgacctctttctctctggcatccctcaatattttttcttttattccatcagtgaaatgtttttatagtcaaataattttgcaaaacatttttttcataattcacaaaacaaatgcgtattttaagtgttcctatagtaaaggagaatcctttaatctgatatgacaccaattttgattgactatagtataccctaaactcatttttattccaaaaaatttattgatatcattagaatagtacacatttgtgggacacttaagtttgtaattataatagctgggagaaagggttacagccaataaatcctgattgtggaatcaagacagcttcacagagttggtgattgggcgtggaagaatgaaagcaatatttaaataggttaatctaaaacaggaagtacatataaaaatttgaagaaaaaattttcaagctgtaaaaattacataagcaagcagttgaaacatttctgcaataagatgtaaatatgtacttctagctatttttgaaagtaatgtagtcttcaaagaaaaacattaaaaactgagtacatgtgtgttttcagtacctgtgtgcacagcacagaaaatacaaatatatttaaggctcatttttggcatcagagaggaaataatagtctttaaataatattactacaatggaattatagctaaattattccaattaaaaaattcctttctgtatggagcttagagtttgtttttaaaacaaacaattatagaaataaatgtgaaattatgatacatagtacaaaagaagttacaacctgtgatgattgtaagggttttaaaggaggaggtatttgaattgaggggttgaaggatgagaagctgatgaggtaaaggttatgaaatgaggcatgacaagcagagggcacacaggcccagtggaccgtgaaacatggggtcttcaagggtggatagagtaatggacagtagagctgggacaatagaggatagtgagagacatggagtctctgcaaacataatacccaaattgagtagttgacaagaaaaacaaattttatttctgaaatagaaataccaatatgtcagtgggattttgacagacgagattgtttctttgatttataataatgtgacgtgtatgtttttagaatggataaaaattgacaacatgaaagttcagcttaactcaacaagtattcattgaatcaggttccaaaggtaggtaaatgaatatgatacattccctattgatgaaggagatagaaacataaatatgtgcatgtatctaagatgcctaaaaggccttttgagtgagaggaagtctgagctgatacataatgtataaacattcagatcttgaatctgagatcagacgggtgattcagatagaaggaattgcataaacagacacgtgaggcttaagcaaataatgttgccgagaaccataagtactttgatgttgttggaatgtaaaatgtgagaaaggaagaaaaggcagagaaagctagaaaaaaaaaacatgaaatatatcacaatacggctctgaagccaatacggctcatgaagccaaagacttagagttcgtgctatacttcagggctgtgcaaacttcagacagtgagccaaatctggcttattgccattatttggtgagtaggcattggaactcagccaaaattatttatttaatgttatctatggctgttcccacatttcattgtcagagctgagtagttgcaacagagtgtgtgtagtacacaaaggcaaaaataagtatcatgtagcctttacagaaaaaaagtgctgaccctgctatacataatatgccaagcacagtcttcaagtaagtgagtaacagttttagactttttcaaactaaaatacgtagtcaccacttttttattattatttcactttaagttctgggacacatgtgcagaatatgcaggtttgttacttaggtatacacgtgccatggtggtttgctgcacctatcaacctgtcatctacattaggtatttctcctaatgctatccctccccgagccccccaccccctggcagtcagcagtgtgtgatgttcctctccctgtgcccatatgttctcgttgttcaacttctacttatataagagtgagaacatgcggtgtttggttttctgttcctgaggtaccactttgtaagtatctaatatatgttaaacaccagactagatgatttactcacatgaactgcgtctcaaaaccattcttcctggtagatatcaaaattccccattttactgataaatatagagattaaggaaggttaggtgcctttccaaggccccataattttgacatttttgaatcaaatttaaactcagttctgtcgaacacaaaatacattacttttttacagtctggtagcatattacaaaaatgaatactagaatcaaatgaagtctaattgtgaggaatttgttgcagaaatcccaccaattcatgatctgtatctaaattaggtagaagggtaatagagagaaattccagagtttagtatggaaaataagtagatcatctagaatgacttctttattcttgacagattgggtgactaagtcagggaagcaacttcccactttctgttttgggtggttagaagaaagatatattcatttctagatacagggaatctaggacagcaagcaggcccacaagcagggtagcattgatgagtgatgttttgtacagtgtgtatattttcaaatgtctgaattagatccatgtgaagatagacaccagggtgttgcctgcaaaaggctaaaactcagagacatgggatacaagttggagattattcagctttagcatagagttaagaagtagcagaagctgacttttatacaattttaggaatgagtataaaatattttatatatcttatagaaatccattagatttagaaagaggcactggattatggtgcttaagaacactaagggccaggcacggtggctgacacctgtaatcccagcgctttgggaggcctaggtgagaggaggtttgagaccaacctgggcaacgtaggaacatagactccatctctacaaaataaataaacaaataaataaatagaaagaaagcgaaaaaataaaactctgtaaaagctgacaacctgagttcaaatcttacttctactaattttctataaccttatgcaaattactagatttacttgtgctttggaaacctcttctataaaatgtctattactaacactaaaagcacttaccttgtagggttgttaggaggattaaatgagttaatacatacaaaagttttaaaataatacttgtatatggtaagcaccatatagatgtttacctgtatttattaatttaaaaatattttttacatttcatatatttaattaggatttttcaacatagttttctcactacctcatataccaatgtttattctaaactgaaaagggatgtataagggtctataaaagagggctgacctgaatccaatattttctttatacctgtatatcagccataagcctggagcattgtgtgaggttaaaatgaatgaagtgctttaaagatatgtttgccacaatagagcttccttacatgtctatgaggaatattataaccaagcatactctcacagagtttaaactcaaatcatgaacatttaaattaagtttttccttattttgcctatacccatttttatctttcattgtcatttttgtttgacagagtatgatgagatagagtatttttatttggaaagtcctcagcaagacaaattagccaaaagcaataatggttcagattaaacagagtggaattgatctaatccccaggctcaactaaggaacagtcactatctgggtgtttgattttagactatagataagttgagatgttgtaatatttatggaggaattggctatgtcagttatgggatgaagactagtagtacaagtaccatcagtagtcattcttttttttttttaactttttactaaactaatacagttagatatttccactctatcatgattatattttttatgacagaaagaaaacagttccatgtttttataaatagtctctgcagagatttcagatgatgttattggtatcttggtttggcagtgtccgaaaaattgtgattgcctttaaagtgtttgtgctacttttagttaagtaaacccacactgtgtaagacccaggctggttccaagtaatatcaaggtttctatgcacataatagtttacaaagaacttaagtttaaagactatggattaaaaacaaacaacaacaacaacaaaagtgctttacagaaccaaacaaaccctctcttgatgggaatgtcaaaaaggacacatgagtcaactggaaactcttaaaggccaaagctgggacaatttgagcaatccaaaaaaatagtatgaattaatatccaaagtataaaataaatgtccttgagtccctactgatacaaataaataattgaataagtaaatgagggagaagggaaaatctcctatgcagaatttcaaataaattatgtagctgttcaacgcttaaagaaatacaacataactcttctgtgtgttgtacatagtgactttcttcccaagaatagagtgtggagaaggatggggttggggagagagaaaaagagggggagagagagagagagaaactttacagcctatgttcagtgatcaaggtcatcatcaacagtgataaatcatgctgatactatgtacgcctaatatgatgctttgagaatggcaccttaactcccaaaaacccaaaattcataaaattaattattaaaacatcagaaaatttcaagatactctacagaaaatgtgattagtgctccaagaagctttcaaaatcatcaaaaacaatgagtggctgagaaactgtcacagacaagaggatcctaaggagatgtgttgaataatgtaaaatgggatcttgaaaaaaaagtaacattagagaaaattagggaaatctgaataaagtatgaactttaatgaatattaatctatcaatatagattcactaagttttacaaatataccttaatataaggtatcgataatactagaaaccaagtgtggggtgtatgggaattgtatgtactatcttttaaatttttctgaaatctaaacctattgttaaaaagcttataaaacaaactaaacagccagtcatatgatttaaaagcaatcatggggaccctgattacaatttaacattctccttccttactagcttagtattcatattagtctcttcagctatgcaactaatttgtttttcctaaatagcaaaaaggaaaattgaacattaaccgtttcgacgactgttttactgaacgtttttcattatttgcacagtttagtttatatgttagtgtttttttttttaacttctgaaataagatttttttttactacgtatttcctatccccttaattcattgttgtagtagccaccaaaatctcggagttttccaaagtattttacattattcagtgtattttctgtttaacagaaatacattattcaagtattacattacattattcaatattatattattcaaatattttctgtttaacagaaaaataaagataagaatattacttgtaatttgattatttaaaatgtctagagaagagaagaaagctataaaggggaaatactcactaaaaaccgtattctaaaaatattcccagagatttaaaaccctggaatccctttgtaataaattatatttattttgagtccctaactgtgttttcatgaatattcacaatgttattagcttatttatctcctttttgggtcaaatgcatttactgactgtagttgcatgcttatggtgacagaggcaatactttaacactacctgcagagtcgcacattatatgttaacacttctaaaatatatttcctataccaactgttccaacttttgaacacattgtttcagtaattgcatggtagtattgcctgacaaaccaatactcccattttgttttaatttatacagaagtgtctttacaattaactaaatacttgttacattttcccacatcataaaattagggggaaaatagaaaaatgaaattactgattcttgtaatactataatcacaatcatgaaagtattctaaagagcaaagctgtgaatcttgatttctattaggtactgattaaataagtagtatagacagtgtgggaagcataaaaacacaaaaacataaaaaaaaaaaaaaacttgattctgaggagagtttccaaagagggagctactcttgtgagcataaaaattaaaacttttttttcctgaataaatgcaaagagaagttcatagggacataacatggttaataaaggtagatcatggtatatctttcatgaagagaaggaagataacgttcaattttcttctcaccaagatttgaaaatatgtagtaaagccatttcttgttcatgtcgtgatgattttcctgaacaatttcttacaaaagcaaatccttttagtatttcctaagcaatgacactttaaaattaactaagaaaattaaatttgaggtaaaattcaagatacaacatttgctacttatatttaatgtttaatttgtgtttctaatgcttttaaaattaacatctaaaaaactttttaaaaaatctaaaagtatatgtcctaatttgagtttttatcactctttaatatctacagtaaaataactttctttataacacacatatctcaaatttctcttcaaatattatgcattgaggtatcatgtaagacttccagattttattatggatgaaaatgggatctacttgtacttgaaaaagtaatgaataaacaatactctgattttttatctataaaactgaatcactacaaaggctagggataagccagtgatgtgcctagcgaagtattaagtgtatataaatcatctattgttaaaattactcactttctaagtgtttccactttaagttcaagaaaactaaccattgttagatcatgggatgcatttgaagagctttaaacacctcactaccacctttagtgtacactctaaccccataaagagctcattattgtcttccttttctcttattcctgtggcctttatttataaatctagctactttatttctgctaactttacataataggtccctattgctaagacctcacagcatttcacaattacttgattacacttaaaagttgtgcttcattccactgagagcactttgcaaaccctaacacagcagcctggcacatattgggtaaatgaatgaatatatgaatacatgaatacatgattattccatttaataccaatttgatattggcctccatggttccacaggtatcatcatgaaaatgtatagcaccactatatcttgccaaaaagaataaagttaatccaaaagagttgccaaatttacccagagaaaaacactttttaatttcttctctttaaaacgttataacatcataatgttctaatggagcaagttttctttgggactgaatgttaaatattatgttttgggaagcagaattagtaatctcttaaagtagagtactcggtcatttccatccatgattctatgatcacacaacttgatagtgaaaataactttgccaatcctgagtgtgaaatgctacgtttatgaaatataaaacgcatttagggcaattaaatatatcagcattttctttactgaaaactgatcaatgcagaatatttaggaaattacatttagacaaggcaaggctatgcagacatacattacatgattttgttcaatgtctccatttttatctcacctagctctaaaaggtggttaggcagatattagcaggttgactgaaaaatcaagtacttagtgaccttgtttaatttttgttcttatgcttcacatttcaaaaataataaaagccttaattttgtcatgaaatgcagcaatggtggccgagtaacggtaaaagaaatacaatgagaaagaagaaatgagcaggtgagatttattctgtattaaatggctactgtcctggtcctatctacacaaggaatagcaatttcatgctattgttcatacaatgcatggaagcagactttgtcaaaaggcagagagtgggggtgcatggaggataaggcttcaataagatttgctgtaattctcccctttgattacctcccccaaaatgagtatcaaaatgttctaccttccatcttggcagaaagggaagaagacatagggcaggtggtttttgtaactactagcagcaatgatgacaggaaaataaaagttttcattactgagaatgaagtgaaatatctatttaaggaccatcttattttcttaaaatatgtccattaatttatacattcatttattgtacaagcatttttaaacacaatacctatgtgctgattcactgaagggcatatggaaatcaaaagcaaagtcttgttcttcttcttcagtagatacaaatagaaatcagccaaacaacagataaagaatgcaaatgagcttcataaggaaatagggactagagtaaagtgtaaagtggaagagatggaacctgagaaatcatctcagaaagctgagtttggagaaaagtcctaggaaaaaagtagttatttttgaatactatgagtaagagattattgatataaccatctattttttcaataggtaatagaatacaagctggtcttgtagaatatgaagagaagagttcattagttttgggattctgacttattcccaaatatccagatgtttttcaaagtgatataaatattagatatatttaatggaacaaaataaaaataattttatgtatgaaagtgaagcattctgaatttgaattcagatgatcaaattgtatatgtgttatcctattctgtttaaaaaatgaagtcatagttcctatatatttttaaaatattatctccaatagaaataaatagaaaatgtttaattttcatttttattttgatctttcctataataaacctgtactgctttcaactaagaaaataattttttaaaactctacatttagaattgttctctgactatcacaaagtctgttagagtaactatgaagatgattcatagattctgctgcctttggctcttctttctctttgacttggcctttaacattgctttattcatattgagctattttactcctaatttcttcatacagttatgtctgattctactgtgaaaaagcattccaaattgcttaataccaattaatttgtgacattaacaagaggccaaggaacccagtcacagtccttatttatttactgcatttttgtgagtttttgttaatcagtgagtatatttaagttatatagttattaatagagataactctccttattagacaaaagctcacaaaaactaccttatcaagaagaagatattatgcaaatgcaggtggaataaatctaattttccatttttatgcacaagttatttgcagccccagtttattgtaaatgttgcagcacctacctaaccatatttttaaggtacatatttcatatgggtagcaaggggctaataataatgaaaaatttggacatatgaagtattcttttctgttactagccttgtcaccaaccgaacacacagccttgtttgtagctcactttcccattttcaacctattggcaataaaatatcaggtgttaaaaaatgaataaaatgttgtaaagtacttcagtggataatgtttcatatatttaataatggcaggcttattagtatcactagacataggattaaaatgtaattattatcataatcagttttgttataatatttagattctttttctaattgaaaactagatgcatactaactcattctcctgacattttgctgtcttcaacaataaatatttcaaaattggatcatattcactccagcagcatttaagcactacttatcaatatttttcaggatacttacatatatgaaagcccattcttgtgtctttatatccaagatgtttgatgttagcatttgagttaattcaggaatcctccagaagatccatctgtttcctattcagtgttgaaatattggtttgaaaagctgtttactaaggataaaagtaggaatcatctctccaggaaagaagaaatactctcatttatttttgtttgtgagatagcctctagaaaggatctaattaatgaagtatataaggatgaagtgtgttgaaactttctttcccttttaaaataaagatacttcgatacactgagggaatgtataaacgtcgcatgaagatgtataggatgttttaataggacacaggaagaatttttcttctatataataaatgaaaatgtcaacttcaagcactagctctataactcttactttaaaatcctttaaaaatgttaatgattgcgtatttataatctttgagttttgatttttaagttttaatttcctgagtgttttttataaaaccaaatacatatcaaaggtatttggggtttttttttttttttttgcttgttttatgacagtgtgcttgctttctaatcaagattaaaacaagccatactgatgcagattaaattatctagaggttgagttttgttaagtttctttcacttcttacatggactgaagtgatatatatcttcctgtcaaatgatctttatatcttgataatgttttcattgcataaatgtttctatgaatagtagtaatatataataaaaatacttgtcatttcttcagtgcttagtatctcctaagcactgaataaaattatttatatgtaatcttcacaatagtcttacgaggtaagtgttactgtttctgttttgaagatgaggaaatttgtaaatccgaaagtttaagaagtgcacctaaatttacactgctaccaagtggtcaaatcacaattaaaatttagttctgtttgattacaaaagccacagacatatctaatgacatgttctattagttcaatatgatgcttatattgataagatttcaacatatgaagttattggccattggttaatttgatcatttaacacagatatatagcatttgagtaactctactggatctcattcaactatcattagatccaaacaacgttgaaatttcgttgctagaaattatagtgcatgagctatataaaatgtatgatatataagaaatgattaatgcataggattgtaggtagagtaagaatgagaataaataatctgaaacaagttgtgatggatttataggacattgtagtgaactgcttaagcaccataataaatgaaggcaataaataattatatgtgtgtatatatatatatgtgtgtgtgtgtatgtgtgtgtgtgtatacatacacccatatgcatgtatattaataaactcatatggttttctggcccccagtgactgaccccattcataactctgagttctatactgttttgtgcaacatttccagaagagtcaatattccatcccagactgggaatccaccaggtattcacataggaacttactaagtgccaagttaaatcacacaggaacttattaaatgccacgttaaatgattacaaaattgatatgaattggaggtaaaaattaaaagccatgttgacttttaatttttttcttttaatttaaaaagtgagttttgtgaatagacttaagttgtgcactctacaactcagattagtgtggttcctagatgaaggttacaaaaaccaaacaaattgagctatgttttggtctgcaagataaaaatatatatgaaatactagaaatgttttgtccttttactatcaaatgttaataaagattctaaatgtgtgtaataagtttattataatacaaaaaagagaacccgattttatctcaaatacatattaatcatgaaatgtttactacgtacctactacatttaaaatattaaatactatcactatcttttatctatatatgcattctatatatccctgtaggtatacactactctctagaattcattatacttttgaagatgaaatacatctgttttcacagaggaaaaatgaggagtaaaaaaataaaaaatgcgaaagttatccccaagtgaagaatttcctctttgtcatcagtgactgagtctttcccagaagatagcatgtttattttctttaaaatgtttttatgttgcccgggaattcttcgttatagagcatctggcattccaataattatttccaaataacacagtcatttggactccgttagatttagcctgtgaatctgcttttggcattacctgtggtttattttggaaaaagctaataagtcaacaacaaaaaattagctgtatcttccaatatcttctggcttcattaactgcccactttacagctgtcacccagaagtgtatacgaatctctgttgaacacatacatattcttattctgtcctcttttctagaagattgtgctttattattgtattatttatataaaacagtactccctttataagtccttctgatttacagagatttcttcaaggcctagtgttcctagaatgtggtcactgaatccagatatgctctaagaagagttactgaaatttctcaaattttactcatagtgttacctttctccattaccagctgaagactcctgaatttttcattcccttttcctacagaaaagactccatgcctacatgcccctgataaattcactgatacaactacagaggtgattgtgtgtatactcaaattcttacagtattgaatatatttattctgtacttggttggttattagaatcctgattcacttaagcaagtattaggcctaatttttttacttttgtcaggtttgcttgttctagagcaactcatttttgttgataaacagcttaccaaaaagaaatgcagttgtttataaaaccatgagacagcatatttagaggttagaaaggggaaggactctttaggacctgggaagtgtactttagcaggaaaacagaatgcagaaagaggagcaggggcgatgggtttgaaaaacagtttttaattatttttgaacagagactgtggagctggtactgtgctagatgatgagattacatagtcctgatcctcaagtgtcaggatcctcacaatctaataaggaatacagaccagtgttatacactagaataacagaaaactacccaactagagcagagtgttgggatagctcagacaagctgaaccatcaccagggtggagagagacgccatcaaacttttccaaagagaagactcttaaaaatatatattaatcatttgttaaatatttaataactgagctctgttggcttatggggattaacataaagagtaatgataatagcaaagtttattttattactgtgtggctagtgctgctatcaataaaagagggactagatacagaagggggaacaaatctgatgagagcagttggttgggtttcacaagtgtgcataggtggaaatgcatcctacatattgggagatgttgataatgaggctgcctgtattatacagaactttataaaaggcacacttttagaacttaatctcacatgtaagcaattaattttattaaaatatgttccctactctattatatgtataacagtcttcataggtgggtttaagtcatttaaaatattatctaataagaattaaaaattcatagatggtagcttaatagctttcttattcttttacttggcagatatatcagcatttggaaacaccataggaaactgcccatttaagacattaactaagtcactctcactatctcttttacaaaataagaccaattccctctcattaattaaatctcttgatttaaaattcccattttctaaatttgtatgtggtgtcgtcagaaactatttttctctcttgggtagaagtcacttttaaacaatatacctactaatgatgtatcaacattcttacgagtgaattctatctatcttttaatttttttcttgcctgtggaagacttctacactctacttaactgacctttttaatgaccaaaagacagaggtgttcttcctatcataatcaaatgttgatttatttgtgtctggtcttttttttttttttaagctataaggatatggattaagtatgcagactctagtgtaatcagagtagtttgaagttcacaaagtgtaatcctgtgctatatatctcaattaatcttgcagactatggctaatcacattcccaccaggcaggatcacacaactcacagagccaggattattaaaatccatatttcacgttaatagccatgtgggtgagattagtttctaagtggtaatgcacctgccataaattcctcctctctgttatcttctgaaatactgctctgtcagaagatgaaaagtacatgatgtgcattcagaatcagtttatggtctttttttttctattggtcaagtaaaatatatcttcatccctcactgatttcaaatgcactggagaagataaacactatttaatattcctctgtgacatgtcataaaggccaaagtgttcaagtttcattacaaatcttagtaagtcttttcattttaacatattgtcctaaactaacctaaaaaaataataattaacaaatacaccttcaaagaactattccccatttgattatctaaattaattttccttccaacattattgcaaattaaaagctcctgaatagcctacacatttacttgtgcattaattcgtaaaaaaatgaattacactggagtgaagataataacaaactaaaaatcaaaatatctaggtcttagcccaggctctgttgttaattgaataatttagagatagccacatagtctcattgtttttcacaggacttgagtcaaatttacatttggctttgttgtcttcaatttgaaagctaattctctagaagaaaatgaagaatgaaacttaatctttattaacctgagtaagaaatatgcttatatgagagataccagaaaacatttattctccttgttaaaatgtttagccttcccatataatctctcagcaatcatacctgaaatatgctctattataatatctaatataaaataatatttttaaatgtccccctttttgtccaaaatgggaaacctattttatcattattaatagaataataacacacataaatactttaaaaggtataaagcacttccatgagtgcttttaagagaggttttgaaatgtgtcctggataggtctgcagatattattaatatacttacttgatcactaaattgctctgtatctttgttttaaaaagttgaaatatggacatgagcgaccttcagaggtcaaaccttaaaagccagagaacaacttgtgacctagaccactattcttgatgatgatcttcccctggcttggtataaaattcacatttttcctcctatgggaaatacagggaaaatattacagctatgaaaaataaatcctgctgcagaatttaaattttcagaccttttaagaaaatagatgttaatgctttctgttgagttgctatagtttcacattcatatattagagatgcattaaataagtttacctgtttaataatttaaatgctttaaatacatgcatttgacgtttgcatgacaaagacaaatacattcataccactttgtaatgtcacagtcaatcagtcaacatgaaactggaagattcaaagaccaaagtaaataaaaatataaaagtcgacagatgcattaactttcccttctgtacatattgtttataataagatactttcaaaactcaaattagatatatgaaaaaggcaccattctgatctactagtgcctaagcattgccaagcagtcaaatctaactaaacgttctatcctcctccatttttcttcgatgcctactgatgcctactttcttttctcactgtggggtgaatgcatctactacttgcagctaaaggacaaagagtcccagcctcccttctgccagagacaccaacattcttacactcaatggggctgaaaatcctagagtcatttttgatcatccttctcattttctttattcagagttacgaatcctgtccaacttggcttatatcctaagtttgtccatcctctctttcccttatactagtcctgtcccctctacacagtttagaatttactgtcagatttgataagaatctcctcactaatacctatgtatccattcacattcatcttccttgctaatccattggttttgttttccaaacgcaaagctgtttttgccatctcttcctcttcacatttttactgttgtctaaaattttctaaatgacatgcaaatttcttatgtagctaagctcattagcacatcatctttctggcacaagattactacaacattctgagctactttatttgtttaaaatgttccctgtgaattcctttcatgcaactatgatggcaactttgttcttaacaaaatgtctttgtttaaatgaacgtaagattcagatcacacacttttttttctaaaatattaatcaacatctactgtatgattgccactaagttaaaagaattgaacaatattactaaaattaggttaaataatgtcaagattttgcactgaattgttcagtggaactttacattgaaagtctcagtctgtttaagtcatgtgtctgaactctagagagtgaaattgtttaagaattacataaataccccatgtgtgcacatgcacgtaattacatttgtaaaaataaagacacatatgcatatatacatatgtgcataattgtatatataaacctcaccagaacaacagatatatttctggaaaatagtttataaatttcacatttctaaattgggtagtaattccatcaaactagaacaattgcaaattaacaggtttttaataagtaaataatgccatctagtttatgttttgggtaaattttaatagaagtttgaaaaggattcattaaggtatataataagttatttgagtttgcattcattggtgttttattaaggcaaagatattgaggtaattcaagccattgagggttttccctgagaaaaggaattagaggagagcccttaggtttagagttttaaattaaaaaaagatctaatgaaagttcattgctgaaaagttgatttttatttggtgtttgagtttatatcagtgattaaagtacatttgtgatttctgcataagctgtgtctttacacagttcattctgcctgccttcctcttccagaaatgtttcctgccatattctgcttttattgtgctattagtatttttttgttctaaaagcaaagaacgcacctgctaggcagagttgctaattttatccctgaactcactcatagatgccacaagcacttcccagtcgatacggttccatgtatcaggcaccttctatagtcccattctagggtcaccgctgttgttgtatttatcatcactgcccagcatctttaccctgcgtcaagaatcctatgcactgcacgttcctccatagaaccttgccccattcattcctcttgtcataacactccaggatataagtgaattcagactttctacaaacccttttgttctaaataatctcataaaactactacagccatactgttgtagcattaagtgagttaagggtgtgtgtctgttgttgttgtcgttcctgttgttgcatctgaatctgttggaaacaaagggaggatggtaagactgaatagttcatgcaaggggcatggcccctactgcagagttcctgctctagattgtgtgtgtgtgtgtgtgcatgtgtgtgtgtgtgtgtgtgtgtgtgtgtgtgtgtatgtatgtatgtatgtttgagtaataaaggtccacatcccaaatctgacatttttttttagatacgcaatctcacatgttggggagtaaaaaaatgactacacagttcaatattaaaggactattaatgcctccaaattggtgagatattctgcacatttgaaagggaatagggatgttcatcaaaggatgagagaaaaggcagagattaataattttgaatagttataaaatcctttagaagtaaattttatgtatcaacttagttactaaaacatatttagaacataactaaaagataagcaggaatttggagttgctacgcaaaatgcagaatgcccaattaaatttgattttcaaatatgcaaaggaaaattttttagtattaatgtgtcccacatattgcatactgcatacttattcaaaggagtactttattcatcagttctggagattctaattgtacataacctatataataacttctaaatttcccgacagaatcgtttcaaaacatttttgattgttccttcaccttacaaaaaaatccctgattttaaaaaagtcaccctttaataaacttttgtgtagaaaggtaatgttggtcaaagcaactctatagagatagatgatatttataaatttcctgtcttaccttttagaatttctgtagtatattcttttagagaaaagtaacacataactgttaagtggtgatgtttttggtgattgtattgttattcatggtttaatcacagctatattacctaacttacttttacttagaatttagcaaaagtataataaaataatattagttttataaagtatttttcttccagactgaatattttttactctcttatacatcgtttgaagacacagttttttttattatactttaagttctggggtacatatgcataatgtgcaggttcgttacataggtatacacgtgtcatggtggtttgctgcactcatcagcccatcattcacgttaggtatttctcctaatgctctccctcccctagccccccaccccttgacaggtgctggtgtgtgatgtccccttccctgtgtccatgtattctcactgttaaactcccacttatgagtgagaccatgcggtgtttggtttactgttcttgtgttagtttgctgagaatcatggtttccagctttttccatgtccctgcaaaggacatgaactcatccttttttaaggctgcgtagtatcccatgttgtgtctgtgccacattttctgtatccagtctatcattgatgggtatttgggctggttccaagtctttgctattgtgaatcgtgctgcagtaaacatatgtgtgcatgtgtctttatggtaaaatgatttataatcctttgggtatatacccagtaatataatggctaggtcaaatggtacttctagttccacattcttaaggaatcaccacactgtcttccacaatggttgaactaatttacactcccaccaacagtgtaaagcgttcgtatttctccacgtcctctccagcatctgttgtttcttgactttaatgatcgccattctaactggtgtaagatggtatctcattgtggttttcatttgcatttctctaatgaccagtgatgatgagcattctttcatatgtttttttggccacaaaatgtattctttagagaagtgtctgttcacatcctttgcccactttttgatggggttgtttttgttttcttgtaaatttgattaagttctttgtagattctggatattagccctttgtcagacggatagactgcaaaaattttctcccattctgtaggttgcctgttcactttgctgatagtttcttttgctgtgcagtagctctttagtttaattatatcccatttgtctattttggcttttgttgtcattgtttttggtgttttagtcatgaagtctttgcccatgcctacatcctgaatggtattgcctaggttttcttctagggtttttatggttttaggttttaggtttaagtctttaatccattttgagttaatttttgtataaggtgtaaggaagggatctagtttcagctttctgcatatggctagccagtttccccaatactatttattaaatagagaatcctttccctattgcttgtttttgtcacgttttttaaagatcagatggttcttgatgtgtggtattatttctgaggtctctgttctgctccatcggtctatatatctgttgtggtactagtaccgtgctgttttggttactgtagccttgtagtatagtttgaagtaaggtagagtgatgtctccagctttttctttttgcttaggattgtcttggctaggtgggctcttttttttgtttccaaatgaaattaaagtagttttgtttttgccaattctgtgaagaaagtcagccgtagtttgatggggatagcattgaatctataaattacttcgggcaatgttgccattttcacggtattacttttatcctatccatgagcatggaatggctttccatttgtttgtgtcctctttgatttccttgagcagtggtttgtagttctccttgaagaggtccttcacatcccttgtaagtcggattcctaggcattttattatctttgtagcaattgtgaatgggagttcattcatgatttggctctctgttttttgttgttgttgttgttattggtgtataggaaggcttgtgatttttgcacattgactttgtatcctgagactttgctgaagttgcttatcagcttaaggagattttgggttcagatgatggggttttctaaatacacaatcacgtcatctgcaaacagagagaatttgacttcctcttttcctaattgaataccctttatttctttgtcttatctgattgccctagccagaatttccttaagcccatcctctatgcaagatgctggggtaaattgcagaaaaaattgttggagtggaaattgctttcagtatcataaatatgtatgtatgtttacaaatagaaatatggaacccaatgtgctgttaactattaagacttcgtctcttttttaccaggcatatacattttcggaactaggaaaacaatagaaatacttgcacttttaagtttgaatgtggtcaaacctggggcattttattgtagaaagtaaattgattttttcccttcatttaaagaatgcattagtgaagaaagaatccttgctgtttgtgtatgttataaaggaacaaaagctggagaattaaattatctgcatagctgagcaaaaaatagtttttctgtgtttgataagagtcagatattcttaatagaattcttagatttcgtgagcagaatggggaccatgcatggcattgaaattttccgcagacacaaaataacttgtattacagctgaactatagctctttggggacttgtttctttttattcatagaggttaagaatggtgcattatattatccatttaaagatgctacttgcatttctgaacttcaaatacaatcatgattttaatattatcaagtaaatatattttaatatggctacacagaaatgatttcattaacatttatagaacccttggtatcagtagctctgtagtattttaccaagtggaagcgttatatttcattgtatatttcttgtgttcctctataaatcacctgtgcatatacatcccagaaaaaatgagtatagcaagctacatagcattgaattaagctttaattttcactggctgcttacagaagaaaataacttgtatagcatttagaattttgagtaggaccatcctcatcatctcatgctgtgtattacaaaaggagtctacctaatgaagcatagggtctggatggtttaacttattttttggataagagaaagaagaaagaaaataatacttagttgctgccttccaaggattctgtgccatgctggttttttaacatgcattatcttaagaatatttctcatttaaatatagattttattatacatttttaaagacaaagaaatgaaggttcacagttacagcgaatagcctaaggtcacaccaaggaataacgaggttcaagccaaaagccaagtaccttttaatttacaaatcccatgttcaccatattctgcctaattgaaaagggattatcatttgtttgatggaaatataattatacatactattaatatatcaaaccacttagcctgtttgaacttcagctcatgtggaaaaaaaaaaaaccttgaagctgtctaacttctagagactatttttggtaatgtaaagcactattgagagtgcttaaacgtaagggttgtggtgttggaaagctagcatttgaatatgcgctctagtattaattactctttttatgccttcgttttctcattggtaaactagagctaataatagtacctaacttaggagtgtgttaggaatgaacaagatgatgtaaaacactttttgtgacgtgtaataaatgttcaataaatatttgctagctgatttgtataggaaattttatttgtaatagcagaggaaaggaaagagcattagagaagaagctgaataaaagagagtgaaatagaataactcttggagtttcgcaattacatagtgaaagtctgtagtgggagaacttatttttttaagacattttacataaaatctgagtaacagcagcagaactcctctaaatctagctcacagaggcaatggtgaggccatccttcccacctcttcatggaatctagagccttccagtactctgaagataggcaacttgagaccaccaagagagcagaatagttgacatctttctttagtggtggcattgatgaggctccttcaacattcgagcaggccatgaatgtttgccaggggaatgagaggaagaacaggaaacagagtgaaccccaaagtctgttttatggcctgtatagtttcaagagcctcacatactccccaaaatgtctaggatgatgttgcaaggagtaataaacaaaaagaaagatcaggaattttttatttatcatttataacatggtatatcatcatctctttatcctgggaagatctaaaagcatttgatagattttaatatttatgttatgtttatacacaaatttacataaatagatatacttgactcatgatctctttattcttcatattcatgaattattcctttccctgccaaaaaaatgtctaatatattgggaaaggaaattgtattaagcaaaggtttatctaaatgacagaaccattgatttccatatattatttttatgttgttagaaataaagaggagagtatatccttagaacaagaatataaatttatttcccaaaataatcaaaaaattattacttttcagctttcgactttagtcatctaatttaaaaaaaagtttggaagattttcttagagaaatgttttcgagatgtgtttgctttcatacttggtatcttacaatttgatagtctattgtaatcactaatatgtctcatattttcttttgttctttctttagttgtgaactcttaggtcagcaataatatcgtgtatccctttgaaccccttaacaattcctgttggagtactgtgcccaaggaaacctctttaaatattaaaaattgataaagatactttccaatttttcttttctcttcttcctagacttcggcatgttaaatcgatgactacttctaacaattctctccttctttattgaagcaacctctcttggcttcaataatattctagcttcttctttgtctcctactcctctgctactcctcagtatcctgaatgagctcgtcttcctctctccacctctggtcagacccttgtctggatgttgacattaatcaccttcttttcatgctgctcccatgcagtcccataagacaactaaccttaacacatcctgcctagtctcatcagcttcaacctctgcctcatccttcatcagtgtattctctatctcaaactacatgcagctcttagaaattgtaataaatctcttaccctcagcatccacagaattaatattgcaaccagcttttgtatgggggtaaggatagagctctcaatatttttaagtaatttgttttaaatagtttaagttctctaactctaaggacataatatattccaagaatatgttagtagaatgcctaaaattgtgttttggatagtcattcattcaacagtgttttaaaacgaaagtattttatgttcaagcattatgctaagtgcagtgtgtgctggagaaaatagaaaatgtttaagatatagtttcatactcaaggagtataccaggggagcaactaagtgaatcaactatgctttcattttctttctttcttttttatttagtagcgttggtgaaattacaattgggcattcagtattccaattgtttttccttttgctttttactctatagaatcggaacccacaaattgtatattgtatatacagtatattttatttgctattttcagatgttttgccaattatttttctgtccttttgtaataatgcttgcaaacctgtagtatttgtagtttcattttttaaccttgctatatctgttgatttgaactttcaagagaatatgttaatccaagattgttactattcttttaaacaaattaaggaaagtcttatatacagtatagattaataatgatcacagacacattgtttctatttaaaatgtcataataaattttcaaaagagttgtacctgcttatagaaagaaaagcgtagggaagttattgctaggagttacgagtgtgcactaccaataaaattctatcagtaatataaaaaaagataaaaaataagagtatagtatttccattgtgtcttttggatggggaagagatgtgtttgcatgtgtgtgtgtttgttcagttttgattgtttaaattttttaattaaacaggtgttccgaatcaagcattttttaatcaacactttttaagccacatttgtgtaattaaatggaggtaaatcagaggtaacatatggatgtctccataatctgtttcaaaaaatgaattatagcaagatgatagaaaaatgtaataccaaaatccaggtcaggtgttcttcaaatgcatatagagggaaaaagtaccataacttacatggcacataaatactttaaatattattctgaacagaatgcttatcaaaaatattcagaatgatacacaattaaaaccttattattcaaagaagattatagttagagaaagtgatttaagttgcatagatccaactcagccatgacaatacttagcacccccctaaaaccttaccacttcgtcctgcaggcgtttcattgcgaatttcaactcaggtttacttcctacattttaattataaattgcctcattctgaaatgccaaactttgctgaagaatatcatataactctccttaatagaattctacttggtcatgccaatacgctctaattggaaccttacacatcttcaggaattatttatttctttttaataacctcactctttatgattgttattctaagccttttgcattgccttctattatgtgttcactaatacatttgttaaaccaaaaatatttgttaatcactcactgtgtcagacactgttctttgcacagtggcaagaaaagcattaaaaatgcactttttgactaacttgttcataatatatattgttatcctacaaatttgtcttagcagcagcataacagatcctgttttcagagattttaattcagtccatctggaagagggtctaggaaaagttcctgagtgattctgatatatggccaatttgggaaccaaatatagacaagtaaaacatgtttgaaacttgaaaaagacacttgggaaacatcagcttggagatgcttcttgtggctctgtgaaagggaaggaaaaactgaaagacagtttaaaggaaaaataaactatgttaggagcacacatctaaattggtcagaaacttgagaagaacagaatatgaggatggtaatctatagcatcaaatgctatagttagcaagatgagagaaaaaaattttagtctctatttactgacatcttactatgtaccaaacactttgctaagtgtcacaaacaccatatttaactctaaaataccacagctaaataggaaaataaagttcatagactttaagtaacttttagaacttaaaggtcctgtagtagtaaggccaggtttcaattctatctactgtactttcaatgtatttattatttgagcattattctcctcaaggattttcaccggtaatagaaagggcttttatattcaagataaagaaaaaatgatagagtgatgttccaagaaaaagtaaggaataatattaagaccataacagagagcgggtgtggtgtctcacgcctgtaattccagcactttgggaggccgaagcaggtggatcacttgaggccaggagttcgagaccacctggacaacattaatgaaaccccatctctagtaagaatacaaaaattagctgggtgtggtggcacacacttctagtcccagctactcaggaggctgatgcatgaaaatcatctgaaccccagagataaaaggttgcagtgagctgagatcacgccactgtactcctgcttgggcgagagaatgagactttgtcgggaaaaagaaaatggaacatagtaacataatagaggatcttatttaagaaggccactctttccttaggagcttatgtgaggatatatgtgtaaaaatgttttcataggagtaaaatgtatgcaaatttaatatatgctttctataaaataatacagtgaagaggaaacaaaggatgaagatgaagcaagattttgaggcaatgaattagaaattcaactaaggtaggattaaggggaaatttatagcactaaatgcttacatcaaaaagttacaaagatctcaaattaacaacctaacttcacaactgaaagaattagagatgcaagaacaaatcaacctcaaagctaccagaacacaagaaataacaaaaatccgagctgaactgaaggaaatcgagacacaaaacttcaagagatcaacaaattcgtgagttgttttttgaaaaaaataataggccactagctaaactaattgaaaagaaaagagagactatctaaataaacacatttagaaatgacaaaggaaatgttattactgaccctacagaaataaaagcacccatcagaaactactatgaacacctctacacacacaaactagaaaacctagaagatattgataaattactggacacatacactctcctaagactgagctaggtagaaatcaattccctgaatagacccaataacaagttgcaaaattagtaataaatagcctaccgacaacaacaaaaaaaaccctgggacctgatgagttcatagctgaattctaccagatgtacaaagaagatctggtactatagaaactatttcaaaaaattgaggaggagggactcctccactctatctatgaggccagcatcatcttgctaccaaaacctggcagagccatagcaacaacaacaaagaaagacttcaggccaatatccttggtaaacttcaatgcaaaaatcctcaacaaaatacttgcaaaccaaatctagcagcaccataatcaagtaggcttccccctaggatgcaaagttggctcaacatatttaaatcagtaaatatgattcattacataaacagaactaaagacaaaaaacacatgattatttcaatagatgtagaaaatgcttttgataaaattcatcatcacttcatgttaaaaactctcaataaactaggtattgaaagaacgtaactcaaaaagccttctatgacaaacccctggccaacattatactgaatgggcaaaagttggaagcattccccttgaaaatctgtacaagacaaggatgccctctcttaccactcctattcaacatagtattggacatcctagacagatcaatcaggcaagacaaataaaggaatcgaaatgggaagagaggaagccaaactatttcattttgcaggtgacatgattctatagcaggaaaacccagtagtcttggacaaaagctccttcagtggataaacttcagcaaagttgcaagataaaaaatgaatgtgctgaagttattaacattcctatataccaacaaaaccaaaaggcaaaccaaagggcatatcagagaagcaatcccattcacaattgccacaaaaagaatgaaatacttaggtatacatctaaccagggtgaaagatctctacaacgagaattaaaatagactcctcaaagaagacaaaaacaaatggaaaaacatcctattttcatggaaaggaataatcagtatcattaaaatggccgtactgcccaaagcaatttacagattcaatgctactcctgtcaaattaccatcagaattcttcacagaactagagaaaattattttaaaattcatatggaaccaaaaagagcccgagtagccaacgccttcctaagcaaaagggacaaagcttttggcatcatgctattctacttcaaaatagactacaaggctacagtaatcaaaacaacatggtagtggtggaaaaacaggcacatagagcaacagaataaatagaccagaaataaggccacacatatatgtccatctgatcttttacaaaactgacaaaaacaagcaatggggaaaagaccccctattgaataaatggtgcttggatgactggctagccatatgcagaagatggaagctggaccccttccttacaccatatacagaagtcaactctagttggattaaagacttaaatgtaaaaccccaagctataaaaaccctggaagacaacctaggcagtaccatcctgggcataggaaccaacaaagatttcatgatgaagacaccaaaagcaatcgtaacaaaagtaaaaattgacaagcgggatctacttaaacttaagagtttctgcaaaacaaaagaaactatcaacagagtaaatagacaacctacagaatgggaggaaatatttctaaactatgcctctgacaaaggtccaatatccagcattgataaggaacttgaacacatttacaaaagaaaaacatacaaccccatttaaaaagtgggcaaacaacatgaacaaacacttctcaaaggaagacatacatgtagccaacaaacatatggaaaaaagctcaatgtcactgatagttagataaatgcaaatcaaaaccacaatgagatagcatctcgcacctgtcagaatggctattcttaaaaagctaataacagatgctggtggggttgctgagaaaaggggacacttgtacactgttggtgggaatgtaaattagttcacccattgtgggaaagcagtatagcaattcctgaaagagctaaaagtggaactatcattcaatccagcaatcccattactgatatataccatgacaaatataaatcattaatccataaagatatatgcatgtgaatgttcactgcagtattattgaaagtagcaaagatgtggaatcaacctaaatttccatcagtgacagattacataaagaaaatgtggtacatatacactgtggaatgctatgcagccataacaaggaatgagatcatgtcttttgcaggaatgggaatggagctggaggcaattattcttagaaaatgaatgcaggacagaaaaccaaataccacttgttctcacttgtgagtgggagctaaatgatgagaacttatgaacacaaagacgaaaatagacactggggtctacttcttggggagggtgaaaggagggagaggagcagaaaacataactactgggtactgtgcttaatacctgggtaattaaataatatctacaacaaatccctgtgacacaagttttcctatataaccttcacatgtaccccccaaacctaaaataaaagttaaacaaaaataatttaaggaagttctagtcaaccctaatcttctaaaaaatacaaggtacagtcaaattgctaagatttgtcagagaattttgctagagtattctgggtgttcctggtaagaccctgtcttttactgagcccacaactctccccatatggggagatatagcccatatgggttatatattatgtatatggggcctccactcccaaccccatatacataatgtatacctcaactctccgggaatcccagtcgtgtcatcaatcatccttgcactctcatttcctcagacacttatttccattgtcacttcatagatgttgtcattaccaataagttaaaccagtttccaacaacactatttttttttcagctcatgcactctagtgtttcaacaccagctatatttagactccatggggatctacaatctactgttcctaacatgttttctctttacctattgttatttctatgctcatacttactcccttaattaggaattctatgacctggtatataattgattctgtgcatattcctcaactcccttcctcccttcctccctttattatcgattccactttgggaaaaaaaaatccacattagccaaacttgtatttcttccatggttcctctcggacaaatgtacatggctggagaaaaaaattagaccatgctgcctggtctcattaaatgtaagatccctactgcaagtggccctttagtgtttctaggcaagcacactatattcccctagtacttttcatctcccattctcctatatgatcatttaatgcctttgcatctctactccaacctccagatgactctgcttcctatttccctgataaaatagaaaccaacgtagacaattttaataaacttctaccaccacacctatcttgcatttatactctgttttatttttctccaaagcatttactgccatctaatatgttacatattttccttaagaatttggtttattgtgcattcttccccctcctctgccactgtaagtttgaaaataacaatgttattttctattttgttatttttgtctttgcagtacctgcagcaatgcctgataagtaaaggatgcagtaaattgtgtgtgtgtatgtgtgtgtgcatgcgtgtgcatgcgcacgcgtgtgtgttttgtttaaataatgttatgggatagatcttataatcttccttttacaaatgatgaaactgaggctcagataattttagtcacattctaagggccagttagcaatcaaatagtggagccagaattccagcccaagtcagtctaatctaaagcttaagcatgtaccaaattaagtttaaactattcattctactagtctgaattcttgggtttgtgtctcagaatatcttcccaggcttatcttgttctaccttattacacacacgtactcttcaatcaaactagaaacttcctgtctttcagcatgtccctagctggtcctgcacagtcattcatgtgaacaggctcctcttcagtgcctggagcatgttccgtcttatgcctattgaaatcctgcttgttcttcaggatctatatactctctctttgtttttttctaagacatttcaagtgggattttctgttctctgcttttaactcttaccaatgtcacacatctatcttagagcacttatttaaattacaaagtggagagagacgttgtatccatgtctcaagttcttccagactccctggcagatcatcagctcctttgagtatgtgttcatttttatatattccatatagcaacaccactacacgattttcacttgacaattataacagtcttggagtgctcaatgccaaacattgttctaagccattacatatgttaattaattcaatcctcaaaatcctgtgaggacaggtactattattatccccaaatttagaatgagaaagcgaagaacagaaaacttgtcaaagtcacacagttagtgattatttgaactgagacttgaatccagacagcctggttccagaggacttgactaagagatactaccttttagttatcggtaaatgcaccataaatattggttgaattcaggaagctgaataacagtatctgacaaaaaaaaattacaaaaacacagcaggaagactaaaggagtgaatgtccccttgtgttatctggctgtttgatgacaaaagtaggttactatactacaagctgttatatatgttgcctattaagaaaaaaatgtaaaggactcagtaaggctaattgtatgatatcaaaacagaatttacatttcacatcacaagataaaagattttttgcgccaatgctaagttttctaaactttgcttttgagattaagtagaagacttgattgtttagaaataaactgtaagtctattgtgaagtctcaaaatggcccagcaaaagggaaaatacatctgaattttctagttgtgtaattatctgtgtaattagatgtgaaacttctctttcacagtcttccctcatcatctgggatggcctcaggaaacagttatcatcctcccttcagacttacatgagatgcactgggatttttataagacactgtttaaacttcaagaataaaaagcaacaatgagataaagtgaaattatgcgtaggtatggattttttgtttttgaaaggagaaggtagatataatttgaaaactatgatagagagcgattttcaaagtatctctatgaagatactatttttaacttttcacaaagagaaattttcttccattaattatattaaatttttattttaataatttttatatatatgcattgtaggcaaagttttgatccaatacagaagtgttttataaaaatcatcatgagttaagtaaatattcagcattttaatctttgccttgcctttgtaacgttttcttctcttaattccttggaagaatgaagaaaggaatatgtgtgttaaaaactaaatatgtttagtaaatctaaattcattacttcaaaaaagatattatttttatatttcgtaaacatatgtattcttagaacagattcctgtagtgtatctgcatgtccttcaggctctgctgttgaacattttcctttcaggtcattagttgtgccctgctcttctgccattttgaatggtccagtggtaaatttgtaccagctttattaaacacaagcaatacactgcagattttgatgaccaggctttctgtaatgtggccttttaaatctgagggctcagaggcattctccaaatcctctccattagtctttttaaagatacaagctacttcagaatagccaaataagaatattattattagaatattgtcatgcaagtcttacttatttggctattctgaagtagccaactctaaggcacactccatgagcctcaaggaaatgagaagttctctttaagtataattccctcttggatatgatgtcagtggtatctcctctccctctatctctggggccacatccaccatcacttatgactacacttaggagaactgaagaggaaacctacatcctccccaaagagtcctaagacagtagcgagcagtggaaacagaacaggaagttacttgtctgggagatctgatgtgtagtctgtgctttttgtatgtgtgccagagtaaaaagcaattaatagcaaagtattttataaaagctttttctgtaatctatggctctgttatgtttaccccattgttgctttatctttttttgtttagagtgtacatttagtgtctgaagcaaggagagtttgatagctcaccgaaattactacatgttttctactagcaaaacgaaatagaacaatttgcttgagaattactgtggattatttactgtaagctaaactctatgtaataataatcgctgacacttatttcttacttcaggcaatattctaagtatttttatatattatctaatttaatctaacaacaaatcctaaaaaataggaaactatcgtctccattttacatatgacaattctacaatacagcagattaagttaatttttcaagatgatacgagcagcaagtagtgaagttaagatttggacacaggctattattttagacatttaggagaatgtcagattcttccggcaggtcatataaccactgcacaataccactctccgccccatctttaagtatagtgcttttccacctcatcaaaaaatttgtgatgatatcctgtaaattctatccttaaaagaaccataaaaatatgtattagacaccgacttgaaaaaaatttacataaaagataatagaaactatcttagtctagtttttgttctacaatcaacatttgtttttataaatctctataaaattccagggcatggccgggcgcggtggctcacgcctgtaatcccagcactttgggaggccgaggctggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaattccagggcattgtgctgctattgtgtgttattagaatattgttatgaaataaacaatgataagcccgatctgtctcctaaaatctcttttgtttctgatatgacaagatagagcatgtcacaaacccaaaccttatcactaaatataattttcatagttattatattatcccatccttaattgtttcatagttgtaagcatcaaattttcctggaactctatatttcccatttccaagtagaacttaaattactattgtcctttaatgaaaaaaatcaattaagggaaggaaattacacatttttcaaacctcccaccagaaaaacaaaaacagctgtggaaaaaaatgaagagatatatgggttcactgatattgactgaaaatactcacacttagtgccatccacatacataagttaatataaaatagaacaccataaagtcattttaaaactgtcatatttattgtgtttttgcccattttaaatattagctcgtgcttatctagtactaagggcttcatatttattaacttatttaatctgcacaattatccatcactgtctctattttacataaaaaaaattgagtcacagagagtttaaatcatttgtctgaggtttcgaatgcattcagattgattacttaaccactatggtaattcgtctctgacaatcaactaaatcaatcattttattcattcaagatcaatggaatcagaagtgaaaacatttaaggactcacctgtatattagaatcagtagggaaaagtgatggatttttaaaaagaaatatgttaagagtacgttgcaaaaaatgtagatttcaatatatgtttagaaaaatatagaggagtctgatcatacatgagagagagagagggaaagacagagaaggcatagatattgagcaggaagaaaaataatgtgtacaatatttgtgagtgacttgaggtattttaaaggataaatcttaaggccttgatattagaactcaaaccatgcaaatattgcaactctggtaaattccagcttaaattaaccaaatatactatattctgagagaatcattaaacggtaacaaagacaagagtagctctttgttgttgttgttttagcagttactgatgataatatttaaatatactcaatgtttctaaatttttcagggtctatctaactgaatgaaggtgctttttagaaataaatagataacgatctgctgtcaaaggtattgctttcctttattagcagcctcatagtgatgtagaacaaagttgtcgggatagaaacctgcttaggttgcttgttctcctcagatggtaaccccaggaagggtagatgagacagttcaccctaaaagacggtgagtagtgaccatgagtcaccaaaattggagttggccttggatgtcagctttgctgaaggggagcaaaaagtctgaggtctgaggagttaaaaaaaacagtcagcagtcactggtcacttccagcaggtgagaaaggaaagaagcattttgagcatacagtagagccagagctaacctcataacttaggaacacaggttaaggagcatccaggtatgttgtacacctcaaggtacaacataacttttcatcttaatgagcataggttcttgagccataccatctggatcttcagtagagtgatttcaacattaataggagcatgtcctctggggtgctaagtaagggaggttcaacggtgaacaagacctcttcctgctcctcaaagaatctctattgcagtagaaagataggcatctttatgtctttacataaaatgaagatgaaagagttataaataaggtataacattcacgtgggtatttagaaggatgagataaattccatttgggggaaaagtgggtgatgggggtgccttcagagaaggcatagatattgggcaggaaggaaaattcaatgctcactattaaactgacataacatttttttacctttaggtttgtgggcacatgttaaggtttgttatataggtaaactcatgtcacgggggttcgttgtacggattatttcatcacccatgcattaagcctagtacccaatagttatttttttctgctcctctcctcccatcctgcaccctcaagtaggccccagtgtctgttgttcccttctttgtaacacattattttgaattagtatagctatctgtatgcttcttcactcaagctattagaaactagagggctggttctagatctttaaggaatcatcacatggtcttccacaatggtagaagtaattcacagtggcggagacaaggaaccaacccaatgtctatcagtgatagactggataaagaaaatatggtacatacacaccatggaatactatgcagccataaaaaggagtgagatcatgtcctgtgcagggacatggatggagctggaagccattatcctcagcaaactaacacaggaacaaaaaacaaacactgcatgttctcacttataagtgggagctgaacaatgagaacacatggacacggggaggggaacaacacacattggggcctgtgggggtggtggtggtacagagagggagagcattaggaaaaataggtaattcatgctgggcttaatacctaggtgatgggttgagaggttaacgtgtgccatagtggtttgctgcacctgtgtaacaaagctgtacaccctgcacatgtatcccagaagtaaaagttgaatttaattaaatgagagggctaagatccctccttgttcccatgcactccccacacctagcacatacctgccatccagtacttacttatattgtgaataactattaattaaacagaattaaatatgacctagctgctgtgttctattccctagaaggaggcagaattctgctggaactggcttctgattctagcagagcagggctggattctctagaagaaagggtgtgataatgcagaagcatctaagtagtaacagtaaacctaaaatgcaaacatcacttttacctgattggttttactttacaaagagaagacggagagaatactatattaacttcgtaaataaagatctgttcaagactatattggatgaaaaccatcaaagataaacacctcaatattttatgccatcttagggctgccggttatctactattagacatttacaaaatcattcaatgagtattggtaatacttgtagaagcaagtttatggttatgtttggggcattgagatttttaatgttacttcttttgaattgataaatggttatattattgtttaattataatctgttcttcaataacaaatgagtattttaaaaaattattttactaatacataacatttctacatatttacggaaacgtgatgatgcatgcatacaatgtataatggtcaaatcagggtatttaggatatctatcacctcaaacatttataatttatttgtgttgggaacattttaagttttctattttgagatacacaatatattgtttttaactgtagtcactctgctgtgctagagaacactagatcctattccttctacctaagtgtatgcatgtacccattaaccaaccacacttcatcctccttttccccaccatttcccagcctctggtaactatagttgtactctctacctccatgagatagcttaggtagctcccatatatgagtagaaacacatcctcaaaacttagaaagattacaaaactagaaggggacaagcagctatataacctggaaatcagcattttttttttcttttttttttgagacggagtcttgctctgtcgcccaggctggagtgcagtggcgcgatctcggctcactgcaagctccgcttccgggttcacgccattctcctgcctcagcctcccgagtagctgggactacaggcgcccgccaccatgcctggctaattttttttttgtatttttagtagagacggggtttcactgtgttagccaggatggtcttgatctcctgacctcgtgatccacctaagagtttatcttttcttacaacttcttttatactgaaaagaagctctttagttaactctctttgtcatggagttagaagtcaagtgctattccttgttttaaagatgattgcagtcttggcatgttatcaaaatgcaaatactttacccttaaattaagcccttatttagagactcaaaattccctggagagaggaggatagcagtgctatatcagaaatatatttttttaacatacagagttgactgaagttgtttttattaaaaatgggcatttctaatcctgtccacaccaccatcctcagtatctcacctccaatttaatgacaatttcattctgaccttaggtgaagtccttctttctaagaaatatgttctgtaatcccccagactagagtagatgccttagaactttctatactcccttagttacttaaatatatcttaagggctagactgcaaattggcaccacatcacttctcccacattctgttgttaagtatagcacaaggctagcccagattcaaaggagaaaaactccttctcttgaggggaagggacatatgcatgctagaacaataggaggaattattggtgtccatatttagatataatgtatataaatgcccatttgagattagaatcataattttaatgtcagcatagtctttgtaattttcccactttttttatttactaggatgtagatacaaagaagacaaatagttgaattcatccagcatttgagtttcatcaggcaaggtaaacaagtcctgataggcaaaggatttaaaaggtttatgcaaagaagttgttagacgcagagccaaggaaagaaaggagatagtgaataatgaaaaactgcatttgaggttgttttaaagaattaatggaatggaagtaatagagttagtgagctggaatgatatcaggggtgatgagaggtcagattatagaactgtgtagttattactgataataagtttagaagggagaacatggaagcagaaatacattttaaaaacaaggctcagtataataactgagtacttgtataataactcagtataataactgagtactcagtataataactgagtacattgtacagttctaaaaataagccttaaatttagaacaaagacagtgatcatcgtaagctgaaatggaatggaaatattccatgagagaggtgagaattgagtggaatattggagacaggtaaagcatcagctaaagaaggatgctggagaaggcctggcggacttggcagcaccatttgcatagagtgcttcagcttagcgcttaagcccatgttgagcttccacactgtccaataaggagtttagggtttgatttatgtaaagtgggaatcactgaaaacattttagtaagaaagggatgttattaaaataatagaggaagattaactgacatgaggaatagtatgaaagattagtgggactgaaagcgaccagttaagatgctggtggaataacccattgtgatgaagcatttttaaaaacatgcatgtattagatgtatagaaataaaagatatgccttttattgacatctttgattggtgtgtcaggcataaaaaaagcagagggctcttaggaattttttcagcgtatgatgaaaagcatgtgatctgctggtgaccctggaacagtgaaagtccttggccgggcgcggtggctcacgcctgtcatccctgcattttgggaggccgaggtgcatggatcacaaggtcaggagttcgagacaagcccggtcaagatggtgaaacctcgtctctactaagaatacaaaaaaagccgagcatggtgaggggtgcctgtaatcccatctacttgggaggctgaggcagagaactgcttgaacctgggaggcggaggttgcagtgagccgagatcgtgccactgcactccagcctgagcgacagagagagattctgtctcaaaaaaaaaaaaaaaaagccttaatgtggccattttctggggcgcctcctgctggtttcactatgtctcattgctcatgatgttttctccacaaagttcttgaaggctgtttagaacatggtttggaagctagttgagcaaaaatgaaaagataactgggagggtctatggaaactgaataaaggtggtagctatggcagtaactttgccctcttcaaccaagtgttgtttgtctccacaattgcttttctaatatgggtattatccccaaaatacttaatggtgggcattgtctccaaaatacttgtttttaaagatgcaaggtgctgtagttgtattgaacctgtgagaatcaaatcagcctgctggtgctaactctgatggagggcggtgaggggacagaggtcataataacacagtcgccaattaagtgcttacaaattctggtttattatgaggctttcacacaccaacaatcatgcaaatatgtttaacacacaagcagtgataaaaaggagcgagtagctccagagaccagcctactgacttatgaactggcaggtccagttttcctaagagagccagttcacccaggagaagggcctcactgctttttttccccagcagagctctggcacctgcagctgaaggaaggaggccccagagttctcaccagcagaaatgctataggcttcttactgtggtcagcttctttgtggtgtttggagtcttccaaagaagtatacatggccactatcttcagctgccttttaggagagaattttatgagtacatagtagatgtatacatttatggggtacgtgagaaattttgatatgggcatacactgcgtaataatcatatcagagtcaatggagtatccatcaccttaaacatttatccttccattgtgttataaacaatccaattatattcttactgtaacatgtgcaataaattattgttgactgtagtcaccctgttgggctgtcaaatactagatcttattcattctatctaactgtattttgtaagcattagcaatcctatcacttcactttcttgtcaggcctcagaggtacctggccatgttaggtgtcatcgtatcatctcaggccaccataagtgtttttatcactcagaggggtcagcaatttcactgaagctgagtcatttgtcataagtgactccattttgagacattcaggattacaaaacattattatatatcatactgattttacaactcacattactagattcttaatttgcctcaaaaacagacttctaaaaggcattgattttgttttccatacgtagtcgtttttgatgatccccagccaaagagggtgtgtccctatttacattgttgattattacactgattttttttttttttgcctgcttcctactggaagggaataatccctaattcctacatccagttgctgggtccggggaaaagctacctatacaatagtctctttaaaagttgggtaaccccgtgaaaccccgtctctactaaaaatacaaaaaattagcccggtgcagtggcaggcgcctgtagtcccagctactagggaggctgaggcaagagaatggcgtgaagccgggaggcggagcttgcagtgagccgagatagcaccactgcagtccgccctgggggaaagagcgagactccgtctcaaaacaaaaacaaaaacaaaagttctgtaacccactgtgttataatagaaagtgaattaagaagtcaacatcttaggttcatttatttttttctacatgtattattcgtacctactatgtactaggcattgttgtaagatcctgtccttatggagcttaccttttagaagagattacgttctaaggtgtgttagttaaacaaattatctcctgaaaatcccaatgaaggatttttatcagaattcaccttcctgtaaaacataaagtaaattatgtcccagttcctccagttgtcttgagtttaactcctctactttgatattttcttacatattttctcaatagtaaaacttgaggtacaaaattttaaaaagtagaaggtatatgtttattttgtacagcaacacatagactatttcaccaattttggttaaaatttcctatgaatgctgtggaccataagaagattgaacaatgaagattgaatttattgactcactattttttgatcaggagatcaaaattgtttgatacctactatgtgttagaattgatactgaataaaaacaattaaatattattttagtagaataagccaaatttctggataaacgggaagcctactgaaatagcttcttccttcctctcatctttactgaggtataattgacaaacagacgttatatacgtttaagttgtacaacttgatgtattgatatataccttgtgtatcaccagaaactaacatattcatcacctcatacggttaccatcgtttgtgtgtgtagagaacataaaatccacctgctgagtggatttcaggtatacaatacggtattgttaactacagtcacgttgctgtactttagatttccagatcttgcaaaactgaaactttgtacaccttgaccaccgtctcctcattcatcctcccccagcccctgacaaccaccgttctgctctgcttctacgaactgaatagctcctcttgatttctttttctttctcttttttttctctctttctttttctttctctttctctgtccctctctctctttctttttcatatttaagtgctgaaattacgagattggtagatttaagatttcttttgagcgtgggacaaaacacagacacttgaatagatggaaagcagaactctattacttgcagctttcaacaaagttgcagggctagacagaggttgcacctatgaacagtgtaacagcaagcttatctgtggtaagcagggtggggttagctaggtttctcagacttactgtggattggctaatttgaataattttgacaggatctggagcctaggagctgttccttttagtgtggaacctaggcctggggcaatgagggctggtgtagaggagcccagaatgtaagggtctgatgaagaaggggttggagtgtgaacttcatcagctgcccaagaaggggaacagattggcctccagtcaaggcctcaaaatggggtcaaaacagcatttttaaacagctgtgttagacgattgtatctaatgtgtttaatctatctctgtaacatatagttttcttacatccaagatctagcaggggtaaatgtattacttgtttcaagctcaggaaacaataccagttaaccatgtatgtgagatcataattatcgaagtgtgaaattaatagtagaaggatacattgacggtgatatttataccaaaaattttaaatatactgcagtaggcctatctatatgtatctatatctataaaatagagacaatacctactcaaagtaattatgtattaaataagatacagtcttatttatatataaaatatagccttgtatacagttctttctatcacctttcacaataaacagatggatcagctgtggggaattacaaagtttgtgatcacttacaccaaaatacataagaaaatcataaaagcctgggaaattaaggaattaaacagcagtgttcccaagcacagtgaacttagcaagtctcatattttgactaataatgccttctgtcgtcaagtttcagaatagtctccacgttttgccctctttttttacttttgtcaaagggaaaaaactctttaaccaccctgtaacacacatgcacacacacacaaacacacacacacacacacgcacacgcacacacagtctttcaataaacctttcaaagtccaactcaagttgtgctcttaccatgaatttctttaccaccttctcaatcaacttactctaaataacttatcatattcttcgtatttattgttctcctgaagctcctgtaattatcttccagtttaaacgttcttatagtccaaggtggaatacaagtgttacattactgttgataaaaaatatataaccatgaagcaatacaacatcttctttctgaccagtgaattaagaagattagaactacattccaggtagtttgaaaaagtggatagatatctagactcagaatcagaatttatttcttggtgtctgctttttcaatttctttatttctggtctctgttttgcagtttattagttctgaaacatagggaaagcactgaaaaaataatccaagcatatgggttctaatctttggattctttccaaataactgtaatttgaatatatattttctatgaggcataatttattctatttaaaattggtgtaattccaaacttcccatttcacacaagagttatgaagataaattaatccttgaattcaaaaactatttcctgagtccctaatgtagatttgttactcgactaagccttcaggatagaacgagtacagtgttttaccaatcagaagatgcatctttttcactttttaacgtcactaaaataaaatatcataccatcggtgatgtccagtgattaccatgaactatattttcatagcataaaatctttgaaattgtgatgcatccttagtgaaatatatttatacttcttcaagtttagttgaggaaacaaagttcatagaactaaacagaaaacgtctatgcagtatcgttagagaaatactatgagatcacagaaaaggaggcacacaaattagtttagatggtcttaaggactgaattatgcctcccgacttcaaatcatatgttgacatcttaaccccaagtacctcagaatgtgactgagtttggagatagagcctttaaagtgatgattaagatgaggtcattaggatgggccctaatccagtctgactggtatcttataagagagggaagtttggatactcagacacagtgaggaggtggccacccacaagctaagcagagaggtttcagaagaaaccaaacctgtcaacatcttgatcttaaatttctagtctccagaacgatgagaaaataaacttttattgtttaagccacccagtctgtggtatttggctatagtagctctaggaaattgaaataggtggtccaagagagcttttagacaaattgatgtccagttcatttcaggataagttggaatttaccagctgaagaaataatagaaggaaagtgctgaaagcagaaaaaataacccagaaaaggcaggctataaaaatgatacattcataagacagtaacgtgtgtgtgtgtgtgtgtgtgtgtgtatgtgtgtgtagaacctggagtgtagaaagtgagcttactaaaggaagaaatgttgagtgagaaatgaagctgaagaggtattcaaatgccacaggacctggggcttgaaattcaggcaaaggaactcgtactctatcccataggcagtagagggggttttaggcatgtagaaggaatgtaaataataaggtggctttttaaaaaatgtatgtcaaaagtttttttctattgtcatgaagcaaaatattagaatcacctctagcttacgcttgttatacttatgagaataaattgtatgtgtatgtgtatgtatttgtggataagggaccagataccttacaaggcccagatgtaataaatatagacgatagattaagagttcaaacatctgagtcttctggggcctagtacccttctgtcttttattttgaccaccttgttctgtgttgctcactttgatttagactttgctgtctttatagctgttctccaaacattcctcttactgcacttaccacatagagcataattgttattcccttatgaactttaaaagtttatttataataatataaatttggaaactaaaataacctaaagctcaagttgcccgtcttaaaatatgggtagttcctttatcaagatggttcatatgaggaagtggtgaaaatgatagggttgacactcaattattaaatatataaaatctagcttttactttaaagaagtacatagtagggaaagtgtgaaatttaacttcaagacagattgtattttttcggaatcttttacacctccgatttgcctttacgttatctgaaacaaagatcaggcttaaaaaacataaatattaaaatattcatccattttgaaggaataagtaaataaaacacatctctctgaaaaattctgggattccatttgacctgaacatgtatcttattactagagaagatggaaaggtggaggggcttggagatgggagaaaaaactaaagtgctatgaatgattatacaacagtgccccctgatgggaagaatggggtctgaaattcagatgagatttcttaccaagtcaattacatgacttattcttcgtttttgcttccatttaaagagatttttgtagcgatgcatcagttttactatagaatctgacatacagtatgcactgaaaatatatgagtaaatcgaactgaagcattaagtctaggcaaggagcttttaaaaactttagctggcacaagggactaggtgtgttaaatatgaccataaccttgagttgtctgtagggtaaaatacattgatctttatatgttaagcttttggcaagtgctatttcccctactaatttacccacacttggtgataaatctatcttcgatctcaaaacattatcaaatactataatattatttcaaaattttaacagtataattagttcagatttaaataatcttgaggaagaatgatttcaattttaaagcaaaagtgtttttcaaataaccaaaagaaaatagttttgctttattttttgttattaactaggcatattaatgtggtcaataagaactgtagcttttccttctctaaaggggtgtaggaatggaaagcaatgagtactgaaaaggtaagaaaaatttgtacaatctagggtttgaattcaaaccccagagtagttgcatggaacaaatttactcatcttaataattgtcatgggtgcatggtaaataaaaggagaacttgtttgttaagaatgaggcattatcatagtattggtaatgcattctataaataagatttatgttttgagaaactcaagtaagaaagcaggaatggaattatccgtttttgaagtgaaagagaagaaatgtggagagactgtgtgtgttaggtctgcatctggctcctagggagatttgaatgaattagaaggaggcttcctttcctcttgatgtttgtagtcctgacttggtaagtagacacaggctggattgcaggccctagccacaccctcagcaggcatcaggtataattatcaacctgcaccatcagaggttgcagcaactcattcagtgatacatatttgctggatatgcatgaaacactctagtgaatttgaacatttttaactgaagaaatatggatatctagcattcattatagataatctcccttgacacccttctaaaaaattcatgaacccgtaggaagtagcatctcactgccttactgaacatggtaagtatgctgttaaatctaactatctgcttatgttttctgctcagcttaaatgctctttattttatattactactatttatttttgccaattcaaactttacctattttattgtttgcatcttgaatcccacattttctagaaacactttagctcagaatattatctttgtctttggaattctgatttcaaagtaatgtgttgtctggaacatttatgttttcttactatctaagtctgaatcagcaaggcaggtattcagtgagataaaagaataataatatcatataacattgtttaaattattgggattctaattagaacgactaacagtttgcaccaatcaaaacttacataaaccattaatttcaatattttggaatttaacattgaatggtaatgtttctttaagtagctacggaactatatttgtccaattcagttgcacctttttattctttttgtatttccaaattctgagattcagtatgttactaacacctcctgtctcataatctatttagtgtgccttaaggtaagataggctgcttaaggatgctttgaatttacaggaaagggatatctctgtggtaccagaatttatttgagaaaaaacaacttcaaatgtagttttcaaactgtgcagactgtcaccttactgacatcagtaagcaaatgttcttaaacttgtatcaagtatctgaatagtcacttacttaactgttcaatgaagttaaccactaggagacaagtttgccctaagcttaacccagacaggagatttcaccttctagagttaatttacagcttaagaacaagcccttcaaaatctttctactaattgttttactcaatttagaaagttcatttaaatgagaattcttttttatctaccttaaggcaggttaagtatttttttccattacatttacatatcatgtcttgccgctatgtttggtgttatacattattatatagacatgtgaacagttttgcataaatatgcccagtaaggttgtaagtactaatttccccctgatttcctccattaagggtgcaacattttactaacaagaagaaaagtatcttaatttcatgattcacaagtgaggaaaatcagatttttcaacactgaaaattagaatctataaaagagaaataggggaaatgtaactactaaatgttatgtgcaagcaacaacataaagattagtccatgtaattataacacaaccaatggaattcagcaagtactttactacttaaagtaggaggaagtgtaaagacggatggacagtccaagtcccagctcagtctcttgtgaatgtggataagtcagtttaaattctaagttcactgattctgtgttctctcctgcaaaaagtcagaatggcaatgcttatcatgtagaaagattggcatttaaacaattgttttgtaaattctagagtatattctaaatatgagttacatcagattgtacttaacacgtaagattttctaataagactggaatggaaagaaggaaaccttggttcagtaaccaatcatttgtgctcctttgtcaaatcatttaatatttttgaatgacagctttaagtgggattgtgtgagctttaaatagagttgtggtaagaaggaggaaaaaacaatctcttgggctttttctagctctaaaacactttaattctgtcatttatagctttgtttttaaaagcaagtcagatggtttaatatttatagattcatacactatattcaagaaagtattagagacttgtgcaagattccatgacaagtcagcagctgtgttgagataagaaatttacgctggatcctaaaatctgtcatcctgcctagcgttccttctactgaaactctctgccttgatagtaatacttctagttactataatctaattgaatctcttcatgtagatcattctagaaaatattgatatgttgggcatacttccagtcaatgttttagagcctgtgctaatgcatcagaataattagaaacacaaggcaaagcttctgccttcagaaagctcacagtctcacagaggactttacctactgacatgtttatcttagcttgtgtggctaaactcagcaacatgcaacatgctttgaatagttaaaattggacagctactctcaacattagccatgaagcacttcaaatgaagggataagaaaaattcattgctttgctcatttaacagtatgataaggaaggaggaggagagagatatatcatgttgaaagaacaatgaagaatctcaattatatcaggaatttgtacattagatgtgtcgttttaaaatcctatgcctgattatgcatacacaaataacaagtataaatcatcctcttcatacacattttttgtttaatctttaatacaaacccatgggaaagatttatcctactatcacaaatgatgaatctaatgttcagatattaggaagcataattttgctatttgtcttcctcattaaattgtgaattcctgggaggaagtgtgtaatagtagaaccaacttacttatgctgaattcactgtcccataaaaactgtgtgtcgcctgaacaagttattaaccctcctgaatctcagtttctttacctataaattgcaattacatgaagtacatataaagtcgttaagggcctgatatgtattagctaagtaatgagtgtttcttacaccatcatacatagcagagtccatgaatagactctctgtaactgtggaggagggatgtcatccagtcatactttacagggagacttctaatacaggtggcctcttagtacgtgtaaaaagtcaaacctatttagaagcccattgtaaaatcataaatgtaaataactccctaatgataaaggcaagtcatttcaatagctcagtgaaatcttaagagattcttgactaaatatagataagtattaaggtcgtccacttccacagattttctctaataatttaattcttctcatcttattacttaaacccatataacatagttattcagaagcagtaaatgttgaatagaacttaaactaaagcacaaaaatgagaaatgttttttaccctgacttttgtacccccatcaaaaccagtatgcaatgtgaaaaatttcaacccttaaaaagaaaaatttacatgttgccatattggaaatgggggagggggaagacatatacttccaaagaaggacctctgagttgattaaggccatatcaccagaatagtgcttccagaccagagcattcaggttcatttaatttctctttgtaaacaaagcaaccaattttcagttctattgcaaatatctaactgtcctctttttcacagaggagagacaagtattaactgctcttcaaaagaaagttactctgatttacagagattgtaaacctctggcccccacaaacaaacaaacaaacaaacagaaagaaaacacagagcaacaagtctcttaaggacgtaagacacctaggagatagtgttcccactaaacaatgttgggactgggccctgtggctcatgcctgtaatctcagcactttggagggtgaggcaactggatcacttgagcccaggagttagcgaccgattgggcaacatagcaaaaccccgtctctacaaaaagttaaaaaaaaaaaaaaaaaaaaaaaaaaaaaagctgggtgtagtggtagctgcctgcagttccagctactcaggggactgtgatgggaggattggttgagcccaggaggtctagactgcagtgagcagtgattgtgccactgcactacagcctgggcaacagggtaagaccctgtctcagaaaaaaaaaaaaaaaaaagttggaggtgcttataacagctataattgtgatgtggagatgctaaccctgtactcagaaagactgcgactctttaagcacagaagaagtaaagcacatactatgtagggaaagagaagaatagttggcttatctgccaatgccatagctgcatattaagacctaaattccaaaactgtaaggcaggcgttatttttagcgttctattccttcatttcccctactattcgatatcacaattacaaagatcagtccttccaagtagttgattgattgtcatcattgatcttgtacacagaaggtgggaaaaaagcacacgtaagtcttgcttggcatttcagcaaatttcctccattaagcgtttttattggcagacctaaaatatatgttcttggtttggaaacgattccctgatgggcatggattgctgcttttacctccctgctcacccttataaatttctgaattagaacaatggtaaaacagaattgaagaaaagaaggtacaactttttaaatgctggaagaaaaaaataaagcttcactaaggtcaatgtaaactgactctacacttctgtaaccctcccagaaatatcagtaaacatttttatcccaaatttattttgtcttcttttccaaaggctcggtgttcatttatctacagatactcttactagggtatattggttttataagttaaaactggggctaaggatggaaaatagtagtactaccatgctcagctaatgagttttttgctctgccagcttatatggcagccttgtaaatagctttcattttatgtaagcttcttttgatagcacctttctctgttaaaaggattttatttaggcttagatgcaaaaaatgatgattgatactttatttttactactgtggatcccaaaggggccagcaacataaatttcaaatatttgcttttcttattcctgccaaccttagttaagccttgtatatgacctgaagacatttttttttttcaattcaatagttaattcattgaaaatttttattgctttgttaggcacatgtgacacaaacatttaaaaagatgggcactgattctaaggcacttataaatagtaaggaagacagtcaaataaacaaatacaatatagtgtgatgattgaaagaatagggctatactcaggttgtagaactagccaagaagaccagtgatgaaattggacttccattggtggaggtgacaaatatgttcagggaagtattaccaaaaaagtaacactaaaaggattttgaaaggttaagaagtcttggctcttttaagatcagatgtgaccactaccacatcaaggttgcctgcaagtattttagtttctatttaaaagaacaactgtgcatttggggtcatactaaaaaaatccttgcccaaaccaatggcaagaatatttttttccctacattttcttctagtgcttttacaatttcaggacttccatttgtctttagcaaattttgatttgatttttgtatatagtgtgagacacagttctgatttcatttttctgcttgtggatatctagttttcccaacaaaaattgaagagactctgtttctcagtgtgtgttcttggcaatttatcaaatttcaactgacagtaaatgcttagatttatttccagactctctattgtgatccactagtctacatgaagggtcctccacccccagtcacagaccactactggtccatggactgttaggaactgggcagcacagcaggaggtgagcagcagacaagcaagcattactgcctgatctccacctcctgccagatgtgtggctgcatgcattagattctcacaggagcagagccctattgtgaactgagcatgtgagggatctaggttgtgcactccttatgagaatctaatgcctgatggtctagggtggaatagtttcatcctgaaaccatctccactgccctacgccctcttcttgctgtctgtggaaaaattgtcttcgacgaaaccagccctgtgtggctggggactgctggtctacatgactgtttctgtgtcggtaccatgatgttttgttaattatagtgtcatagtaatcttgaaatcaagtagtgtgatggcttagctttgttcttttacttaagattactttggctattcaggttcttttgtggttctatataaattttaagattatttttctatagctgtggaaaatagcattggaattttgatagggattgcattgaatctgtagatagttttggatagtacagacattgcaacaatattcattcttcaatccataaatatgagatatcctttcatttatttgtgcctttttcaatttctttcatcaatgtattgtagtttcagtgtacagatattttgcccccttagttaaatttattcctgtgattcttttgatgatgtgattataaaaaatattgccttctttatttcattttctataacttgttgttagtgtatagaagtactactgatttttgtatgttgattttgtatcctgcaactttactaatttttaatcagttataacagtttttggtggagtctttgcagttttctaaaaataagataaagtaatctgtaaacagatacaattttacttcttttccaattcgaatatatttatttcttttccttgcctagcctggctgagatttcccatactatattgaatagaagtcagcatcctttttttttttttttttttttttgagacagagtcttgctctgtagcccaggctggagtgcagtggcacgatccctgctcactgcaagctctgcctcccgggtttaccccattctcctgactcagcctccctctcgagtaggtgggactacaggcgcctgctaccatgcctggctaacttttttttgtattttttagtagagacgaggtttcactgtgttagccaggatggttcgatctcctgaccttgtgatccacccgcctcggcctcccaaagtgctgggattacaggcatgagccacggcacccggccggccagcattcttgtcttgttcctgatcatagatgaaaatagtttttcatcattgagtgtgatattagatttgggctggtcatatatggctttattatgttaaggtgcatttcttctctatatctaattgtttgagagttgttaatcataaaagaatgttgaattttgtcaaatgctttttatctattgatactatcacatgatttttattcttcattttattaatgtggtgtatcacatttattgatttgtgtttgttgagtcatccttgcatcccaggtctaaatcccatccaatcatagtgaattatccttttaatgtgctgctgaattgagtttgctagtttttttgttgaggatttttgcatctgaatttttcagggatatattgccctatgcttctcttgtattcttatctggctttggtatgagggtaatgttagtcttgtacaatgagtttgtaagcattccctcctctttaattttagggagagtttgagaaatattgggattaattattcattaattcaaatgttgggttgaattcaactcgaagccatcaaatcctgggcttatctttgttgggaagtttaagactactgattcaatctttgtattagtcagtctccagcagaacaatccatagagagagagagagtgagagagacagcgtgttaaaaaggggatttataataagaattaactcatggaattctggagtccagaaagttctacaatatgctctgtgcaagctggagaactagaaaagccaatgtataattaaatgagagtccaaaggcctgagaaccaggggacccaatactgtaccttttagcccagttcaaaaggcctgagaacttgagtggggtggagtgctcactttggagtcccagagtctgaaggtctgagaacctggaacaattatattcgaggacagaaaaagatgaatgtcctagctccagaagaaagactgagtttgccctttctctacttttttgttctatccaggtcctcaatggcctgcatgatgcccatttacactggtaaaggcaaatcttctttactcactctactgattcaaatggtaatctcttctggaaacttccttacagacatgcctagagataatattttaccagccatctgagtatctcttaggccagtcaagttgacacattaaatttaccatcacagtctccttactcattattggtttcttcagattttccatttcttcataattcagtctttccagaggtggaattcaccttgcttatcattagcatgtgtattcagtcaacattcaggcatgatggtgatgtcagaaaactacagattatccacatgggtggctgagatagtgatactttggcttactgatggttcagtgtatacaaactttgtttcaaactttgcattccaaaatctaaaataaaaaatactctggtcccaagcattttgggaacagggattctcaacctatattcagagagagggggattaaaaaaaagaaaaaagaatggggaaaaaagatgtaaaaaacacagtaagaaacatttcatctctctgattctcaatcttctaacctttaatatgatagtacctacttcaaaggatccttgtaaagattaagttagttactatatgaaaaacccttagaacaatgcttggcacattatatagtctcagtaaatattatctggcattgaaatattttaaaatcaaatattagatattctttttaaatactttaaattaaaaagagcacctgacacctcagtggcccagtcttaggatttcagataaatttcccctggaatactttcagtttgagtctagttgttttcaaaatccagtaaaagactttaatgaatgtaaaatgctatctgaatctggacattactgttttaattccaatagaattttctcatgtgggttaaaaggacaatcagcttatatttcctactatattttcatctagcacaactcttaaagcaagtctattttagttatatattattttatcatggttcctggaaggtaagattggtggccaccacattcagtctccttcacagctaagtgtagccacataactatgctttggccacggggatatgaatgctactactaattttttcccttgaaacaatgggatgttgactttcttgctcccttcctccttactgcttattgggagatggcagaaactgtcccatctaccattcatgtataagttaaaaccaaaagtgaactacagcatagccacttagcctaaaaatgttggctcgtctgtggattgatatatgagagaaaaataaactctgattcttgtgtctgttataatagctagcctgtatgtgaataaataccttctttttaaatttttgaggaattaaatctccatattatgtgtaaatctacattaaattaatataccttgagatgtttttctctctatatttcatgtcttttcatcacaaaagatttgaagcttttaacataagatttaatatctatcttacctctaaataagaaatgtttctttgacagtttggaaagagaatttcagtgattatagtcttatacctcaactactaattcattttacttgtagagcaccaaactataagcatccattatagcaatattgtaactacatcagattgatatatctctaacaagttttatgaattccaggaataatgtgtttaaagtttaagaaatttgaatatgttcctttctatctgagagctaagatagaagagtggtagctaaaaaaaaaagctaccactcttacctcctctgtaaggggaaaaaaaaaagataataaattttgttttcccaggaagacagagtaaatgttgccagaatctaactaaatatactgtggagctcttccttaagagacagaagaattagaaataccacatgcaataagtgaaattaagtttgagcatttatacttatcacacgaacaatatctttctaaacataatctttgagaatattccctcttaaagcatcagagataaggtgcaatttatattgatacttttccatctcattagaatcttttgtgagcaatctatagcctggagcatctgtttctgcttctagtggtgtggttagaaagcagatttaactattttggctttggagtttgctttaaagctaatataggcaaaagtcacgtggtctttcaattaattaaccaactgaagtgttaacctcatctccttcagtgtgaaggaagtgagatgttcatccctcacgattataacttaagggtgcagtggctcacgcctatgatcccagcactttgggaggctgaggcaggtcgattgtctaaggtcaggagttcgagaacagcctgaccaacatagtgaaatctcgtctctactaaaaattcaaaaacttcctgggtgtggcggtgggtgcctgcaatcctagctactcaggaggctaaggcaagagaattgcttgaacttgtgaggcgaaggttgcagtgagctaagactgtgccattgcactccagcctgggcaacaggagtgaaactccatctcaaaaaataaattaattaattcaaaaataaaaaataaggcttacatgggacaagattacagtttgactgaacaacttagttcccagtccccaaaagagagagaagtatttaaatgggaaatacagaaagtaccaaatttaaaattatattatttgacaatttattcaataatttatattttcacccaaaggagaatttacccacctctctctatataaattcaatgataaaacattccgtgcatagtacagtttaaagtcccagcactcctaatttttcacagtaatatgtcagattattatcatctggacatgttatttgctctgtaataatataggctgccttttaattactggtgtaaatatttttgaattttttctataagccaagttcagttgtcataggctatagtttgaatgttcacgttgccttcaaacttcatgttgaaacataatccccaaggaaacagcattcaaatgtggggtctttacaagctgattaggtcaggaagactcctcccttatgaatgggattataaaagaggcttcacatagcatttggctttttgccctgctgtccctgctgccatgtgaggacacaacattcatcctctccttaggatgtagtcttcaaagtgccatcttgtaagcagagagaactatccctcaccagacaccaaatccactggtaccttgattttggacttccagccttcagaactgtaagaaaaaaaaaaatctgatctttgtaaattactcagactaagttatttcattatagcagcacagaattagaaaccgtatgtaattgctccctctctgcctacaggaatacattaaaattttctgttttgtgtatttaaaggtgatccaatgacagcctttattgaggaagcgctttgtttttcagaaagttggaagaggcgaattcatttaaaatatcttacccatttctctatgatgtacctaggacattgctgaacttttctcttgctatcctctagaggagatttaaattgctagctaaaatgtcattagcaaactactctggtgattgggatgaataactgaataaatgaaaagataaattggtcagtagattaacagacaatccagtgtgacttaaaaaatgccatcaaacattcttggaatgttaggtaattatttaaagaggaaaataagtgataaaataagaaaccataaatgaagtaaatgttataatttgtgttttgtatataggttcttgacttactaactatattcactgttttccattcatgttattactaaaaacgatgttttaaggtttgagtttattatttatagttttctacataaataaagggcttcattaaaattctgatttcataattaacctctacaaacacaggccccatggtattataaaacaattgccactttagaatttttgaaaagcattatccggtagaaaaaagtaactgctttatttgagttaaattaaggctcttaaaatcaaatcttagctatgccgtagccacacagtttcagtaagagtgcagcatgaggtcacaggaagaatagaatatacaagtgattatccaagaaatgaagagagtctgtagttgtctgtcctggggaaagtcacctttacattcatttgctttttgactataacctataggaaggcacaaactataaaaaataagtcttgtttatcgtagggactcaacaatatgtaacaattgaagaatgtgtgggtctgagatcctttaaggatttataacattttaagccatatttgctttttttttttttttttttttgagatggagtctcgctttgtcgcccaggctggagtacggtggcgagatctcgactcactgcaagcgctgccttccgtgttcatgccattctcctgcctcagcctcccgagtagctgggactacaggtgcccgccaccatgcccggctaattttttgtatttttagtagagatggggtttcaccgtgttagccaggatggtctcgatctcctgacctcgtgattcacccgcctcagcctcccaaagtgctgggattacagacgtgagccaccgcgcccggcctgctttttgtcattatagttttcaccctaaacactgcgaaaggaagggctaaaatatcctgcatatgggcataaaataagatctaaatgtcccatatttctccctgtctcacattatcaggatctcctttggcttctgcttgcactagtttatcagcttgtggccccactaaactatctcagcagctcacagttttaagcagatgtgagtctctgtccaaatttttactgaaaaaaaaaaaaaaaaaacaggtaaaaagaaatcacttcctttttttttttttttgagacagagtctcagtccatcacccaggcttgggtgcagtgtcatgatctcggctcactgcaacctccacctctgggttcatgcaattctcatgcctcagcctcccaagtggctgggattacaggtgtgtgccaccacacccaactaatttttgtatttttagtagaaatggggttttgctatgttggctaggctggtcttgaactcctaagctcaagtgatctgcccgcctcagccccccaaagttctgggattacaggcctgagccacggcaccctgccaaaaaaaaaaaataaataacaacaacaaaaaaacaaaaaaacaccttctgatacaacacatttatgtgtgacagtctgagggtaaattcagggctatcgtttaggtcataggtagtggtgtaaggccaaactggctttatggctgttgtccatttgattgcttagcgtgtgtatcttcattgatgattgtccatgctatatgacttgttaaatgttttaaatattagtgctggttgtggtaagatgagagtaaagatggagatccttaacagttcatgaatacaaacaccttctaaaaggaatatacacatttctgtcttaaaagctccttagctactcctccaccatttagctcacatactgcagtcttttccctctcaaactattttttattcttctctccttcacccttacattctgaacatttataatgttgaaaagttttagccatctctcttatttgctgatttttctcaactcatgccttaagggttcaacttgtactcctaaaagtttacacatttattttcttaaacagagacaattacctcctaagagaagttgtggtataagttataaggatcatattttgtttattttttaatttaaatagactgtttcttaaagcagttctatgttcacagcaaaattaagtggaaggtagaagagtactcatttacttcctgccttctctgccacacagagcctccctatcattgacatccctgaaccagagtggtacacttgttacagtctgtgagccacatttgacacatacttattaccccagatcagtagtttacattagggttcactcttggtgatgcacattctatgggttttgacaaatgtaaaataacatctacccaccattatagtatcatgcagagtagttttaatgccttaaaaatattctatactggaactgttcattcccctctgcccccaagccctggcaatcattgatcatgttattatttccacagttttgccttttccagaatgtattatagttggaatcatacagtaggtagtattttctggttaacttctttgacttagtaatactcatttaaggcttgatagctcatttcttgttagcaatgaaaaatactccattatctggatatgcctcacttgcggaatgacatcttggtggtttccaaacggtgttaattatgaatgaaactgttataaacagctgtgtacagattttcgcatggataagtctttagctcatttaggtaaataccaaggagtgcaattgttgaattgtatggtaagagtatgttaactttgtaacaattgacagactgtcttccaaagtgactgtaccattttgcactcctgtcagcaacgaatgaaataattcctgttgcttcacattctcaacagcatttagtgttgtcagtgttctagattttgggcattgtaaaaggtatgtagttgcgtcccattgttgttttactttgtaattccctaatgaagtattattttgaacatttttatatgcttatttgccatctgtatatcttttttagtgaattcttttgagatttttttctgttttttaattgggattttttttattaacatttaaatgttctttgtacattttggatgacagttcctttgtaagatatgtttttgcaaatattttcttccagtctgtggtttatattctcactttcctgcaagtgtctttcatagctttttcattctgttatggttgtgttatagtatctgtaatgggaattagagaccctgaaagaagtttaatagattacttctaagctgccttcctactcttaactccttaagaagtatatttttatactgaagaagtatatttttcaagtgacattttaatattaaaacctatcacaaggtatgattatgaataaaagctggcaaactcatttagaaatattcaatagcttttgcttttaaaaagattttgttttaactaatgttaataaaatcaaaggaaatatccctcccccatatattaattattactatatccttgcatacatttaactggaaggtagaaaagttgactaacaagagtctgggctaaataaagcctatgatttgacagatcattattttttcaggttgtctattaaagtatgagaaacaagaatactatgaataaaatcagattctcctgtttagtttcttaaatgtttcctttatggtgaggaagtattgcctatgtctaagaacagcagaatagaccttgtaaagatagcctgggaaataaagattggaagaaaagttacgatcaattatgggtttctttagtaagatctctacctatgtttttttataggtcccttctaagtatatgattgcagtccagaggtatagtcacatcaattgtgtattatttgcatagattagcattgccttttcacagacaattttctgttattttcctgccaatataaataccaaagactattaaagtaagaagaagtttcaggaaaggtagattgcatcttgtcacaaatcgaagcacaatgagtaagctgatgtgacttttccctgctaagatcactagaaatcagagttgtctcattaaatacacactcaaagaatggaatgattgccagacttgctgtggtaagatctttgaacatttacaaagatgcttaggtaaattttagccttgtcacccattctcaagttatttaaactttacaattttgcagatcttatagatgtactttcactaactctttcttgcatattcttgttatataagaaagaaatgaggcttaaaataccaattataaaagaatgagttattttaaataagagatttggaattatttaagccatgtattatataaaaagaaataacttttaaaaaattctaaaacttaatatagccagaagtaatatagaaaacaatagagggttttttttttttttcctgagaaacatttgactaaaacaacatgtgctaatgccaaactttctggcaataacgtctttttatacatgtgtcatatatatcacaatatgtgtagtttccaaggattgtcataacaaattagcacaaaccagatgagttaaaaagtctcagatcaaggagtcagcagggtcgtgttgtctctgaaggcactagggcaaaatgtgatccattcgtttctcttagcttctggtattgtcaacaatccatggtgtgttttcacttgaagatgcatcactccaatatcttccttcattttcacatggggctctttctgtgtggctctgtttctatattttctctccttataaggacctatactataagtgccccaccctaattaattataagttcattttaacttgattctatttataaagacctcttccttcatcttcacatggagctctttctgtgtagctctgtttctatattttctgtccttataaggacccatactataagtgccccactctaattataacttcattttaacttgattatatctacaaatacctcttccttcatcttcacatggagctgtgtggctcagtctgtttctgttttctctccttataaggacccatactataagtgccccaccctaagtaagtatgatctcgttttaacttgattatatctacagagaccctatttccaaataaggtcgtactctaaggttccaggaagaacatgaattttggggagggtattactctcaacccaatacacaatatcttatgtaaactttggatacagaacaatctgagcttgaattccgactctgctacttagtagctatgtaagctaagacaagttagttaatctttctggttatatattagttcctttatatataaaagtatgataaatcccactttgttttaaagtttagaaatgatatttgtgaattaaccagaaagtatctgccgcacagaaggttctaaaaatagtaactgttattattttatgattattatacagaattacagcagcttctttcttttataaacattttgcttaattgtagaagcagtattttagaaacaaaatactaatctttaccaaacgtttggacaatttagtgaaagtgttgtcatactgttgctttgatgttaaggtataataactttgctttagctttgctagcagtatatttctccaagtccagccatctttctgagtattatgcagaaaaacactgtcctcaaggttgaccttaatgacaacattgtggttcataccacttcaaaccctccctttttttgctccttgtaagtttctttttttatttaattgttcaaccaatcaacagctatttataacctatatggaaagtattatattaggaattatgaaaaacagaagtattatatgatcctgcttacaaagaacttatactttatttgtcagaccagactaacgtataacatataaagcattattaggaaaatgaattgaaatttaataagaaatctgcctttttagcaaatattattccagtctttaaaatgggccaggcagtacacagaatatgcaaagatgattgaaatgatttgttcttcaagatggtctcagatgaatgagagatgaatgaaaagataattttcatagaatgtgataaatttaattataatcttatgagagtgttgtgtaacacagaaaagaatacttagattaaaagagaagggcttcagggcttctaggagaaggtgacatgaattgattactaaatgactagcagtagaaagtatattggggaaagaacagaagacaggataaggaattttgaggaagaggaaatagtatttgtgagaaaatgcacaggagcaaaaattatgcaagcattttgaggttattcataattcatagtataagattaaaaggcagtattgagaaaaacatgtaataaatctggagtaaaaagcagaagcagatcttaaaatggtttcaatatatggtattttgttccgtattacctgtgtggacaaagagaattgcaatagtattccaaaagaatatgatgaaggctggagaactgaggaaattaacacttatactagctttctattttaagtcggtacaagttgcttttatatgcattgtcccatgcaatccacatagcaactctataaggtgggtgttctccccattatgcagaagaaagaagtagatcaaaggtgttaagaaatttgccctaggttacacaacagataaatggccatgtctgtatttgttcaaaatgatgacatcatgaggggaaggtgtgtgttatggccgagcataagtcctgtgaggaaacacttagaaatttttacaatgaaattcaggtgatagatttacagattagccttttctcacagtacttattttcagccatgacacctaccttcccctcatgagttcatcatttaaaacaaattcagacattgccatttatctgctgaaacaaatctatattatatagggggcaatgaaattatgaaggcacgtaaactgaagcctacagcacagtttcaaagagggtgaaaattgttaggaagctagtgaaattaacatcaattttaggtttgtttcagctacttgagatatgaccccaagaatttaccaaggaaatggttatattaattcaggtgtgaagtcataaccccagatctagggtcagatgacgaatgctagggagggtgtttgccggtagtcagactaagaaagatagcataagaaaaagggagggagggagggaaagagagaaggagagggaaagagagaaggagagggagggaggcagagagagagcaagagaaagcatttaaaagaaagaaagcatttaaaagaaagaaaacttaatgtaaaaaagtatttaagttcaaaattggttggctattggaacatgaagaacacgtgaaatatttagggtaagcaaggcaatagtcatgtaactgacagagaaactgtgctggaggagtctaatttagtgaggcctatgggggtggagtgaaatgatacttcagtttcagacacacagagtttgagatgacagtgaaatatccaaacagcacatccattaatctctagatattgcacacgaaccagaatatgtagtagtgagatgaaacatgcatgtgagattgtgtctccttttttctccaatccttttttgatagttggaaatcctaacagacagaatctgtgctaaataagcaggtggtgtgaagtgtcagaggagtctgatttatttttcttaacagttagttaaaaatagaaagtgtatttgaaaaacatagatttttgttcagtgacctgtgtcacagaactgtcacaattacgctaattctgtagtcctttttggaggagcgtctgagaggatctgggggccatgggctacaagctaggttactttacctctctatatggtgacttcagagaatgatttcaaaataggatatatgttctaaaactggactgtgctgattgcacaactctgtacatttactaaaaataatggaatcatacactttgggtgaattttttgttacgttatacattcatgaagctgttaaagaataaaataaaataatgctatgtttttatttcttgctaaaaatggttatggattagttctgagtgaataccattgtaaatgacttgatttttaaaactgctgcctaataaaattccaatttatatgcaaaatatagtattaaatacacatgaatactgactctcttaaagtaatataattaataacagctttgtttactttatgttatactgtttttcttgtcatattcctaactatgtctggttcatataaaaatccaaattataagttaagaataaatagtgaaatattactatttattacacacacacacagaggtttgttttgtatcatgttgactacaacttggcaacagacacctgagaacatcactgtatataattttttctgtgttgcaaattttcaaaagaaaaaaacgttttctaatgatgtgggttatttgttttattgtaaattgtttaatcattgtctcatagttcttgaattcattaatagggaactgtactgggggctgtgatgaaagataagttaaaaatggttcatattctcagtgaacgttcctgtatgacaaggatgatatatgtgtagaaggtaattataatttgggtaaaacgtgataagaacagtagtaattattattttaaggctgttcagagttgaaggaggttgcctttaggtatatggatcaaagtaaatcttcaggtaaagtttctgtattagtttttttttaagtgtttttttcttttattattatactttaagttttagggtacgtgtgcacattgtgcaggtttgttacgtatgtatacatgtgccatgctggtgcgctgcacccactaacttgtcatctagcattaggtatatctcccaatgctatccatccccctcccaccaccccacaacagtccccagagtgtgatgttccccttcgtgtgtccatgtggtctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatcagtctatcattgttggacatttggcttgtttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttcttaatgattgccattctaactggtgtgagatggtatctcattgtggttttgatttgcatttctctgatggccagtgatgatgggcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctgtgtcctgaatggtaatgcctagattttcttttagggtttttatggttttaggtctaacgtttaagtctttaatccatcttgaattgatttttgtataaggtgtaaggaagggatccagtttcagctttctccatatggctagccaattttcccagcaccatttattaaatagggaatcctttccccattgcttgtttttctcaggtttgtcaaagatcagatagttgtagatatgcggcgttatttctgagggctctgttctgttccattgatcaatatctctgttttggtaccagtaccatgctgttttggttactgtagccttgtagtacagtttgaaggattctgtataagttaaatggaaataacaacaaatgtgttctcatttgtttattcaatgagacaggaaggaaaccattctaggaatatgttcttcaaatttaatgtctgtatccctatagtacacaaatactttcaaagtggtaggcagacagaaagttttaaagattaattttccacatccttaagattcttatgaattcttttcttgtgaattcatgggaacacttctgatgtaaaagcttcatgcattccccattgagtctccctatcacagtctcccaataaacacatgtgactttgacatccttatttgatagcccaaatctatgccagtgtttcctaaattttattgatccatgtatcactgctacgattttccatctctctgtatcaaaacataacacattttctgatttctgtcatattcatatactttactgtatcaacaatgttttctctgaatttttcatatttacttaaatgtatttgtaattatttgaaatgtgtatcagtttttcacttgtcagatatagaatataatgatacacataaatacatttccctttatcaaagaaaacacactgtagtccatcctttaccatacagagatgcaacacccaagaggggaaaacagtcaaaacaccaaacaaaaggataatcataaatattaatgtggatggtggaaagtaaaaattctaactcatgtaagctgtaactgacttgattttagcaatttatctttttaatattaaaagagaatcttttttgctgataaattaataattttattgtggataatgtagttttggaatataactcagaagaagtttaaagtattaagtaacattgttacaacaaagccttttctattcccatctactcagtatctgaacatgtttttaaatgcgtgtagtcaaaaactagaaaataggtacacccacctcattaagagacagagttctaatacaattttacattcgatttaagcatattgtatattaatttaagcagctgcttacaaaaaagattatattgataacttaatcctaaagaaaaagaagatttttagtcttgtgatctgcattttaaaaattggtttatatgaattgtgtgtgtagagaaatagaacaaccgtaaaaaatctcaagcataaccatatattaaattgaaaaaaattctatgggcaaaatagaatgagaatgttagttcagtaagataaagggacaatatgaaatttctgactcctaaaaagagcttgttcacatatttttaaaatgaattattgtggatttcaaataaccatgatatttatattattttttttccaaaagaatgatacagtagtatactggaaatgatatcattagcaattatttacatttctgttgtaaaaatttagatatcaatctacaaatatgtgatagtatatatgattttaaaaattatagactatatgagcagaaaattttgaagaccactgttgtagaataaaggcctagatgtacaaaaccttaaaaactttgatatatctagtagttcaattatttgatgagtaggacaaggcttggaacacaaatttgaaaagactgaggtgctcctggaaggctaatgctaccaaataggaaaacaagttgggtgactcatggaatttcacattttctcctagtcagccacattaaaaaaaaataaagaagaaacactggaaatcaattttttgttggtttgtttttgttttttgtttttgagatggagtttcactcctgttgtccaggctggagtacaatggcgtgatcttggctcactgcaacctccacctcccagattcaagggattctcctgcctccgccttcccaagtagctgggattataggcatgcaccaccatacctggctaattttgcatttttagtagagttggggtttcttcatgttggtcaggctagtcttgaactcccgatctcaggtgatccgcctgcctcagcctcccaaagtgatgaaatcaatttttaaaaaccatttatttaatgcaatacattcaacatctcatttaacgtataatcaatataaaaaatagaatttggaatctggtgtgtattttacacctatagatcatctcaacttggactatccagatttcacgtgcctagtaaacgcatatggctgtagcatccttatttgatagctcaagtctgggccagtgtttcctaaattttattcattaatgtactgctcctataattttccgtatctctgtatcacatcataaataaattttctttctgtcatagtcacatatatctactgtatcaacaattttctctgaatttttcatcctttttacttaagtttacctatattaatttggaaagtgtagcagttttttacttgttagatatggaagataatggtgtgaataaatagaatataaaatattattacatgtcaaatactttttgacccaagaaactgagcctgagtccagtttctctattagaaagactaagaaacagttgtttaagtgggatataaagtatattcaattttttctaaaaataattgggattaaagaaaaatagtaaatatcactatgttacttactctaaagtccacctgaaaccatatatatatatacatatatacaccatcagcatcatgtgtttcactcactggggactaaatctcagtatgaaacacatactgagtatgagatttagtcactggggaacatttgcaggtctttagtagggatcataagacacaactatatttcataagttaatcaggctaatctatagtactagaatttgatttgatatagaagattaaaaactcagaacattattttaatttctgtacccttcttacattttatatatttctttgtagtaaggaacttcatcatattttattggggtcattgagacatatctaactttttagcctttcagatgatctagaatgctgttacaaaaaaagaagctaaggaatgctggaatttttaatgtcaaagacaactatagaagagtctacaccttttttgttgtttctgttgttaatggtgagatatgagtcctagagaagccctctagaagggtacacaaaaggaagttatgaaaatgactgatctctacttgtttatagtcaattagatatgaagaacatggatctgtattctggtgacattaaataagagtagcctagagtcaaataatacaatcacataatataaagataaaattgttaaagcacatttatatctgtcaaagagcaacctctaggcttctaagtttttattactctaaataattttactagcatcttgaatatcatctgtgattagagaacatgaatattttctctggtaatcaaatgttattgcaaataatatcgtacttcctactgacacaatattattttattatgatttagctattagataaacatgtttttggaaattttaacttcatagctatacatcgtatgataaacgtttatttaaactagaagcaatttcaaaaggtatttctggaagttgccttgattggaatgcaaacatatttatctgtagaataaaacaggccttcactgtcccaagcacagagaagacattcagaaatatattttgaatgaatgaacaattccatttccattagtagccctttctactaatggagcaagatagaaagttttatgtgctgtgtgatttcctaagtaaaataaatggaggaatgaattccactagatggtaacaacagtgctataggcttgggaagattatggataactctattttatgttcctctttcttagaatgaaatactattattttatactgaaaactaatataaagttctaaaagactaccccttatcaaaagagaatataggttgagttacttcaagagtttgagaccacactgtttgccaaacgtcattccatattttcttaacacttttattaatacccccatcgctgctgttaacttattttttcatcatttccctgtcaaatttatctgtggaactggatttaatatgctttaaagcagattttttatgctcaagttatgcctattttaacaagcattttaaaaacttgcatttgttaattattttcaaatataaatgacatagtcaagagcatttcacttgactgggaaaaaaaagaactgactatgagctcttctagattatctcagattacaacgatatcagctttaaaaaagacaggttgtgttttggcatccttcttaatcttcagatatttgcttatcactccatgtcatatggcctgacatcctttctgtggcttgctatcctctgaatcattcctcgccttctcttgactattctgccaaatgcagctgttttctaagagatttcacaaaggttttatctgtgccgtgggacaaaatatgtctgcatctctctctctctttctctacttctatctctatatctatcatgtatctgtttatttatttattctgcatgtataacatatatgcaccactataacatacattcactttacaaaattgtgttaaaaaatattgataaaaaagaaatcacttgtaaaactaatgccaagtggtaattattaaatcagagagagagagagagacagactatgtagaactgtgatagaggaagcattttctttatgtttgagtcttatctgttaaggtaacttaatttcaaacaactactcaaaaagaaagctggtgtcaacacagcatatattttaatgtgttaaatatcacaagattagtgaattcataaacagtctaagtaatggtattcaatttcctatagcatatgtgttttgtaagagatagtggataaaatagtacatgcccacatttgatatgcaaataagatttttttggaaaagcttcttattttcccattgattactattaattttaagtttttaaaccaaaaaaaaaaaaacccatcagatcaaggaatgtgaagtttaatattctctggctgatcatgctttttgtttgcttctaaagacctggacctaagtactctctaaccttctctttatcttgctgagaaaggcagtgacgttacagcaaataaagactacatgaattcttattaaatactgttatttccacttctataataaaatgaataatttctgtttcagtacagaattgtcatttctcctatgttttttattttaaatattttcaaaacaaaaaagtaaaatgaacacccatataaatactcacgtagctcagggatcttcaaactagagtttcatggacaatttcagcttgtcatctgcttctatcagtagttttattggaacaaatctatgcccatttatttatgtattgtctatggctgcttttgcactgcaagactgagttgagtagttgtgacagagaccatatggaccaaaacctaaaatatctaccatctgtccttgtagaaaaagtttgtcaaaccttgatttagattcaccagttattaaaattttgctacatctgttttttctatctttgtaattatagataggtagattatattaatagttatatacatccacagattttatggatgtatatgtacacaaatatgcttttttctgaactatttaaaaataagtgtctgatattataatacttcagcatgtatctcctaagaagaacatcgtcctatatctcctacatgatcacaacattataatacgcgaagtatttaacaatggtacagtaatattgtctcatagacagtccatattcagatgtcttcagttgcctgactcagcatccagtcaaggagtatgcattgccattgatactttatctcttgacccttctttagtctataattctcctttgatttaactttcatgacatttccattttcacaaaatccaagacaatggtcttgagtcatacaatttggatttacgtgatgatttcctcttgaatttattaactattttgataaaaaatgttatgcagacaatgatacacacttcccattttatcatacagaaggactcacaatgccagtttgtcctataattggtgacactaagtttgagtcacttggataagataggatctgccagacttatttattctagtgatatatttaaattccatgttattgataagtagtaatgtccagtgatatcttgaaactatgtaaatattatgctactccacagttttatataatggatttaacatctattgatgatccttgcctgagtcaattattatactatagaacacaaaataaaaactttctaattacatcattccttctatgtttatgacctggcattcctctgtttaaaagttcttttctcttttctatcttttcatttcttaaaaaattattttaatattatggactcatggatttttatgtattcaatgtgaaattatacattacttgcaatattctttttgatacttaaattatataaactggctgttgaaaaccacttcaaactggcaactttgacctgttgtcttctttattccttcatgactgccttaaattctgaagcaacaaaatactcagggcccactttctgattcctctgccctaaaccttgtatgtactattctttaaggattcctagtttagtaagaaagataccaagatctgagtatgagatatgctcattgctagtggtgatttaacacaaaaactagggaatacataatcttagttacttttttcttattcataaattcttacctctaattcaaattcagtgatatatggtttttcctcacctctctcactctataacttgatctcccatttcctgtaatgagaatcatgactccccaaaattcagtatatgtacttatttgatttgccttacatatagatgaagtaaattaagaatcatgatactcactttgggaggctgaagagggcgaatagcttgagctgaagagttggagagcagcctgggaaacatagcgaaacccccagccaggtgtggtggtgcttgcctgtaatcccagctacttcggaggctgaggtgggagaattgctttaacccaggaggcagaagttgcgctgagcttcaacatctcgccactgcactccagactgggcaatagagtgagaccccgtctcaaaaaaaaaaaaaacaatctgatttaagattgttgactgtaatcagctcaagtctaatatggtatagacaaacagccttatcaactcttgtcaactattgcaatgcagtgtgatacaggttaagtctggaatgtatgtaagttggtgttatttgttttacatttttttgttttattttctaaaggaaatcacaatatcagtatcactacctaaaatctatttagaaaagttcaaggattttttgttttctctttctgttcctggaacaggagtgtttgctgtcagctaaatctttttaaaatttacttgaatttgttctttattttctgtgtgataatgctaaaaaagtcacattgagttagtttaatttgcttatattagcatataatattaaggtttgctttatcttttctcttaaatttagtttttaaaaaatataaaaacatttacatggttcacaagtcaaaactatacaaaggtacattcaaagaagtctcattcttatatctgttcctttcaacttgttaacacatcctcataagagatcattttcattagcatataatttatgattctgtgatcctttaaaaaaagaaaagcgtatacatgtgtgcatttaataaagttagtatgttattaatatacttcattttgctttaacatgttctggaataacttagtgtctgtatatagtgaacaggtttttctgtttttctcaattgcttaacactcaattatgtcaatatctcatagttttttcaagtttcctatgtattatgtctttatttgtgtctttttgaatttctttcatcaatgtcttagtttgtaatgcacagatctttcataaccttagtcaaatttttctctaaatattttattttttgatgctattgtaaatgggatttgttttcttactatccaaagtgatctacaagtttaatgcaaaccctataaaaatttcaatggattttttacagttattagaaaaaatcataaaatttgtatggaaacataaaatattctaaatagccaaagcaattttgagaaaaaagagcaaagctggaggcatcacagctttatgatttgaaggtgtatcacaaagctataataatcaaaagagtatggtactggcataaaaactgaacacacaacagagatcccagaggtaaactcatacatttatggtcaaactaatctttgagaagggcatgaagaatatagaatggagaaaggataaactctttagtaaatggtgtagaggaacctggactttcacatacagaatatcatatcatttcatacctgaattaatataaccattttcttgttaaattcttggggtcacatctcaagtagctgaaacaaactggactttcacatacagaagaatccagcaatcttctgtgtatatacccaaaagagaaaaagtcagtatgctgaagacatagctatactactgtgttcattgcagcatcattcaccatagcaaagacaccgaaataacctaaatgcccatcaactgatgaatgaataaagtaaacgtgaaataaatacatatatgtacatacatacatatacacacatatatgtatataccagacacatttacatatatgtatatgtatttacacacaatgaaatattatttggccataacaagcaagaaattctggcatttgtgatgagattaatgaaactggaggatattatgttaggcaaaattagcaagacaaggaaagacaaatgctgcataatctcactatatgtagaatctaaaaaagtgaacttggaaaagcagagaatagaatggtggttaccattagctggcggtgggggaaatgaggagacgttggtcagaagttacatataatcaattagaagatgaccacattctggggatttaatatacagcatgtcaagtaaggttaataatgccgtattgtaaacttgaaatttgctaagatggtagatcttaagtgttgtcaccataaaatgatggcaactgcgtgaggtgatagatatacattgagtagcttcctttatgtgttgggaaaattcctaaagaaagggaaatggtgtgaactttactgtatattatatacacaaattttatacaagtatgctttacccatgagtgtctgggagaaaaaaaaacctgaaaaaaatgtctctaataaaaaatatgggcactgagggagtctataaaagaaagtacaaatgctttgtgacaactgaaccttagaaacttctgaggtatttttttttttttatcaacaatggagtgctctttctgaagaatcacattggacattgtgagaaaaatttttctactacatcaattacttcatttttttttttgccatgtgctaagacactgttttagtcattgagggtacaaagataggtgatttaagattgttgactgtaatcagctcaagattaatatagtgtagtcaaacatccacaccagctattgcaatgtagtgtgatacaggttaagtccggaatgtatgtaaggtggcgttatttgttttacatttttcttgttttattttctagaggaaatgacacttaactgccatgaattacttctgtgaacatttgttactcatgttacaacaaggtgtcttggatttgctcctgacatattcctgtaaaaatccccattgatttttagggttgattcacttgatgtggctgttatgtaatgtgtacccttcctgtttcactgatactgcagctcacttggtcaaagaaaacagccttgtctaataaaggacaactttgattctaaccaaatctcaagatacttttgaaggtgaacttgttttgctaaataaatatttttctttttcatttcaacatgtcataatacattttaaataatagattacctctgaagttgaacagggagttgtattccctgatatgcaacctataaaagtttaataatggttttataagagagaatggggaagaaaagggcagtacttccagtctttatctgtggcacacatacacacacccacagaggcagaaagctggatgggattgtagatcatgtagtttgaaaataattcagtctttgtcctattggttttgtattgtctaagtcagaattttagattttttttcagtatttgtaaataagcagccacatagaggtataatatacacataatgtataacttacttattatgcacaggtggtaaattgccataagtgaacataactgtggaaccaacaaccagattaggaaatggaacattatcagtattcaaaaagaccctcttgtgcttctgcaagccactgcccccaactccctcagggaaaccactacataagtcaacctgaattttaatttgcgttcaagtagagcatagattgcaatatttatcaaagataacaaggttaaaagatgttggcctgaggaaaattctaggtatccatgtctaaacaccagtgcaaatccccaaagaaattatctgtttttatatagttctaaaaattattggtgataacattttcaattagagtttagttgcattacttaaatgtataagcttaaagatcttgttcatatttttgtggttttttctgctttataaaaactattagaaatcccttcttggacattatcacagtctttggtttttaaggtcatttgtactgtgtatgtatttaaatactaacctagggtatgttagactgcaaattaatttttgaagaatttttattgaaataatacccatgaccacttagccttacacataggaaaaaaaatggtcattttaatgtataattttattgtcttcatacaatgtaaaaattagcaataattttttaaagtgataatagtaatattatatttctcatcaatattaatgccaattaaatgcgaacgtttaaagttgctatctgagtatgattttccttgtaaaactccttaactgatgaccctgagtcgaccattggctggaattcaagttcatgagcgtgacacacaaggcccttcgtgagatgatccctgtcttcctttggaccttacaccactgctcttgtttatattacaaaaaataacaaactactagtggtttcctagcaactattgcagcttttcatgcctatgtaagtgcttatcctgctgaatacaattttcaccttttgtatgatataaagttccattcatctctcaaaaccccactctgattcttccttctcttagtctttatggactgtgatcaccaattttaatctcctttttaagtttgttgcttcttccttgacattttttccaagttctagaatggtttaagttttcgaaccacccctataacattatgagtttctaaggaaggagcaggaactatttcttaattaactctgtctagtacattgcagatgctcatcaaatacttgtttgtgggtaaatcttcccaacacttatcagagtgataaaaaaaaaaaaccaagtaatttagtgattgttaaatgattagctttagaaaacttcaggttttttttttgggggggtgggtgttaaatttattttgccctgtaaaaggagttaatctgattcctccccttttgtttataaagtttgtgtgtctcatgagatcttaaagatagaaacaactttaatcgagcccaatttttttaagaaattcataggagaagtaaaaaaaaaaaaatgctctgttacagaaacaagttaaaaacagactaccttgtatcccttaatgagagctaggaggcctacattgtctctccaactgtcttccaagggcctgaggtccttcatggggtctacagacttgaaggcagttctcgggctcatcgtttttatcccgttgttgcctccagttacttatttgctttattctgtcctgttacttcaaatgttttgaaacagcttcttctcttagaatgtatgaatgagcaatgtttcagttccgttagaaacatgactcttttctggctacccataataaatccgctctccagttttgttcttttctactacattaaagccattataacaaaatattaaaaaaaaattttctttcaaaaaaccagtaacccaagtatctatttcttagtgatttggctgcatttataggatattttatttggatctattttataatcacttgaaagcgtcactttggtttggttcaggtctgtggacctgaataaattgaccatgctttggcagagccatcagaagagtattgtggccaatcctttaaatctctgcagatgctctatagctaagtcaatccaaactgatcatcattgtggccatactgagtggtttttactctgccatgggcgtgatgcttagccataaaaagatttacctttgagtgataatatttttgtattttctgctagcgtagtttcccatttccaatgacattgggaagtaaaatatcttgcttttttaatacggtcattttcatttatgcttttttattgttccttaacaatgaaaaataatgtaaaatgatataaaacctctgagatgcagatttcctggggataaatggttggactgattaaatatctgttcatgacactgttcagaatgagtcttcatgtcattttggaaatgaaggttaatatctaatccagttaaatataaaaatatattgtgattaatgtctcatctactgaagagctttggtcaaacaaaaacctcataactttaaaaaacaaatgagagaaagaaagaaacaggtagataattactggaaaaataatctaaaactattcttaaaattatttaaggcactcatattttaagttttcttcgggcatatgcaaaactattggatgtattagataatctctgtatcacatgctctctctctatgtatatttacctctgtgtgctataagtagaattttgtactcacgttatgataataatgctaagcattaatatattttaagtgaagtttccactttatatacgatcttgattgattatcaagtatttttacgttagcgttcccatttaaaaaaattatcaagaaagaaggaaaagaaaaactccttaataacgttaaatataggttaataaataaagacattagaatatgtgttggttgtaaataatttacatcctctatgcttagagtaatttggagaaaattcaatagttctttatagtcatatcttttcatagaatttatatttgtattgctaatttggtattctaggtaaaatttatttctgcccttgaaatgattttcattttcattagtcacttggtcatttattgaatacatgtttattgagtaaacactctgtgctaggcattgctagcataatgaatgagaagaggaccgtgactttatggggttaaattcagtagagccctagagcatgtgactaactatattatgctgcagaagccacacacacagcatcctgtaggagtacagagaaggcagaaactaactcttaaggagaggtagaaatgtcaggagagcttttcagtaggtggggatgtttaatttacattttaaagaaatcgatttcaaaattaatacccaatttcaacacaccatttatagaaaaaatttctctaaaagcattgctttcctatcattatcaatttttttttaattttcctaggccatttttgggaaaagaaagtggctattaatgacttacataactcatactgagcttaaaatatatatattgaaatcttcatttaaaagtagaatgttattctcagtgttctttccataactttctccgtctctgtggccccatctttgttttgatgagactcaaaaacattgatcctgttaacttttattttcaactttcaatggcctagtggtgcttgcataaatatacagcagtgctctctacgggacagaagctaatcaactcatgtggaacacgctttattactgggtatgaaggatggatatcttataggaaactcaatgacaattaaaaaaaaaactattcaaaagcgactgcaaagaataataccacattttaacttgaaatatttacaagactacttaaacctctttctagcaactggtaaagttcaggaccagccccagctccaatgtgaacatgagatgcaagcaaactttctgctttctctaagaaattatgttattttaaaaatgtcattttttcatttctaaccaaaatgttatattgagttttttcatttgatttacttttacaatgttcttcttcagtggaacagcaaatattctacttcccaagtagccatatttgattattattataactttaaagaaattaagttgaacagatgtttattatggtgaatattacattcactgaaatatattcatgattttgacaatttactattcaaaaaaagtagtgtttacagtaagacaaaaataccttttgaagttcacatgtatcttttaaaatagcgcaatgacatgctgcccatggatattgaaatttttgaccatgattacaaatgttgtgcatctcatcaaagaaataaaagcactgttcttctgttcaggttgttttttgcatttagttataaaagttaattctaggcaaattggtctggcaaaataaatcacgaatgtataaatgcaaaattaagagagtaaacgatgctaacacaatgtctcaatttcaaaaataacatgtttggaatttagtcttccactgaacttttccactataaaaactaatttttaattacttgaaagcaattttatataaggtcaatcaaaaagtgttaattctcaagataaaaaaaattgttcttgacagtttttttctgttagactagtaaatgtgtggttgccaagggtatatttctaaattgaaagcttcaaattcctattttttgagtgctccgcaaacctcaggtgtaacagagttgatttttaatgccaaaacatttcaaattgagtaacaataatagtgctaattatacaattccacttttacatgatattttatagtttatggattactttcacatacatatgtacgattttacctaatcactccatccacagttgttatacagattatatataatactacatgtgaaagcagtttaactgacaaccccattaaacacaggaagaagaaatggtaattgggtattctgtgatattgtttaacagccataataggcgtacccttacactagctttatctctgaatattttaggttatataaccatatatgactccattttttaattcagattgagttgaattttttttcaacttatcttaccagatgcactgttcacatcctctgtagtgtttaagccttgttctctattaaaacaatctctttcataaaactactgaagtcaaaggcaaaaactttgtgatggattcccaaaaacattctttaggtatgtcctgcttggatacacaactcaggttttcagacttgttcagctgactctattaaagactgagaagtgttgtcatcttgatcaatattgagcaatgattaggtgtaggtctatgacatcaccttactctaaaaccacagttaaactgttttgtgtttagactgtatgctttaaaaatccttatttctgagtatctaacaggattttcttaactattatatgctttttaaaaattaatgtatattagaatagatggataaaagctcttattcctctattctgtggggaattggttcttattccccatcaaattgtggaaacaagtacgtgccctgttgaatcctgtctaaataaattaatctcatagtcattgtgattatgtgtcaggaagagatggccaaatgaaagttcatcataggttaaagccctaattgagaaagcaaccagatactttattatgcatcctaagatcttctccaaggacaagtaataaactaaaaaaaaatcaatgtattaatattatcatcactatgattattttggtaagaaataaaaagtgagttcaaaaactatatcaataaaatattcaccatttctgaatttaattgaaattaatatcaacaatttttctctatttgtgttaaatttataaaagaatatggtaaattaatttcatagcattttattacatcattctcaaataattctatataagtaggtgtgttgtttttctcaatgtccaggtgaactggagagattatatagtgttttattttaaacacaacaatactaccattttatacctcatcagaaaatttttaaaaagacacccattattttctaattaatacaatttcttgaaacatttccttaatctatagacattttaatatcatattatgaatactttataaacatttgcatatttaggaggaaaaacagttttcataaatgatttctgtatttctaaatttgtagaaatttttctctacaagtttgtagaattttaggcaagaaaaaattcagaagaaataaaataattaaatgtataactctcatcaaggcatttattcattttctgtaatcaggctgaattcagatatggaaatagaatttttaatgtatttcaagcaaagtagttataaaatttgactctcttgtgaatacaacactaagactttcaaagtcttctacttgtagagccaaatagactgacaatcattctttgattacatttacttagaatatgtgatacaaaatcttgttaactttccagaagactggtaaatttccagcttcccttagaataattgtaatgatagctgaggtttcttacttgttttctgtgtgccaagtattagtccttgtacaagggctttacatgaagaatttcttcaaattctaacagtaacactatgaggaatagggttatgattcttactatattgacaaggaaattgaggcattgaaagaataagtaacttaaaaaagtatcttgtagcaatgtttaaactctgtttactgctcaaaggaagttcttattacatcagtttgtggccaacaacaaatcccttgcatataactaagaaatcataatatgcagaactataagttctcagtggctgtgcaatccacctagaccccatgatctgctcccttcaattgcaccaggcaattcagatgccacccttgtagtcaggactcctactacatcttagagtggaatgttccatggcgcaatgatcctttccacactcaaattgtccatagtttcttgatacgtatacgtgaagagggagcatgttgttgttcagcatagaaggagtctggacatggatattatatagagactgtcatgatccttaaaaatgttttggcaacgttgcctcttctcttgcctagcagataaactactggtagtttctgttactgttatcaagtcctccttcttagtttttttcccccccttcagattaattaagccttttgcatgcagtcctctgcagaaataagtattactatttcatacgttagtatatttacaagcaagtgtgtgaataatatagattatcaatgctgaagaagatcagggtaagaggagaatatggctaatacaagattattactacttaattatcagtatagaagattagaaatttgcttagaaaataattttgaatttagctgggaggaaagaaaagacattataacgacactttaaatgagaaatgaatgaataaaggtcgggttgagaataaataagtgaattggattttaagagtgagattctcaacttagcaaagcactcaaaagggcaagtaagcttgaaccaacacaacagatgggagatcagagtgtagtccaagagagtttattacaaggattagctctaaaatctaatggacaatattaaaattttaagaacagtttgcatttccatttcacagtatgtttacttttgttataaaaatacttcaaagtgtttaatccttaccttcaaatctagagtaaaattacgctttataaaattgtgtggttttttgtttgtttgatgttatgacatagaggaacacactgtgccacactgtcaataaatgagttttaaaagtgcaacttcaaggaaaatgtgttaagatcacagtgggagaaaatgagagagaatccttggtaaatcaggtgggcttaatttatagataactttgtagatcaggaagggaaagggaagctgctggaaacacacgtggcatcttaggaaatttgaacacacaatgtttcatgttcccataaaaatattggtagatgctaattgatcatgttgtctttgtatttactcctgcaaattccaaatttagtcttagttctggcagaattgtgtctgcttgataggatattttagtttataccacatttaagaatcaaatagcacacacacattcagaaaatgtgaaatattcaagagtaaaataaattgttaactgcctgaaacatgagctgtgtcctttcattgttgcagtccccacacaaggttttagatatatgtattgctcaactcaacaggtattgctcaactcaacagtggagtaacagatggcacttatattttgtgaaatgacttattttcatgtttcttggcatatgtgactcaatgcattatttaaggtggaattgtaatatttgtaccttaataataacttcttaagaatgagaagtggccaagctcctctcatactaagtgatatattgaagttagcatcttcatgaatgtcttcttaaccccttatcttgtagctactataccatttatttttgcattgccttgtattttagtgaatatatgcacatgcttaccctctcctgaccctatttgcaagttcttgtaatcttactgagttggaacgctgaccatagctcctacacccagcaggtactcaatgaacaattatgggtttcaattcgatcaacatactttaagcattcaagaacgttccatgtctgtaagcaagtgtttgaaaaatctcaatagatgcagaaaaggcctttgacaaaattcaacaacccttcatgctaaaaactctcaataaattagggattgatgggacgtatctcaaaataataagagctatctatgacaaacgcacagccaatatcatactgaatgggcaaaaactggaagcattctctttgaaaactggcagaagacagggatgccctctctcaccactcctattcaacatagtgttggaagttctggccagggcaattaggcaggagaaggaaataaaaggtattcaattaggaaaagaggaagtcaaattgtccctgtttgcagacgacatgattgtatatctagaaaaccccatcgtctcagcccaaaatctccttaagctgataagcaacttcagcaaagtctcaggatagaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttcaagttcatatggaaccaaaaaagagcccgcattgccaagtcaatcctaagccaaaagaacaaagctggaggcatcacactacctgacttcaaactatactgcaaggctacagtaaccaaaacagcatggtactggtaccaaaacagagatatagatcaatggaacagaacagagccctcagaaataacgccgcatatccacaactatctgatctttgacaaacctgagaaaaacaagcaatggggaaaggattccctatttaataaatggacatgggaaaactggctagccatatgtagaaagctgaaactggatcccttccttacaccttatacaaaaatcaattcaagatggattaaagacttaaacgttagacctaaaaccacaaaaaccctagaagaaaacctaggcattaccattcaggacataggcatgggcaaggactccatgtctaaaacaccaaaagcaatggcaacaaaagacaaaattgacaaatgggatctaattaaagagcttctgcacagcaaaagaaactaccatcagagtgaacaggcaacctacaaaatgggagaaaattttcgcaacctactcatctgacaaagggctaatatctagaatctacaatgaactcaaacaaatttacaagaaaaaaacaaccccatcaaaaagtgggcgaaggacatgaacagacacttctcaaaagaagacatttatgcagccaaaaaacacatgaaaaaatgcccatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactaccgcaagaacaaaaacccaaacaccgcatattctcactcataggtgggaattgaacagtgagatcacatggacacaggaaggggaatatcacactctggggactgttgtggggtgggtggagtggggagggattgcattgggagatatacctaatgctagatgacgagttagtgggtgcagtgcaccagcatggcacatgtatacatatgtaactaacctgcacaatgtgcacatgtaccctaaaatgtaaagtataataaaaaaaaaagtatgaaatacctagctgtttttgtgtggtcctgactactttaaaagctgtgtgccttgatactctagtcactactcaaatgtatgtacacatagtattttgcagatgatttcagaagatgaacaaaatccctgaaagtcatcagtcaacccaggttcagaactttttactattattattatactttaagttctgggatacatgtgcagaatgcgcaggtttgttacttaggtatacatgtgccatggtggtttgctccacccatcaacccgtcatctacattacattaggtatttctcctaatgctatccctcccttagccccccacccccacataggcccaggtgtgtgatgttcccctccctgtgtccatgtgttctcatttttcacctcccatttatgagtgagaacatgcggtgtttggtgtatgttcctgtgttaatttgctgagaatgatggtttccatcttcatccatgtccctgcaaaggacatgaacccatccttgggttggttccaagtctttcctattgtgaatagtgctgcaataaacatatgtgtgcatgtgtctttatagtaaaataatttttaatcctttgggtatatacccagtcataggattgctgggtcaaatggtatttctggttctagatccctgaagaattgccacactgtcttccgcaacggttgaactgatttacactcccaccaacagtgtaaaagcattccaatttctccacatcctctccagcatctgttgtttcctgactttttaatgattgccattctaactggtgtgagatggtatctcattgtgttttttttttttttttttttttgagatggggtcttgctttgttgcccaggttggagtacagtgacgcgatctcgactcactgcaacctccgcctcccaggttcacgccattcttctgcctcagcctcccaaataggtgagactacaggtgcctaccatcacacctggctaattttttgtatttttagtagagacagggtttcaccatgttagccaggatgatctctatctcctgacctcgtgatccgcctgcctccgcctgcctccacctgcctatgcctcccaaagtgctgggattacaggcgtgagccaccgcaccctgcccttattgtggttttgatttgcatttctctaatgactggtgatgattagctttgtttcatatgtttattggccacataaatgtcttcttttgagaaatgtctgtttgtatccttcgcccacattttgatgggattttttttcttgtaaatttgtttatgttctttgtagattatggatattagccctttgtcagatggatagatagcaaaaattttctcccattctgtaggttgtctgttcactctgatgatagtttcttttgctgtgcagaagctctttagtttaattagatcccatttgacaatttttccttttgttaccattgcttttggtgttttaggtatgaagtctttgcccatgcgtatgtcctgaatgatattgcctaggttttcatccttataccaaaacctagcagagacccaacaaagaaaatttcaggccgatattcctgatgaacatcgacgcaaatatcctcaataaaatcactagcaaactgaatctagcagcacattgaaaagcttatccaccaccaccttatcaagtcgacttcacccctgggttacaagactggttcaacatatacaaatcaataaacataatctatcataaacataaacagaaccaatgacagaaaccgcctgattttctcaatagatgtagaaaaagcctttgataaaattcagcaccccttcatgctaaaaactctaaataaagtaggtattgatgggacatatctcaaaataataagagctatttatgacaaactcacagccaatattatactgaatgggcaaaagctggaggcattccctttgaaagccggcacaagacaaggatgctgtctctcaccactcctattcagcactgtattggaagttttggcaagggcaatcaggcaagagaaagaaataaagggcattgaaataggaagagaggaagtcaaattgtgtctgtttgcagatcacatgattgtatctttagaaaaccccgtcgtctcagccccaaatctccttaagctgataagcaacttcagcaaagtctcacgatacaaaatcaatgtgcaaaaatcaaaagaattcctatacaccaataatagacaaacagggagcctaatcattagtgaactcccattcacaactgctacaaagagaataaaatacctaggaatccaacttacaagggatgtgaaggacctcttcaaggagaactacaaaccgctgctcaaggaaattggaggacacaaacaaatggaaaaacattccatgcccatggataggaagaatcaatatcgcaaaaatggccacaccccccaaagtaatttatagattcaatgctattcccatcaagctaccatgtactttcttcacagaattagaaaaaaactactttaaatttcatatggaaccaagaaagagcccatatagccaagacaatcctaagcaaaaagaacaaagctggaggcattaagctacctgacttcaaactatactacaaagctgcattaatggaaacagcatggtactggtaccaaaacagacatatagaccaatggaacagaacagagacctcagaaataacactacacatctacaaccatctgatctttgacaaacctgaccaaaaccagaaatggagaaaggattccctatttagtaaatgatgttgggaaagtggctagccatatgcagaaaactgaaactggaccccttccttacacgttatacaaaaattaactgaagatggattagagatttaaacgtaagaactttcattcagtttacctcagaatgccaaaaaagttaagagaatcgatacgctatttgctagacaaattcttatttagataacttcttagaaacatttagatgtaaccaaatgagttttctgattcggtgattattggcaagtatgttcggatatgaattttaaatgtatggaatgatagtttttcatttgcttctgaaactacatgttttttttttgttttttatttatttatttattattattattatactttaagttttagggtacatgtgcacctgcacgttttggctttaagaggatgatcttcttaaccagggaagaaatacagaagaaaaatgagtagagtgaagaatgtatgtaaatgcactttagaaagaggagagaatgtgttatatttaaccaaaaacagtatttttaaattatcatttaagagacagtgatcatgaaattaggacctgttcaactcttaacataaatgttatatattttccatattaaaaatctttatttaaaatattttttaaaacattacttataaggtataatattaaacttatatttttagcagtgagaatgtatttgaggttttgtcttcaagctttagttgcaaagagaaaagtagtttttacccagaaaaaaaaaaatggccaaggaatgattcaacatcctatagtggcacgaagccaactcttctaatcaataagttgtcattgccagtaagctgaagaagaaaagaacagaaatggtttacaattggatatttccaattatttcaaagaagaaaaatatgttaccagatatgagtcaagatgacataaagtacatgatttgtctctattaactttgaccagaaccagaaaaaaatatatcagacatgtgctatacatataattaagccattaatacacaacttaaaatctctcgtgacctcattctataaggcttaaattcctgaaaaatttctccttataccattgccaaaacatgtagctaaccagaccatatacggatctgattccaatcactgtttatctcattttaatgtggtttctttaattataatgccattataatttcaggtcaattaagaatggtgtgtaaatcatacagcatttactaaaatcctaacatgacttgattaaactttctttgtgttcttggcacccctcacattcatgatcaaaagaatacaaaatctcccatggctttgcttcgttctattttcaggtgatctcttccagtttgtacactttttctgtatcttcctcatatagaaagtttttacgattttccgtgatgttacctatttttagtttcttaacttcaacatcttcctctctgaattcctccattaatgaatactgtctattcctcaagtttaattgcctcttattatcatgaataagtttccttgttaataacatataggctgtggagggcatttcaaaaaattgaagttaaaaactgtcttgggcaataaaagccagtagctcttagaggtgaacacgctcaaagacaggacttatttcggtatataaatttttgtatacctatagaaacatctcattaatttattgtgtagctcataaacacattatttttatgtcattcccttttgtaatgagaaatgatgaaaaatagattttagatttctgttttgttcagcaatacttgttcagtactgaccccatacaagtcacagtgataggccttctagaagttgatgcaactttttacattattgcagcagataacaactttattatatatgcagagtgtgctaaagatgcctgtaaggaaacacatatgataaccatcactaggaaatgtacctattaaaatttttactccatcacctcttggccagattaaatttctcctcactagagatagtaaaaaacttagttgtatcgtgtgtatattttcattgttcaattctgaaaaaatctattttatatacggggaatgctttttattaagggggctcaatttcagatttcatcagcacagctctttcaacagtctgtgttagctgactttctgaaaaaacgtttccaataagagcctctcaaaatctagtagcttaatattttatttctaaaccttttattaaaattatattgtaaaaatctaacatctccccaaaaccgtgctcattaactctgggaatctctactgttctaagaaacaaacaaaaaaaaattataagaaatagtcctatgttactttgaagaatcagtagttgcatatcaaactgattttattttaaagctgttgtagcaatattagatataaaaacaatacaaattatgattatgaaacaatttgtagacttcccattttgtaccagacaatgtactcaaaaattcatacatattttctcaatattcagaacagccacagtgaagtagttactattatcctgattttacagattagagagattaagtaacttctctaatgtaagacagataatgaacaacagaactggggtttaaacttgaggaaaataagttttaagaaatcagaaattaagtctttggagataatttttcatgttataatggaaattataaatggaataaactgcaataaactatcatggaataaactgacaaaatattgcataccttactgtagatgtaatgggcaattgaataattatcacttagcttcctttgcttccatcagctgtataggattccttccaggtttgatataattcttaaaacattgcttcctgttattgtattttagaatatgttctttcactgtttgaaatactacatcattttaagtttttctctcttaaatcttgtcttccacccatgaagttatctccttaaccaaaatagaacatgattccttgattgagatgagaaaattttttatttcatttttgtttagattcatgggatatatgcgcaggtttgttacatggttatattgcgtgatgctgaggtttatggtacaattgatcccatcatccaggtagtgggcatactacccaatagctagtttttcaactctttctctatctccctgcttctctcctttagtaatctgaagtgtcttttgttgccatctttatgtccttgagtacccagtgtttagctcccacttataagtaagaaaatgcagtttttggttttctgttgctgtgttaattcacttaagataatggcctccagctggatctgtgtttctgcaaaactgaataatttgaaagacatgatttcattattttctatggctgcatagtattctatggtgtacatgtgccacattttcttttttaaaatttttattttaggttcaggggtacatgtgcaggtttgttgtagaagtaaattgtgtttcataggagtttggtttacagattattcctccacccaggtaataagcatagtaataggtaatttttgatcctcacccttctctctccttccacctcaagtagaccttagtgtcttttgctcccttctttgtgtccagatgtactcaatgtttagctcctacttgtaagaccatgctgtatttggttttctgttccagcattagttggcttaggataatggcctccagctccatccacattgctacaaaagacatagtaacatacttttttattgcagcttagtgttctatagcgtgtgtgtatcacattttctttacccagtctaccattcatgggaatttaggttgactccgtgtctttaatattgtgaatattgctatgatgaatatacacatgcatgtgtttttatggtagaatgatttagattccctggagtatatacccaataatgggatttctaggtcacatggtaattctgctttgagttctctgagaaattgtcaaacaagttttcacaatgctgaactaagttacattcccactagcaacatataagccatccctttttctgcaacctcgccagcatgttatttttttgacattttattaattgccattttgactgttgtcttattctgcttttgatttgcatttctctaatgactagtaatattgaacagtttaatatcctttttggccacatatatgtcttcttttgaaaagtgtctgtttatgacctttgcccaccttttaatggggttgttactgcttattactttttcagtttcttatagattattagaccttagtcagatgcatagtttgcaaatattttctcccattctctgtgttgtttactttgttgatagtttttttttttcctgtgtagaagcttaagtttaagtagatctcatttataaatttttgcttttgttgcaattgattttgggggtcttagtcatgaactctttctccattcttatgttcagcatggtatttcctaggttatcttccagggttttaataattttaggttttgcatttaaatctttgacccatcttgagttgcttcttgtatattttataagaaaggggtccagttttgaccttctgcatatggctagcaggttattccaacatcatttattgaatagggagactttccccgtcacttatttttgtctactgtgtcaaagagcagatggttgcaggtgcatggcattatttttggtctctctattttcttctattcatctatgtgtgtgtatttataacagtagcatgctgttttgaagttgggtcacgtgatgcctccaggtttgtcctctttacttaggattgccttggctattcaagctctttttaggttttataagaatttttaaatagtgtttttgaattctgagaagaatgtaattgaaagtttgatacagacagcagtgaatctgtagattgctttgggcagtttggcatttttaacaatcttgattattcctataagagtggaatatttttctatttgtcttttctgatttcttagagcagtgttttgtagttgcattttagagatctttcacctccctggttagctgtattcctaggtattttattccttttgtggtcatagtaaatggatttttgctcttgttttggctctcagattggatcttgttgatgtataggaatgttactgatttttgaacatttaatttgtatcctgaaactttgctaacattgtttgtcaaaggcttttggtggggtctttagggctttataggtatagaatcattttatcagtgaagatagctagttttgacaacttttcctgtcaggatgcgttttttatttttttctcttgcctgtttgctttggccaggatctccaatactatgtttaataggaatggtgaaaatggtcactctttcctcgttccagttctcaaggggcatgctttcaatgtttgcctattcagtatgatgttgactgtgggtttgtcagagatgacttattattttgaagtatgtttcttcaatgcctaatttcttgagagtttttaataggaagggatgttgaaatttatcaaaagccttttctgtatctattgagatcaaatggtttttgtttttagttccttttttgagatgaataatttattgatttgcatatgttgaacccaccttacttgactgtggtgggctaggtttttgatgtgctgctggatatggatatggtttgctagtattttgttgagaatttttgaatctatgattattgaggatattggcctgaagaggggtgtgtgtgtgtgtgtgtgtgtgtgtgtgtgtgtgtgtctgtctgtctgtctgtctgtctgcaaggttttggtattaagatgatgctggcctcatggaatgaggtaggagggagtccctacaactcaaccttttggagtagtttcattggaatggtagcagctcagcagctcctctttatacatctggcagaattaagctgtgaatctgcctggtcctgggcattctctggttggtaggcttttcttactgtttcaaatgcagaactctttattgttctgttcagggattcactgtcttcctgattcagtcttgggtggttgtatgtttccaggaacttatctgtttcttttaggttttgtagcttgtgtgcatgcaggtgttcatagtagtctctgagagttttttgtatttctgtgaagtcagtggtaacatcccctttgggatatctgatagtgtttatttggatcttccctcttttatttttttgcctgtattagtctactagcagtctatctatcttattaatttttttttttttcgacacagtctcactctgtcgcccaggctggagtgcagtggcgcaatctcggctcactgcaacctcttcctcccaggttcacgccattctcctgcctcagcctcccgagtagctggggctacaggcacctgccaccacgcccaactaatgttttgtatttttagtagagacggggtttcaccgtgttagccaggatggtctccatctcctgacctcgtgatccacctgcctcggcctcccaaagtgctgggattacaggcgtgagccactgtgcccggctctatcttcttaattttttaaaataatcagcttctgggtttattaatcttctgtatggtttttcacatctcagtgtccttcatttcagctctgattttatttcttgtcttccgctagatttgggggtgatttgctgttgtacttctagttcctctagttgataatttgagatcttgctaaatttttcagggatgtgtttcatttttataagcttccctcttaacactgctttgtatgtgtcccagagattattgtatgctatattttgtttttcattactttcaaaaaattccttgatttctgtcttaatttcatcatttgcccagaagtcgctcaggagcagctgcttaattttcatgtaatttgattgtttgcatgattctcttagtattgatttctatttttatttagctgtggtataagagtgtggttgatttcaatttataaaaaaataatttaggattgtttatgaattatttttggtccattttggagtgtgtggcatgtgcacatgagaagaatacataatctattgtttttgtatggagagttctgtagatgcctattagttccattaactcaagtgttgagttcagctcctgaatatctttgttagttttctgcctcgatgatctgtctaatacagtcagtggtgtgttgtagtcttccattattattatgtggttatctgcatctctccataggtctctaagagcttgcttttgaatctgggtgctcctgtgctgggtacatagatatttaggatagataggtctttttgttgaattgaaccatttactgtaaggtaatgtccttctttgtctttttttttttttttaatcttcgtaggcttacagccttttttgtctgaaattagaatagcaatcattgcttttttttctgttttccattttcttggtagattttcctccatccctttactgtgaaagtatgggtgtcactgcatgtgagatgggtcttttgagacagcatactatttggttttccttgtttatccaactttccattctgtgccttttattggggcattttgcctgtttacattcatgattagtattgatatgtgtggatttaatcctgtcatcgtgtttgttagctgggttattttgcaaacttgtttatgtggttgctttatagtgtcactggtctgtatacttaagtgtgcttttgttgtggctgtaatggtctttcctttccatatttagcactccttcaggatgttttgtaaggcagatcttttggtaacaaatttccttagcatttacttatctgtaaagaatcttatttttcctttgtttatgatgcttagtttggctggatatgaacttcttggttggaaattattttctttaaccatgctgaatataggctccctatgttttctggcttgtatggtttctgtggaaaggcccactgttagcctggtgggactccctttgtagatgacctatcctttcttgctagctccacttacctttttttctttcattgaactttggagaatctgatgactatgtgtctttgagatggctgtcctgtataatatcttgcaggggttctctgcatttcctgaatttgaatgttagcctctattgcaaggttaaggaaattttaatggaggatatcctcaaatatgtttttcaagttacttgctttctctgtctctttttaagggatgccagtgaatcatagatttgctttctatacataatcccatatttcatggaggtattgttcattcttcttcattcttttttctttatttttgtctgactacattctgttagagttggtttttgagctgagagattctgccctcagtttgatcagttctgctgttaacacttgtgattgtattatgatatatttgaagtgagtttttcagctctagcagatcagtttgattcttaaaatggcatttttgtcttttgtcttctgtatcattttattgtattccttagagtttttggattgggttttgactttctcctgaatctcagtgatctttattcctatccatattctgaattgtttttctgtcatttcagccatttcagcctgattaagaatcattttctggggaactagcatgatcatttggatataaggagaactctgccttagtgagttgccagatatgttgtgctggttgtttcttatctatgtgagctaatgttctttcaatcgctgaagctgttatcctttagatctttttttttttttgtatttatcttccttgtgttctttaaatcatagacattgttaccctttggatctttttttaaaaaaattatcttctttggtgtctttggggctttgagtgtggtattagatggattcactcaactgtcttcatttctggtagattttatggggtctcagactcggctcaggactcctgggctgcatgttgtaaccctgagagcagttatgaggtcactgacttagttatctgatccattgaggttaggaacttgcagttctaaggtatttttggaccaccgatcacaacactctgttgaatgtgccagccaaagtgcttcatcaggcagtttcagtgggatctgtcctcattcccacatgccagcagcaatgctagagggtggagtgcatgtgcattagctggggtggggcactggcaggtgtggggtgttggcttctatacagatgtttgtagcagtgatggtggcaatgcaatgtgggtggggggcagggccactggcatctgtgcactcaatcacactgctagcagtgttggcatggggacatggtacttgcaggtacagagctggcagtatttgtgtgcacgttcacttcagtagcaatggcagtgcagggttggggacaggtctgctggaatctctgggcacatttgcaccagcaatggtggcacagtcagggagtggcagggtgtgctccagccggcactcatagcgtggtggagtgcatacacacatgtacatccattggggaggggaggtgatgtccacctgtatgcatgtgtgctggcaaagtgataggggggtagccataggcaagtgtatgctggcaaagttgcacagggaaggatatggtggggggtaagtgcgagtgacctggtgcacttcacaaatggctgctctgctggagctgtccgatggtcaggtgcagtctgccagcatatgagctatgatacgggcccccagaaggcactctggctgggcatctgaggctgcactgtaagcaggcacagccagactgaaactccaggtgaggccagcagacagggggctgctctggtagaactggtcctatctcggggcaggatcaatctgctcttttcaggtccactagctctcctagggctcaagtctcctagggaaacccagcaaggcttggaggatggacatccctggctgagcttcactgcagacactcctgtgccaaatcctctgggtgctacactggctgggtttttttcccctactacatctctaagcagctctccctgacaactcaagtgtctctggaggtcgtgtggtcttctgctgccaggattccaggggtcagttgtgagggcaggctgctcctcacctgctcaattcactccatccctaggagtctttgggtgccaggaatgagtcccagggcaccctagcttcatgcaggattccccatgtcctccctcttctgcctgacatctgtgtcctgggcccttggtggcagatatccctcctggctacatctagtcagccatcttgacactgtatcacatttcttaatgcaatccaccatcgatgtgcagttaagttgattccacgcctttgctattctgtgtactactgtgatgaacataggagtgcaggcgtaatttttgtaaaatgatctattttcctttggatatgtatccagtaatgggactgataggtggaatggtagttctggtttaagttatttgagaaatctccaaactgtttttcacgttggctgagcaaatttacatacctgccaatagtgtataagtgttccctttacactgcagccttgccagcaaactttaagaagccaaaaaacgttaagaaatcacttttttgaatctgtaataactgccattctgacttgtgtgagatggtgtttcactgtggttttgattagcatttctatgatgatgaatgatgtgaagcattttttcaggcttcttggccacttgtatgtcttcttttgagaagtgtctgttcatgtcctttgcccactttgtaatgggcttatttgttttttgcttgttaatctgttttaagtacttaaaaattttagatattagatcttcatcaggtgcatttttttgtgagtattttctcccgttctgcaggttgtttactctgctggtttattttgctgtgaagaatcgctttagtttaattaggtcccacttgtcaatttttgtgtgtgttggaataggattttttaaagttaaaacgaatgacttttattataatttattattttgtcattaatttgtgaaattataaattgtaccacaataaaataaaatcatttaaaaatatagcctctgcctgtttatctttttttaaaaaatatttactgaatttttattttacgttcaaggatacctgtgcatgtttgttacataggaaaacttgtgtcatggaggtttgttgtacaaatgattttgtcactcatgtattaagcttagtacacattagttatttttcctgatcctttccctcctcctaccctaccccgtctgataggccctagtatatgtttttccctcaatgtgtccatgtgttctcatcatttggatcccacttacaagttagaagatgcggcatttggttttctgttcttgcattggtttgcttaggataagcaatccatgttcctgcccaatccatgttcctgcaaaagaaatgatctcattcttttctatggtagaattgcatttaaggacatagtgataaattgttcctcaagtctactgtccagaacagtgttttcttctaggattcttgtaatttggtgttttgcattaaaatttttatctatcttgaattaatttttataaatggtgaaagatcaagggtccaggtcattcttctgcgtacagttagacagctatcccagcatcattttttgaacaggaggtcctttttctactgcttgtttttgttgactttgttgaagattagatggctatgggtatttggtgttatttctgggctctctattctgttccattgatttgtgtgtctgtttttacatcagtaccatggagctgttttgagtactgtacctttatagtttgaagtcaggtattgtggtgcctccagttttgttctttttgcttgtgattgctttggctatttgagctcttctttggttctatatgaattttaaaataatttgttctagctctgtgaagaatgatgtttgtacgttcgtaggaatagcattgaatttgcagcttgctctgggcagtatggccattttaatgatactgatttttccgattaatgagcatggaatgtttttccatttgtttgtgtcatctatgatttctcttagcagcatttggtagttctctttgtagagatcttttatctccttggttagagatattcctaggtattttatttttcatgtagctactgtagatgagattatgttcttgttatggtcttagcttgactgttattagtatatagaaatgttactgatttttgtacattaattttgtacctgaatcttcactaaggtcatttatcagttcctgaagccttggggtttctatgtatagaatcatattattggcaaagagaggtaatgtcacttcacctttttctatttcagtgccttttatttcttccttctgcttgattactctggctagcacttccagtattatgttaaataggagtggtgagaatggcgcatccttattttatctcagttctcaaggggaatgcttctagtttttggctgttcagtatggtgttagctgtaggtttgtcataaatggcttttattatcttgatgtatgttcattcaatgccttgtttctgagagtttttatcatgaagcaaggccggattttatcaaatgctcttccttgtcttttgagatcatcatgtcgtttttgtttttaattctgttcatgtggtgaacatttactgatttgtgtaagctgaacccaccttgcatcctaggaatgaagtctacttgatcatgaagaattaactttttgataagctgtaggatttggtttgctagtgttttgttgaggatttttgcatatatgtttatcagggatattggcatgtaattttctttttttgttgtgtttttgtcaggctttggtaacttgggttgatgctgcctttgtagaatgagttagggagaagcccctcctcttgaattttttggaaaaaattgggtagaattggtaccagctcttctttgtatatcttgtggaatttggctgtgaatccatctgctctgggcttattttggttggtgggtttgctattactaattccatgtcagaaattgatattagtctgttgagggtttccatttctctctgattcaattttgagatattatgtgttttccaggaatttatgcattccctctaggttttctagttcttgttattctagttcctctatctggtatgttacattgtttctgtttttttctaactttttatgatagatatttagtgtaataaactttgtttttaacgctgctgtttttgcatcccagagattttggtatgttgtgtcagtgttttcatttatttcatagaagttttatatttctgctttaatttcattgtttacttaaaagtcattcaggagaaaattgtctaatacttggttttgagaggacttcttggtattgatttctatttttattctgttctctgagaatatggttgctataatttcatttagttaacttactgagacttgcattatgacccagcatgtagttgatgttgaagtatgtttcatgtgtagatgtgaagaatttatactctgcgattcatatgtggaatattctgtagatgtcaattaggtccatttgttcaactgttaggtctgggatttctttgttagttttgggccttgatgatctgtctgatgctgtcagtagagtgttaaattcctccactattatcatgtagctgcctaagtctatcagaggtctaaaagtacttcttttatgactaaaagtgctctaatgtttgatgaatagttgagtcttcttgttaaattgaactttttatcattatgtaatgcatttctttgtccctttttttactgctgttggtttaaagtatgtttttatgtaaaaataatgtttcttttttattttctaattgtttaaccgatcttccttaagtcttttacactgaacctgtgggtgttgtttcatgtgggatggttcttttgaagacagctggcagatgggttgtctttttttattttattcaaattgccactctgttccttttaagtacagcatttagaccttctgtcttcaagattaatattgatatgtgaagttttgatactgtcatgaagttgttaactgatagttttgaaggttttattgtgtggttgctttatagtttctgtgggttatgtacttaagtgtgcttctgcagtagcaagtatgttttgttttgtttttctcatttccgtgttattactaccgtaagagcctcttacaaggctggcctagtgctaatgaattcccttagggcttgctcgtctgcaaaagattttattatgtttcatgtatgaagttcagtttggtgagatatgaaattcttagttacaatttttattctttaagaatgctgaaaataggcctccagtctctcctggcttgtaatgtttctgctgagaagtctgcagttaatctgatgaggtcctctttgtatgtaatctaacatgtttctctagctgcctttaatttttttccttagcattgactttggacagtgtgattactatatagcttggagatgttcattttctgtagtatcttgcagttgttctctggatttcttgtatgtggatgtctacctttccaagactattagcaacattttcttgaattactctcttaaatatgttttccagataatttacattttctccttttctttcaggaatgcaaataattcataagtttggttgctttatgtgattccatatttcttgacaactttttttaactcttttttaaatttatgtttttgtctcactggcttatttgaaaagatcggtttaagctgtgaaattctttcttgtgcttggtgcagtctattgataaatatttcaattctattttgaaattccttaagtaagtttcaattcaagaagctctgatatttttttaaagatgtttatctcttccttctattcctgtattgctttagtagtttctctgtgttgattttcaaccttctctttggatatctttggactttcttgcaatccatgctttgaaattcttacctgtccttggcatgtgaatgcccccaaagcattcatattttttatggtgccagaattctggagctgattccttctcatctggagatactgggatttctaatatttgtaatttgtgcattagggttttctcttcgttttcccacaatattattgttttgtttttaattttccttttcttgttctccacccagggtgtatgactgtagagaatattgagtagaattttttgtctgttcttctatagacctatatttttctgtcaacacgttttaaattgggctgttcagtttgacctacaggcctgtagtttgtgctatgggtaagagacagttacagctaacatactgggtagctacttgatcctggtttattaggagattgtctctgctgcctcagggaatgagctgatttgtggagtacacagttttctgaactgcctgattaactctggagggtagggggaaagatgtgcttgtccaaaccaggaaggctcacctacatgtcccctaatggcaggcaagggactgccattaatagtgccgtttgcaagggagaaaccactgggtggccaccaagtgcccagaggtgtgcctcagcatggagctgtgaaaccttctcagttccatgttctatgtacaaggttggagtcgggggttggaaggaaacctaaactcctaatctaggaaagtgactgttcaagaggcctggaggtctgcctgtgcattgactgtagaggccttgctgtgccacagtctgcacagggatgacagggtgactcagcctgcttatccaggcagataggttctgtgaatgcctggagacctacctggacatgccatgcagaggggtcccctgcaccgggatctcttcacaaaagagatggggtgactcaggaagctgttccaggtgagtaggtactccaaatgcttggaaatatgcctgaatgtggagtggagagggctctaatgcaacaccatctatgcacaggaaaggtggcatggctcaggctgccaatcctggtgagccggtgttttgaacacctggagacctgcctaggcatggagtggagagggtcctgctgcaccacagtctgtgttcaggaagggtgtggaggctcaagctggtgatccaggtgaatggatattccaaatgtctgaagatctgcctgggcatagagcaaatagtgcccccctgcaccatgatctgtgtccagaaaggacggggtggttcaggctgttgacccaggtgagcagctgctgaaaatgcatggagatcttcctgagcatggagtagagagggccctgctgcaccacgatctcaagggagtcagttggaacacccagcaatgatacccagatgagttccagttcaccgagctggccctggctgcaggtcttgttaccctggagaaaccacagctgtagtagctcttctcccaccctaggcctgtgatgagggacagcataattccagtgccttttcataattctgactggaggtccttaccctactttagagcaggtgacccaagctctggcccaggactaaaatgcctgtgcagccacactgctgggtcactaaagaattactgactttgtatgtgcccagattaaaaatggcatcctgctcttggtcctgagtttgggaaaatgcccacagtttttgctggtgtcttttcctgacagtgtctactgttttggacaagggagaacactatgttgctcctagatcctctccgtaaattagctctctaagttagccccagggcataggagaaacaaagtgccctcccttttcctgggtttcttggattccattggaaaggtgaatcacagagggtggctgtatgtttctctcatgtgctggggtttcacttacttttatgagctacgtcccgttacagtgctctcttccctgagatctgagttgtccttcacttttctggtggatttctgttttccttcttgaattaaagctcacagaattgatctttacgaactcttgctctttccaagtggctgagacatcttaaaattctctaatctaccatcttgggtttttaaaaatgagatgaaaaactatgagtaaactcttagtggggtctttaaagtcttttttgtttgtttgttttataaaaatgtaatgacagcacatgtcagaaaatactcaagtacaaaatgcccaaatcttctactttttataccaaaaggctggtggttttcagtcaatatagttacagtatactgaataaaaataatttataaaattaaatatgaataataatgtgttttacaatatggtagatacatttatttggaaaaagttacttgataagttgattaaaggaaagtcatttaccaaatgtgtaccctagcttgcaaaatgtgtttcctagattactacttacagagaaaaccttaatgtcaactcagtcagttaacaaaaacataatgtgatatttaggaatagtgcaagttgtcttttaaaaaattagatttttaaaccattttactcttcaaaattactttctgaactctaactttatactgaacatgtcaatcccctcaattctattagttcacctaaagccatgagtctacaatacggtataatttttgagatagaaaaaaaaaaactcagtaaagtatgatattacatttaattttatttttataatcttataaataccttcaaatataattcttacatctttgcaaagtaaaattctttacataagccccttaatcgttagctaatatggcagaaactcttaatatggaaggaatagaatattttaaagatataataaaaataaatgtatatactaaatgtgtttgagtctatgtttatagatagaagtacatcttacagaatatggtaaaatgatttatgaattttactttttaaataactattttatatgtatatacatataaaatatatacacatatatattatacatatatatgagaaaaaccaccaacattacatttttataaaatattcagtgcttcatgatggaacatataacaggattagaaaaatagcaagttcaaaggctgaaaacaaaacatggcctcatctatttgagaaaccataggtaactgtttattgaggaattaaagtctgagagaaaacaggaaatggaatatataaatttcgacaaagagagtctttctcagaagaaaattgtgctttggtttaaaggtttgaaagaataagtgcagtattttggtcaggcctgtaacatgatcagaaacattactttcatggaattgtggagtatagactggaaggatctgggcaaaaattaggaaaacatagttaactagagcagtgctaatgggtatagagaagatagaacttggaacttctggaggttgggttaaatttaccaatgtctgtggaacatccgggtgtttcacctaggcaattacataaaaaagcccgaaggtcagaggagagatctgagctatttttacagaaaaccgaaacaatcaacctatgtctataaacctttgtttatatagagaaaaaaattagaaatattgtttgtcatcatgaaggcaaactaacttgttaattgaactattttcagctagttgttttggcagctgtagacacagccttgcaatcactactcattagggtattggaactatagctccccaccctccaggggaagtagtgtgctttcataaaccatggtgaccaaggaatgaacactttcaatatgatataattaaacattacgggaaagaatgaattagggttctttgtgacatttggctaaacatgctagcaagcaaaaatacacaaatgaaggtcacatttgcaattattatacaagtgtctacattttaattaggtagctgataaatgtcattgagccttagccactgaccaactgtcattttctaaaaggagaggaaaaatgtcacctaaaaagccagaattttttgcattgtcatgaaattaaaaattgtaaccacagtacagtgtgttcagcactaagctgttaaatgggcttagggacaatctcaaaatgtagtaaagaaatatttggacagcatgtgaggtgtcactagtaatacacattttcaagcattgtttctttaaagcattgtgtctttattgtaaaaccacatagagccacattagccttgaacgtctcttctcagagagtacaagtgaacttttttttctttgcctgcagatttgacttaaattcattccttattaatttggactaaatattcactgactttctccctccaatgacaaactaatcttcttaagctcacacagtattgtacctgacctaagaataaaataaattggtatctcatctcttagatattctttattttttggaattttacatagtatttacttgaaaattatttgtccttatcccctaaaaaaataaatgaagtgtgtcagctaatatgaatcccccactaaatttacttataaaagtgccatggaagaaagtaaatatataaatactatgtatgtgagtgagtgtgtgtgtgtattgtctttagagttattctgactgatatttctgaatccattttttttaacttttaataagaaaattcaaaagacaaaataggtcgtgtgcagtggctcatggctgtaatcctagcaccctgggaggctgaggtgggcagatcatgaggtcaggagttcaagaccagcttggccaacatggtgaaaccctgtctctgctaaaaatacgaaaattagtcaggtgtggtggcgcgcacctctaatcccagctacttgggaggctgaggcaggagaatcccttgaacctgggaggcagaggtggcagtgagccaagattgtgctactgcattccagcctgggcgacagagcaagactcttcccccaccccctgcaaaaaaaaaaaaaaatagatacattagatacataaatacataaataaatcaatcataaaatgatcaattagttcttgcaagataacaatgtaaaccttttcttcagagtatgctattatcaaattggaagcaaaacactacggtaaatgaaatccttaatcatcagtgtataaagtgcttttaagaatcaaggaaaacaaatcagaactcaataggataaaagaaaatatttgatatataatttaatgatgaaatatgtatacatggaaaaatatgtgtctaataaagtgcaaatctaatgaaatatgatttccactataatatttgtagaaagtaaaaaaaagataatagatcttagccatcatctaataaaatggtatgcaaaataacataaagaaaatattgctcttttatgatgctaacaggagtctaaatattaagtcaaaaattctagaaaacagttttagcagtagctattttcacttcagaaattctgcttctctgatattcctaggaaattacagtaatagtcacaaagatttatgtacaggggtattcctgtttggttatatatgacagataaattcatctatagggatagggttgaagaagttttaacaaaacacataattgaaatatataattaattaaatgcttctgaaggacatttgtaacagagttacataattataatttatatatatgtgtgtgtgttttaagatggagcctcactctgttgcccaggcaggagtgcagtgacctgatcttggttcactgcaaccaccacctcccagttgaagtaattctcctgtctcagcctcctaaatagctggtattacaggcatgcactaccatgcccagccacaatataatattaaataaaaattagaaaattacgtgtacaaactgattccagttttcttcaaacaaaacaaaaagtctgcctgtgtctctgttggcatatctctccataaatcaaatgaagataaatccaagtttgtttttgcagagtattctgtttctggatatcaagatcagagatgattttgttctgtagtgcgcatatatttgtttataatgagaatatttaaaactagaattcagaggactcttcaggtaccaccgttttggatctgaaccctgtaacttattccctaagggaaagaattaggcgtagggaccttctgtgaccctgaaggcaacaccaagagaaatacatgttagctgattctcataccgatttggaagggtactatactgctttgaattgaattcatttgtaaaacttttgacttgagaagtagtagaatttgtgatgcatacataacttagccaagaaacagcagttccacagctggaagttgctttctgacattaaggttttgttgaatattgtgcaaatactatggatgaggcaaatgtgtggacactgatgatgagagtgacatattaaatcaggctgcaatattttagcccacttgatgtctttgtttcaatttaagtaactggacttaaatgtgctgtcagttgaggctacaaaaatcacaaccacagcagatgagtgaatttaaatggacttttacaggtatttaatctgttaaatgaaaactcacctaacttagctaaaaatgtcattgggaaattttcttttgatatcttttctttgaagaaattgctgttagttgcacagtttcccatttactcctgcatgtgcctcagtaacctgtaattcctagggtcaaagctgtaggtctgcttttgaagaaaaattgccatagaaaaaaatcactcggggacttcaataactaactcaccttgcagggattcctaggcaactttttcacgtgctgggtagcaaaataaaaaccataaacatatttccaatatccatattcccatttgtgagaaatcgccaaagctcgattcaaatttcacctctactgccaagcactttttcttggtatcagctgcttcttactagatgctccaacatgagttagcttgaacagtaatcctattatgcacctattcctctctcccttttaagattgtgccttgtgacttgagcatcacagtgagcctgtgatcactggaaagacagtaacggacagctaaagattataagcatagggttttctttaatggtaaaatataaagaagtttatttgctcagagcagctacacaagcaggagccagtgtacccacacaagtaggaagacacaacttcctttgtccctaccatcttgtttacagacacacatctgcccaagatagtacccatgtggagtgaggactcccccaggcccgggaaaaatttttgtttactctatgggggagaatgatgtcagaccctcttaatgctatatgcttctattaagtgtaaaaataaattcacttatagccccaatttgaaaacaactaagccttttcgctaaaacaaattgtgagtatagttttatctgagtggctctgttgctaagttttgttgaaattccatgattataaagtgatctccttgaggtttattttttttctcttagtttataagaactccttgaaggcaaagattgtatgttttattatactttttaaaaatttccatagttaccttttaatgtgggatatataataatcatttcacgttaaataaattttaaatcctatattgcattatttgtgtctatgtccaaaaatgtcataattatttttggccatctaggattccattatataattagccatcttgaattccattcctaaatccagaattgaatgagtacacccaccttttacagattctatgttctacacggcaccataggaaacactgaacttgatactgaacataatgaaacacatgtttatttttaatataactgcatatgtaaaagcacaacttgcccacagaattgtttctaaaattgggaggaaatacattttgtgtaattattttctaattgctaagcaatgctagctttttttgatttgttataaaatactgtctgatctatcttaaacacacagagaataggaaagtaaaagctaatataatcattacagttaaaactttactgaaatctttaattatccaaaacaagagggaattctttaatcactaaattaatttggttatatttctcaactagctcctgcctttgctaatttcctcagtgattcatattcatattgtgagggaaatattaatttaatgcaaccatatattatgctcttggtgatttaaaaagatagcatcataacactataggtttttaaaaacttaacagccatgaaaaaatacaaaacaagaaaactgttagaatctcctttttggcaataaaagtctataatacccagtttaatttgtaacaatgttcatgctctatctgtgaatacaactaagaatttactatttagaaaagacaaagttatccaaatcttacataattatgactacaaatatttacagcatacctgagtatcagttgtagaaataatttcaaatcacgcttcttttcccttgtaaatatgtctattttttcagtcttatgcaaggaataccaggaatgcagtgccgttaactttttttcttgtatcttggaactatcaaagtttaaatgcctgactccagtgctttaaaaatcgtgtatttcatcctctgcatatgctttttgctcttgaagctacaacactgtaaactttacacataatacatttcttggagaaagtgctgagttgagacatagagtacatctgatttgggctatttcaaactctcatatgccatagatgcagacaaccaaattgaaatgatgcacattatttgtaaattattaaccatttctaaatattctccacacgactggctttgctgaggtgtttcatccatccttgcaagcttcataaaacagtagcaggccaaaattgcagagttaacattaattctcatcaaagagaggacagccttagcaattactttgaaaaaggtcaggtatcagatttctttatgctgactttgatgccaaatggagtcacactgcaggcttggatattgtatgtcttctgtttttttctgtatactctgtcatgaatacatagtgccactctttgctgtctgacatataagttgatgatggaatattctcaagaatattatgctctcaagagcatcacacatcatttggtactataatttatttatatttttacacaagagcctaaacagacatttaaaatcaaacttcaaaagtagggaatacatgatttatatgaatatctgtcatttcatgacttgtgggtgttgctcactcttctgtaccagtaaaacttaacagcattgtgtcgggagtcgatagaaaagattcagatacagagtccaatagtgataatacagttttatcaatcaatattttaggagcggtaaattttcttgtaaacatacctctcatatttagggacggaaatagaattctgaagttttattggtgtcagaaaattcaggaatattttgatgatagcaagtgattaaatactttaaaatatatttttatcatattgacattttattttatcttcttcataaatattgccataaagaattttagttctgcatattctaatccattattttgttaatattttatttataatatttatattttaatattataactattatatttataatattaatattttgttaatattatttacattggatggcaatgttatgatctctaaaatgaccttttatttaatggaaaagaatgctattagttccaaggactgaaagtggtggcaatgtcattctgacttaatggagtacagttttattaaataatgcaagttcagttgtcccagggtcattatattaggaaatatttaatgaaggtattaatatttactcctacccaacctccagctggaatttcatggtgtgagagcaccaggttaattgagttttatcacaaaatctctgggccactttagaaataactttaacacatgctccctaaggtctaacctacaaaaagtgagaaaatagaaaaagaaatgattaacatgtaactagatttagctgacatcttcagcatagttatttattaaaagactgagcaactgatgaaaatttttctctgaaaagaaaaaggtatgggtttgaggagagtgggtaagatgctaattatccgtcctgtatgatgggagaataaatggaccaggaaagtgaagtagtatttcttggaaactcaaaaggcctactggaagtcagttatcacacactgagttcttcctttcaaaccctgaacaggaatatggagaaaagatgggtacatgttgctctagccaatagaatcacaagaatatatacttgtggagttttctgtagatatatagagtctattcatatccaaaacttttcttttagaatttgtttttgggaatacacctgttaggaaaataaaaaatgtaatcatttcctttctgctcttcactttttcagttcctcagggtaaaatgaatatgacaattcggtattcatattctcattttgtgacccagtcaaagctggaaagggtaaactcagtattcagttatacccacaagagtggtacaggataataactaaactctagataataataacaaaaaataatatagaaaatgtattgagttcttactatcaggcaagcatagtttcaactgttttctgtatattactttatttgatctttacaacaatctatgagggaattcctgttgttatcctcaatctaaagtcaaggaagctaaatcacagagctattcctctcttgctcaaaggcacagagatattacgatgtggaatctagatttgaattcatgccatctgactttggaacctctattgcaaacagatttactgacagagctaatctcacccaaaaatttcattcagtaaaatgcgtggccaagatggaggaggaggatatatgcatcgtagccaagcgtggagcttttattcccaggaactgagcgatgatggcggtactgtaagaatacaagatgttggcaagttttcattcaaaggcactctgctttttttttctcctttatgtttattacatgtattatagttcttggttttataaatttttagaataattttgtttgtttaatgttcctctactaatattttaccaactggtaaaatcttaccaatttaccaattggtaaaatcctccaccaatactcccagattgtaaattccacaagtcaggtatcatttgtggtttattcatggccatatcacctgttcctaacccatcgtaggcattcattaaaaagttattgaaaaaatatcagtgaaggttgaatgagaaaacttggaaaaaagaatgttagaggttgctgaaagaatgcgagggattatgtgtacaaggagtctggtccagaccccatcagagcatcactcaatatttctatttcactgagcctctgaattctgagcctaaaatttagatcaaacctactctgctatttctttaagtgacagctcttggggtgatgaataaaaacagtttctgaatcctgagtatgatttaccaaatggtctatcttagaagacacctttccatgacagaagtgtggaaattgttaggatctgaagcaaaaccacaaaaagagagtagagaggtttttgttttgttttgttttgttttactaaaagtaggagtttaaaagagcataggaaaatattggaatatcaaagacagaagtgagttcaagtaactgagactaaagatgaaattcctctgggagggagttgatcatttaaagggtactttagatagagaaaaatgtttcctagggtgtgccaacattgaggagacaaagaactagaaaaggagataaaaagtttccagtgaaatagggataaagacataaggttgtggtatcttggaattacataaagacaatattcaaaggaaaaagaaataactgtgtcatacactcctaataggtttaatgtagcaaaaaatggtccttaaacttagcaatatcttggtaatttttatctttaaagagagacattgtggaatgatataagcaagagatcttataaaagttcaagggaagaaggggggataataattgaatacttttaccatatacagcacttctaaggagtcttgttgtaataaaaattaggtgagagaaatgataaggtcatgataattttatttaaaagagaactttttatatagttatgagaacattctaacaagcatacaaaaaattgatgctgaaagagagacagaaggaatcatctggagagatgtccttgaacagtgaagatggaatggaattcaacatacacaaatacagggattggcctttaagagatgtacagacatcattcatgtgactcagctcatattaatgaaacaaggctgagtgtatgcgtgtacaggcagatggtgggagcatgtgagggactgtctcttctgattgcctctattttcttaataaaatagaaagcagcaccatcaagaaggtcagaaaggtatgggtttgaggagagaggctaagatgttaattatccatcctgtattatgggagagtaaatggaccaggaaaatgaagtagtgtttcttggaatctcacaaagcccactggaagtcagttatcacacattgagttctttcagcatgatactgtattctttggctacagagtgtgtcgacagttggacttaaattagcaggggagagagttagcctgggaaaaaaacagtccagggtgaagagcagtgtgcctgaaggtgcattgaaggaattgagtaaggttacgaattatgaactttaacctggaaatggagggagttgaggaaatgagagcagggtgaaagagagtgaaagagtgttaggatcagtagattgtaggtcttgaagtagttgagatgccaaacagaaagagatgaaattatgtattagtctgtctccaccctgctatagagaacgtctccaaactgagtgattataagggagagatttaattgactcacagctccatgtggctagcgtggcctcaggaaacttacaatcatgatggaaggcaaaggggaggcaggcaccttcttcacaaggtggcagtagagagaattgactgaaggtggatcttgacaaacacttataaaaccatcagctctcatgagaactcactatcacaagaacagcacgggggaaactgcccccctgactcatttacctccgtttggtttctgccttcacacctggggattatgaggattacggagattataattcaagatgggatttgggtggggacacaaagtctaaccatattaaataatataagatgtacagaaaaacacacttaaatgtagcaaggggatgcagctatattccaccctcaacagatttctgcatttgttaatttaatttagtctcacaaagttgagcgttagataaagtcctatcaatgaaacaacatttcccacttatttatgctaatatattttcagagatgagaatcctcagaactaagactgaggagtggggaaactctgaggatatgtcatagaaaagggctgggcagctaagagggcaccaagttggagagttaaaaatatccctgagagaggaggagaccccacaatactgtaaatcagttgcactaagaccatacgactgatgaaagccactttctaaggactgggcttatttgtcaaatagaatggaaatggtaatgcagggggttccagaccatgtccagatcttgaaaaggcctcttcatcccttatgtctgaactcacttttactgaaatctgtgtgcagtgccctgtgtggagcaggcaggaagctatgatactgctgtgtgcacaccctctgcaggaccatcttctccacacctaatccacttgaattgatttaacaaaagtgggtctctgttgaggatgaaacataactgaatccactttctctgttgaaattcaagtattggcatttctgtctatttcatcttattattccatctctttttgtctaggatcccaactccttcaatacttaaaatagactgattttaacaccctttcagtttctgcaccttgcatctatttcttcaattccctccctcaccgggttagagtccgtggtccataacattattcacttccttcagtgagccttcaactacactgcccttcaccatcaattattttaacagactaacctctctaacccccaatttaaattcaactattaatagactatagctagagaacactgatcttcaaaactattgaatgcttccttgtctgtattgaaagactttcgcttcctttcactttgtgacattccactttcctacttttttccttccctttccagattcgagtagctctgcttttcttcaaaaaaaatgctaatgttggtcaaaattccattttcaacaccctatttcttatttcacatacttccttggcaagcttgtctattctcagtttcaataaccatctatttggttaccatttcataatctctctgacgaacctgcgtcttccttacgtctgcagaatcttaacatcaacatgaatgtcctggaggcaccataggctctccatgtgtctaaaactgaattcatgagcctttacctcaagctcttgccttttccttcattcttacctatcttctagtggaggcaaccttgcctgatttttcacttttctttagtgcctccaatcaaataaaccaataatcttatttactattcccatacgtattatctccccatttctgaccaatctttgcctatattacagctttagacccttgagtcatctttatttggtcttgttcaaatatggcactacagccagagtgatctagaacttacgttgctctcctttcaaagctgtaccagtttaacatgacatgctagacgtttcatcatcggcaccttgtttacttattcagccttacatgtcctcccacctctctccctcataataccctgcgctcctattttaatccaccaagcaggccatggtgcctttactttcaaggtttttatatattttcttccctgtctagagtatctttctttccctactgaagacttgactgagctaatcactaatgaactttcaggactcagtttagatagaatatccactggaaagcattttctgatgacttaaagctgaatgagagttttctctacccatgcggggagcccataggtccttgaatttacttttatatcacatgatactaacattgtatgaatactgccttttttccccactagatcgtagctccttgagggctagggcaggattattcacttttgtttccctagcatttggcacctactaagttgttatcacatgtttgttgaatgaatgcttgaatgaatgaatgaatcaattgccacatttctagtaacagctttgcgttcacattaattgatgaaaagggaatctttactgcaacagataaaactgattacataacaaaggaagacctggcgtagtgcgcttagccaaattagcatttggctcatctctgtatggagtggcacaagcccatttgtgtaccacttagtatttggttaaaatatgtataagatttatagccacaatgatgttcctggcctttttaaaccttactatggcctttctacttttcaagtttttcattgattattcttatctggctttaagaactataaaccacattatcatacttcactgtaattgttaatactagtctgggatagttttttttttttttttttttttttcctttataaatgagcagggcagagagttaaaacacaaagcaatagattgcactgagaaatgaatacgttcagaaactacaactacaaactaccttaaaggaaaactcattcacttttcattaccttacacctctaggtgccaaaacttgcatttaattccatgttttaaaggagactttatgtctacccataatctgttcacatatagtttgcccaagggaggttaactcttttcagttaaaattgatccaccttcatcagacttgtggttgaccagcaaagagtcaaggacatgaatctcttaacacctcctgatggtcttgggctacacatatcatgctcattttaagtgtggaaaacatctaaaaatatactttttagagtttcagagaaatcatatttacagcttcacagaacagaaaatattaaacttaatttgatgcttaacacctaaagtgttattttcaaatcatagaaaaatgctttttgcattctaaaatatctctgtaagacagcataattattctaaataattttaattaattatgagaaagcttacttacagtgatactttttttaatcaaaaatttagttagcaatgattattaagtttaaaggccagatactctgaacaaaactaccttttttttttttgagacagggtcttgccctgttgccagtctggagtacagtggcatgatcgcagctcactacagcctaaacctcccaggctcaagcaatcctcccagctcagcttccccagtaactggagctacaggcatgtgccaccacatgtggctaactttttgtactttttgtgtagatggggtctcactttattgcttttgctggttttaaacacctagctgaagtcattctcccacctcggcttccctgagtgctgggattaaaggcatgagccgacgtgcctggccacaaactgccagagtcttagaagtatttccaagatcagcaaattgtccagcttaattgatactgtacatataaaaaatttccaattccttatttctctttagagttcatcataattagtttgtatttttaaaaatttgatccatatactaaacttattgtttcttatggacataaaggaaagttagttcaatccattttaggcaggatgctcaacctttctaaccaaacaccttaggaattaaaatatgaaatttatcaataatcaataaaaatgaaaatttcatcattgtttccccacttaatagtattaatctgtacacattagataataaaacctagaaaataaatttcattcatttttttatgtaccagagtgaatttgactacttttcaagaacatgaggtattacttagagcctagttaaaacacatgtgctacattgaacacacctcatactacataataaattttagtaaatgaagttcctatctatgtttgtagaatataagtgaaatgttggtttcctcactgcattttaataataaggaaagaactgatctatgtgaatgggtattgtaatattaaggtaaacttttaaaagttaatttacaaattttcctgacaaagtataaagcttgggcttttgactgtcttcccttctttcctacttacctctctctctctacttgctttcttccttcccttctgccatcatttttccttttccctctcctctcctccccttccctcccctctcctcccctcccctcccctcccctcctttccttaatattatagctagtagaattttcagaaaatattaaaaaatataaaagtaacattttttcacactctcactgtaatctgaatttgcttgcagctccaaagaaggtttttagtaatgtcttcaaagaaacaatcttcataagaaaaaaataaactagtttcctcaaaattcagattttattatattttttctcttacagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatggtaagtgtcaaaggaaaatggctccagatagaataaaggaggcaaagaagacttatttaatactgttgcaacagagatcaagactattccagtaggagagagtgattgaactcaactctgctaaaaatgaaagcaggagagtttttaaagctggggtgagctagtagaaaactggaggatgttaggggagatactggtaaatgtgactaggccatctgtgtttattgattggtgcttgttgaagttaggctactaccttttcatagagactgggagatagagaacctgtttcttgatggtttcatttcaaatggagagctcccaggccttgagacagacactactgggttataaaaatgacaagagcctgtgttggttgtaagttagtcttcttttctaaacatctttaaaggatttgtatgcattattatgtaattgcactctataccaattataatttaggattaagactaaatactctcgtagaatgaaagtaaaaatagacatttttggaaggccaatttgacagtgaatatcggaaacataaaacagacctatccttcaatccagtggttttatttctggaagtgtattctgtgtaagaaaataataaagagagcacgcaaagataagtatatacttagcattacttatgaatggaaaataagaaaaaatctatatatccaacactaagatatcagttaaattaaagactgctctacagctattggctttatagtttgaataacattttctagatgttgtctacctttgtcatttttggatccatcgacaaaataatgcctggttcattaacagcaggatgaacggcacctgttattactagtctctatccagtctattttatatagatatgccattcagttttctcaacacatatgtgaagtagatattgttactgccttctatagaaatgaaaactctgggacagataagtatttttcacaaggtcacactgctaataggtatcatagctaattttcattcacatcaacaatgattttaagactagtacacttaggctgcatttcatttatgactgatgaaagaataaacattcaaagatacatctcgaaggaactaagatattggaaagattctgggaatgtcaattattaggttgtggtgccaggtgcaggcaaacttatcctttgtgattataccaattgttgccatgtgcagcattgtctcgtagtgttggcatctaagttgtatgtaagcatgatgttagaactccagaaatgttttattttccaaagtacttacatttaatataagtttttaactttctattaccttaagcctaatatgaaacatattttctttaggcattattatcttgtggagtggcattaaggtagaaaatcaagtgatcagaactgtgatctacttgtatagtcggtataattttcagccaactagtgttctgcctctttgttctcttgtatcaaatggaagttaaggtagtcacaatggtcaatataagtatgaattcaaatccatgaaaatgatgagaacaataaatattgggacataagatggagccagctgtgacaacaattcaaggtgtctactattaatgcttgtacacctactgtgagctgatcctattttgggtaattagcagacagaaaagaaagaaaatctggtcagttacatatttcacagtatttcaaatattaaaatagaattgttattcagtaaaagcacaactctctgacactttgattagacaattttttttttctggaagatcatcattaggagtttattattcgatataatggcaagtgacctgaacattacttttactgtacccataataatgagtttcatctgtttcaataaaggcagatgaaacccaaacagaaacaacaaaatgagaagtagtaattctctaaaactgtgctcctcaatctttacagataaaaccctcattaaaataagaccccccttcaaagattgaggtagggcaagagaataccacttacaaaaagctcccaggtgatggtgatggtgctgatctgtggatgatacttactgagtggcaaggctctaggctggtaaccaatttaatatcatttggtcctctgctaatctagtttaatccatattttagagtataaggaagaatggataatctgagtattttccaagtaatcttccataactactgttttctcttctgagcattttataaatcttagctagatgtgactttgagttctttttctctgacaagagtctgacgtatggcttttgtcaggtaattccctttagccttaatagagagtaaagctgaggttgacatgctcttacgaaaaatgagaaaagtaacagagcctgaatagaaagtcatcccactcctgttcagagttaagccaagaagtaccccagacagagcaaagatttttatgaaaaatataaagactcagcttacagagcaatttggggaagcaattctacttccggatatacaacttggagaaaccttcccatacaagtacgaggaaataaaacgcatcttcaccacaatatgtttaagagtaaaggttggaaacagatgtccatcagaaggggaatggatacgttgtattatttttatttaatggagaactaaaactgttaaagtgaatagaaagaaaatggatagacctcaaaatagagagtgaacatggtaagttatggagtattatatataatatgatatcacttatgtaaaacaatggaaaaatatatcctatttatggatacacataagtggtataattttaaaacatgaacttgagatagcaggttgactgcagtgcttaccactgcggacaaagggagaatgagagcaggaaataagtaccaggagagggtatatacattatctcaacttactgatactttatttcttgaaagaaaaaatctgaaataaatataactcctgtagtgactagacactaaaatgtctcacagtaattctcacttggcatttacaatgtaatctctcactttatctgttggctatggctattaacttgcctctggagaatagattataaataaagtaatgggatatgactcccaacaatgggttacaaaagccactggcttccatcttgtttgtcttttttgctttctggcttgctcatattaatggaagtcagctcgtgctgagagctgtcctattgacaggcccactgggagtggcctctggccaacagcccaagagtaagtgaaggactcagttcaacacccctaaggaatttgaatcctatgagtagtcacgtgagtgagtttacacgtgtatccgtacctattcgaacattgggatgagacagcctcccaccttttgaaagacacagagcaagggttgagccacacctgcttccctgacccacgaaggctgtgaggtaataaacacataatctttgttcattttctgggtttcctttctactattttaactgtaattctatatttctgcagaaaatcattctcatagtttcatagctttaaagtttcctttatatgtttcatctattttaagttgctgtgtcatcttgtgattatctcaacaggttggtattcttttctaggaagccagttcctacattcagcccagatttgtttattcaggtcttgattatgcattcttctttgttctcctttatattttctacaaggcctactttttagtcctgtttgttatataaacagatgctacagagaaaatctgaaaaaaaaaggcaaatgctgcaattagaagagatataattccaattgtcctactattttaagtgctcatagtttatattaaatgtattattctttattcattacattagaaattgtcaaatattgaaaacataaaggaaataataatttcatgaaagtgtcttgtgactatatattaagtttattaaactttaatatttttccaaatttgtttcagtattttttgacataaaattaaatttgagagttcttgagtattttgcttggattgtgtctcacactttctccactcttagaggaattactatacttattttgtcatttacatgcatatatttatatttctatatgtgtgaagcctataaagtacatgtactgttctttaaaatttttgtgtcaatgatactgtgtatatcagtcatgatccaccttttctggatcaacattatatcctagagattcatgtatcttggtatcttcagttctaagttcatttcatttcctgtaaagcataccacactaggactcaattacagtttctttattcattccctttttgtaaatatttaggttgttttaattttacattgttacatgtcaaatggattttttcatgcctcattggtaattgtattataagtattttaggagtgcaatttttatataaaagcattgtaacatttccagatactgtcaaattgctttccaaagtgattgacacttctaccaacattattgtataggtgttcgtatttctccacattgtcaccaacataaaatttttttggcaatctcttgagtatagtataccattttattgtggtttagtttgcattttcttgactagtgaggttgaaatttcatgtaaatattggacattctggttttttctaatgcatatttcttattcatatatgttgactgttatttctgttagaatattttacttacatttaactgtaggaaatttacaaatcagttggtcactggttaaatgcattgcggatatattttctcagaatgtaacttaactttttactttgtcagtagtaccttttgttaaacagaattttttgattttgtgtaatgagatatagcaatattttcctttgtagtctgtgcttttcatgtcctaaaaaaaaccctttttaccttaaatttttatttccttccaaatttaaattttgattttcatatttaggtgtttaaaccacatgaaattatttttgtatgtaatatgaagtaattacctgattttatttgttttccatttttggagtggtatgtattaaccaatgtcagtgatctccactgatttgtgaaaccactcacttatatatgttaaaaatatactttaaatccttcagtaacatggtttaattttttggaaaacatttttcacatctttaagcttattcctagatctcatacagtttttgtctcctcgaaaataataatatagtaagaatagcatagtgtttgttaagttggtatatagagccctatcaatctgttactgttgtctgttatttctgttagttcttgctcatatggcgttgtctaatagtatgtgttagatactatatttggaaaaattgcttgtaaaaatagtttgtaaaaattgcttgtgtgcttaggaggaaaacagaaaaggtttggttaaaagtagccagtatctgccagactctttaatttctttaggatgttttcgcttttcccttgctttacattagatagactgttttctatatgtaattcctctctcttgtattttttttgcatcatatgcctatttcttttgtgattaccattaacttagtctatagtgattatcactaatgaaattaagaaatttctcaagtataacattatttgataattttgttgtttcaaacatatgcgtcctttagtgttttctcttttactaattttaccttattcacaaaaatatgtttaaaaatcaatacttaattatattttctgtaacatcactatctatagtcataatttcttataatttttctctgtgttcactttttggatgaagcatattttgtggtaaaaaggatatcactgtgacaaactatcttagtctttatctgtctgaaaatatattttgccattactcttgagtgatagatggttttggaaagtgtaaaatttctaggttgatagttatgttccctttgtactttaagtatctgctggcctcttttgtagcgggcaagtttatcaatctagttgttatttcctttgttaatagacttccctgtggaagttatttttttctaatgcttgccattttgtacctttactatgtactttctaaaagtaaatttatttttgcttattcacccagcacttaagagacaattcaaaagaaaatataatatagaaatgttataatttcagagaaaatacaacatctttcttttcaaatgtgcaaaatccagctctttttctgattcgtctgttcttcatttctacacttttttgtgttatatatgcttacttagtttaaggaagtccattcctgaatttgtactttggagtatcgtaagcatatttattttaaagtcctgatagatataagtgtattttatctgggataagttcttattcctattattgactttggcttttttttgcaatatagaattttttatctatgttgtaatttttggttttctttgcaagtacatgtggaaaggaagtatttttattatgtcttataatgtctttaaaatgtcttataatgacattttgaggcattacagttctgttggggctattgagattcagtcactttccctgggaatagcttaactaagttcacagtcaagaagctatatctgccttctttcatctttgcaagtccacacctttcaatgtactgtagcctcacatgctcacagaaacagacacacatacgtacacacaaaaggcatccaacctgttgttataggtatcatgacagaggtacagtattatttggtaacatagaatagaggcatcaaatttaacctgtgttgtatgatcgggtgaagcaaaattgaggaagtgatactggatctaaaatatattgcatgtgtagaagtacattatagataaaagaaatcatgtgttcaatggcaaaggggtaagagagaacactcctatgtttaaggaaactgcacgttatatattatagttgtagcaaagtatgaatggctgcaatgaaattataaataggcttcttattaaggagtctaaaaattttatctgtgttaacagcaagcctccattaatcagtggaatctttttagcagcagttgcctgtgagacctctgagcatgcagatttaaaataataataaagtctctctcatgggaggaaggaagtaagggggggatcagaaagatgctttcacatttataaaggaaaaaactgataattatttcaaggaaagcagtagtagcagagataaagagaaaataatagttcatcaccctgtattctactagagtctctccacatagatatatttggtcagagcagctgtgttcattggttttttgctttttgttttgttttgtttttgtttgttttaatgcgagacagggcttcactctgtggcccaggctggagtgcaatggcctgatcttggctcactgcaatctctgcctccagggttcaagcgattctctaacgtcagcctctctggtagctggaactacaggcacacactaccacactcagctaatttttgtgttttttggtagagatagggtttcaccatgttgtccaggctggtctcgagctcctgagctcaggcgatccacgcaccttgacctcccaaagtgctgggattacaagcatgagccactgtgcccagcccattcattggttctttttaagttttattatgtctaattgtcttctgtgtgtcctgaaatgttttcagcattataacagcaatagcctgaatccattatagaattccaaccatgtgggactaaattaaaaggtaaaatttaaaacaagactagactaaattgttagagtaaattccagaagaaacatgagcagcatatagtgataacacatatttttgttaggtctgttttggcccagaaacattttcatagagacaaagtgtatatctgtaataacttacacatagctttgtttccaatattttaacaaatatttttagaggcttattaacagattggctctaaaaagtagcttgaatggctcctttatacaattactttacctctctatagtataatgttaacagtaatcagaatgctttctgaatgtttgtgacgcaaatttttacgcagctctctcgactatttttctttgatcggtcaataacatatgtagaataggattactactgtgaacataaaacactatctgtacaagtttattaaacagagatgtactttttacattttttctgtaggagatattggccatctactgtgtgcaagctgtacattaactcatcacaagagagttattgttttaatctctaaagttttgaaagtatttgataagtatgattgtatagcacattcatatgtattatactttctatttgaaatagaataaaataataatagttatatagatcttcagagatatgtacaatgattttggtcaagtactaaatcagtaatgtgaatagctcattataagagtaatttgtgaaaaaaaactttatgagcctttatataatggctactgcttctttgtaaactaatgatagcattctgtcttagtccattttgtgattctgttacagtatgccacaggctgggtaatttaaaatgaacagaaatgtgttggctcacaattctggaggcagagaagtctgatacaaagtgctagaatctggtggggacattcgtgctgtgtcatcatatggtgaagatggaagggcagagacagtgagagcaagaatggataatgcaattgcaacaataatggcctaaccacctcttaaagtcccacctcttaatgctgttacaatatcaattaacttttaatataaattttaaagggaagcaccttgaaatcatagccgataccctatgctattttattaaatagaaagttaattatcaatgaatatgaaatagtttttgtttacacatgcataatcatggaagcttttatccaaatttaagtaagatacatggaaaactgaaagaacctttcatatattattttactacactcaagagaatttacattattaaaatcatgtatctttatcttcagtggtcatgttgatgatgtattttagtcacagatattaaatttgattatagtagttgtcttaaacaatgacaaatcccatctaaatgtgagcttttgtataaaatattcccatattcatggaatgtatctgtacttgctatattctatttccagcgagaattagaaaacatcatgtctgatttcactttattatttatcatagtagttagatcattttagcaacaaaagctattccatttagagcaaatttagtgattatgttgtgatgtttaaaaagtgtgatttacaaaaaaaataaggaagcttttggttatattttaattagctctgttcttttgaagatattccctggtgatatacttaaagaagcatcaaaatttttagtgatctgaaatgatgaaaatacatattctaatctacttaaaaatatttggatagaggttaatctcataatttgctatacatatgtccacatttaggaagtacagaaaaaggctgcattcagaattactgtgttgcatgacgatgaaaacatggttgtgaatattgtggactggtccatactaggcagagaattcacatcacatgttatactttggtcatccccaggctttatgtttgaaaataatcaagaaaggcacagtagtcagtcactgatacttgattgaggtgaagagatacacatagtcaatgaataaaaacttctgagctagtctcataaaataaagaagagaaatggagcagtacctggaaaggtgagtgctgctcattggcgttgagcaaccagaaaagtcctcagtatctactctgttttcaacccgatactgttattttggataatagctttgatctcttgaaattgtgtcaatgcaaatgtttcatagacctaagaggtataatgtggtttaaaaaggaacaactgagttgttaataattactctaaagtagttatttgagtacaaagagtgacatttaagtgatttaaaaaattgaccaaggtttaaagtaaaaatatgcaaggtaacataggttaattgaaagctcttatgagttaacacctcagacacatgcaggatatatgctttcgggggacataggcaaggattattaaccagagctgacactatacctgttcctccctctataaatataaactgatccttgatttcatctgtttttattgttgttatgattttagtaggagtaaacttaattaagtgtagggtgcatttcattcttctatttgtgatgagatggttaggttaagatattttatttttgcagagaggcagtctggattaggagtgattcaaattagataggtcaaacttttttcgggggcggggagcatgttcttctgtttgtcctgattcagagactacagtgctgtttttgatggcggaaatggtggtccttagaggaagcaaattatttttctactaaggctaagcacataattttgctctctttaattccctcaatggtaaacacaatctgcactttataaaccctctgtgtctacgcaagcttttaaaatttttagcactgtcttctgacaattggatgattcctgcatttacaaatttgtggccttatgtcttcagtacttttggctaaattttatcatgaacatgatttattaacagatttgacttggcacatgggcaatggcatcctgactcaaagcaacccctttggtgacaattttctgttgtttcctcaaaatactctttgctgataaattgtttgagagacacaagcacaaaatgtgatcttttatgaaaataagaattctctcttggagggggaaattgtattttatttggatgacacacttctaaataaaatacatcatgtcagtttccccaatttaaaaattgagaccatattctaataataactttacagtcttatgaccattcatcaaaactttatgactttattctgctattgtagtcttaattttaaagccatttattattttatacttaaatgcttttttaccaatttaagtatatgtggtgtgagcaaataccatttcatagtctcctctttattctctttcagcacttacagcagtgcaaggttactgggagcttaacaaatattaaataagcaggaacctatttgaggactgcttcatttttcttgaaatctataggctgaatttctataccatgatagtatatttactaaatatttttgaacacaatagtggattttggattataaatggaaaggagaaagaataatgtccaccttcaacaagatgacctattggtttggcatcctgtgaatcttaggttggtgtaaatggaattgaggtttcggaccatgaattttaaatcatgataactaggttccaatacatctttattaatcaaaataggaacccacacatttttgctaatgaaaaataaatttgtttattcctctaacataataatccatgcttcaggattcagcaaactcttggaaagcattttctgcatcctcctggttgtggaagtgtttttcctgcaaaaagttgttgagatgcttaacgaagtggtagttggttggcaaaaggtcagatgaatatagagaatgaggcaaaatttcatagctcaattcgttcaactttcgaagtattgcttgtgtgacatgcagtcaggcattgtggtggagaagaatttggccctttctgttgaccagtgccggctgttggcgttgcagtttttggtgcagctcatccatttgctgagcatacttttcagatgtaatggtatcaccaagattcagaaagctatagcggatccaactggcagcagactgccagtgaccataacttttttttttggtgcaaatttggcttaaggaagtgctttgcagcttctctgttcaaccactaagctggtcatcatcagttgtcttataaaatccacttctcattgcatgtcacaatgtgatcgagaagtggttgattgttgttgcatagaataagagaatatgatacttcaaaatgttattttttttaattttgagtcagctcatgaggcacctacctactaaggtttttcacctttccaatttgcttcaaatgctaaatgactagaatggtggacattgagttcttcagcaacttctcgtgtagtcagaagaggatcagctttcatgattgctctcatttggttgttgtcaacttccaatggccaaccactgagttccttatcttcaagttccttgtctcctttgcaaaacttcttgaaccaccactgtgctgtacattcattagcagttactgcacaaaatgtgttgctgatgttatgagttgtctccgctgctttatgacccattttggactcgagtaagaaaactgcttgaatttgctttttgtctaacatcatttccatagtctaaaaaaaaatcaagtaataagtcattagcaaaaaagcaagaaatgcccattaaaatgatatataacataaccacatttaacaatgcattccaatatccaatggcaaatcccaacgaggcaaaaactgtaattacattggcatcaacctaacacatggagttggtgcactttgattgttatcataagtgataatattactgcatcctctgacctctcttttatatctgtacgaaagtgacaaaaaacctattagactttaacttatgttgtgtgtacaacgaaatgctacactacccatgaaacattcatcaatatgcttgttaataaatcgttctcttcaattcttagaaatccttgaaggttttatagtttatacttgtttaagtttcataaacttcatttcaatgttgaaaggcaacttaaagttaaaagaagatttggacaatttttttaagaattcatctaagatacttggtgcaaaaatttttctcaccttgtaactatgtcatcataaaatataatttctagttaacacttcaaaatttcttgaaattgtcacataaagtatactaatgatcattaaaatggcatttcttaaaattttattgggcatgataggctgctatttcctttatattatattactgagacacttagtttacattacatgaataagctagtcacagacataaattacagctaaccagcaggcagaacagttgcagcctggcattagatgtaatccctgagaaaaataagcacagaagttgatgtagatgtaatccctgagaaaaataagcacagaagttgatgttaaaaagaggatttaagcctgaaaggcagatttagaattgagggagacatgataatgttgggtcatgatccaataaaacaatcgaaacagtgatccaaaaccaaaaagcaatcctttctgagaacctggctgcaggagtctcagatggatgatacttaaaatgtcttgatatgaaggaagttataaagttagtatctgggtagcctatcagtaagtggcagaagtttcagaaggagctagagaggaccggacactaacttgatcctaggacaggactctataaaggaaactattgtctccataacaagataatatacagacaatccctaatttaaggtagtttgatttagaattttttaactttatgatggtgtgaaagtgatatgcattcagtagaaaccatactctgagaacccatacaaccaatctgtttcttactttcagtagagtgttcagtaaattacatgagatgataaaactatattataaaataatctttgtgttagatgactttgcttaactggagactaatgtgagtgttctgaacaactttaaagtaggctaggataaactctgatgttcagtatattagttgaattaaatgcatttttgaattataatattttaaatttaggaatacgtttgttgaggtgcaatcttattgtaaactgaagagcatctgtactactgctcctagaaactccacttggagataggtagatggggcttccagagtcataatttataatagaacttgatcatcctgttcaagaccctcttgtagaagactcttgccaacaccaggctaactttaggcagccattgtctcctgtttcttgctctagctcagtgattcccagttgctgtgtcgcttccttcttcgtgtttcagacatttgtgggggtagtctcagttattcaaggatgtaactttcatttaggtagtagagaccaggaattccaaatgtcctataattgcaaagcacaggactcttaagtgtcctgacaggcatttttgtgagtgaaaattctcttcatagttatctggtaaaataatctgactggatatttcattacctatgtggtatttttaaatatagtggatattttaatgcaaacactgtatgaattgcaagattacacttagttttgttcagaacttaaccagaggttgttgtccatttagaatacctactacctaacactggtgcctctcatgacacttgggtcaccaattgtagacacctggattagtttgcgtttgtagatgctgcattcacggggatttttatgaacaaaaactcttgattgcttctttatgttgtctattataattctgaaaacttacatattgaaaatttattgaattaaatattgttttaggctgggcacagtggcttatgcctgtaattgcagcactttgggaggctaaggtagaaagattggtttagcccaggaggttgcggctgcagtgagccatgattgtgccagcctggatgacggagcaagaccttgtttcaagaaaagaaaagaccaaaccacaattttacagcaaacgattgcacttttatttgtccttttaaaatcatttttaaaagaattacccgtaggtagttagaatattcattaatttcatttgacaatcacaaaggaagagcataaaatagttatgatttaaaaactttgagaactgctagatggatgtaaggtactttttctccattccatattgtttttctcaacttgctgagactaagatagatggggttactactaaggctcagggataacaaaagagtaagggaaaaacaggaatacatatatatgattttataatttacaagtttagtttaaacatctctgatttatgctactctagatgactgcctccacagtcaagaccatcttgccctagccatttatttgataccttgttttcctaatgtaaagctgagagaaagctatccagagtaattcaggagtttcccttcttatatgtctaccttccatgtttcagttaactgtttgaagacctattgcttccatgatgcaaactcctttcaaaaagtttatgttcccctccaaggagactctgtcctttacccagattattgagtcctactttgctgtacgtggttgccctgtggcgggtaagatcagtaccatcactacctaaaattggttcagatgcagaaactgatgatgacgcatatgttcaaaaagggtatgaagagatttattcttcgtaacatgaggctttctgagaagacacattggtatgaaaacagcctgagtgaaaaaaggaatgaatgacttggatttttaactgtggttgtgaggtagggttgggatgagggttcctatgtgggccagggtttgtgtggtgtaaacttctccactggagtcagggcaggaggtgcccaacttctgaccttgcccagaggtgaggcaatagggaaaaggcaaataatgtggcttgaaagctgtcagcagtcaaagagctgacataatgtcagactcttaattacatgagtctatagtgaatgtcagtcactttaaaatccaaaacaagaaccacagcagcacccatacaacataaatgtgtacgtaatagcactgggccttctagaagggttaacataggatttaggaatggaaacatatggatgaaaacccattttcagaatatggccatgtgaagaaggcttggagctcaagaattaagtagaaagctaatttaaaaaactggagcactataactggtcaagctaaatacatggttgactggttaaatacctcctgtcataggccctaggcctggaaatacatgctagctaagtagtaagcaatcaagtggtctgaactagagaagatggtttatcagcaagactatgtaatattgttataggaaagaggtccggatacagaccccaagagagggttgttggatcttatgcaagaaagaatttagggcaagtccgtaaagtgaaagcaagtttattaagaaagtaaagaaataaaagaatggctactccatagacagtccaaagggctgctggttacccattttaatggttattccttgattatatgctaaacaaggggtggtttgttcatgcctccccttgttttttttttttttaatttttctttttttttaattatactttaagttctagggtacatgtgcgcaacgtgcaggtttgttacatatgtatacatgtgccatgttggtgtgctgcacccattaactcgtcacttacattaggtatatctcctaatgctatccctcccccctcccccaacccccgacaggccctggtgtgtgatgttccccaccctgtgtcgaagtgttctcattgttcaattcctacctatgagtgagaacatgcggtgtttggttttttgtccttgcgatagtttgctgagaatgatggtttccagcttcatccatgtccctacaaaggacataaactcatccttttttatggctgcacagtattccatggtgtatatgtgccacattttcttaatccagtctatcattgatggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccttgaggaatcgccacactgtcttccacaatggttgaactagtttacagtctcaccaacagtgtaaaagcattcctatttctccacatcctctccagcacctgttgtttcctgactttttaatgattgccattctaactggtgtgagatggtatcacattgtggttcatgactctcctttttagaccatatagggtaaattcctgactttgccatggaatttgtaaaatgtcatggtgctggtgggagtgtagcagtgaagatgaccagaggtcactctcatggctgtttttgttttggtggattttggctggctgctttactttagcctgttttatcagcaaggtctttatgacttgtatcttgtgcttacctcctgtcttatttgtgactgagaatgtcttaaccatctgggaatgcagctcagtaggtctcagtctcatttttcccagcctctgttcacgatggagttgctctgtttcaaatgtttctgatgatgatatacagttcaatgaactttgtttcttaatgaaattacatcttctttaatagtttaaaatgattttattttaatgtaatattagccaacatcagaaactctggacactataacaaattacttcttaacacattaacatgtttcttttgtattcacatcacattctgcttagttgttgaatgaagtgctctccatacagaaagttttggaaccactttcagttgatctaatatctttgatatcttttaaagccttactggcatcttctgctcctttacctttagaaaactgacaaataggagaggataaaagattgtgcatgacttttttttgtatctagtcctgtattttacatacatttcagtctagaactaagtcacatggccccatgtcaaacctaaaaaaggccaagaaagtgtcccagtgttcctaggaaaaggaaatgggattagggagcatctagccagtacttgccacacatgagtaaaaaaaaaaaaaaaaaaaacctatcaaatatcacatgtgataatgatgacattaaaattacactaatataattttaacatcaagaataaagtgggctcttaggaaatactttattgagtgattatgattaaaattatttaaggtcagttctatgggttatatagaaacagctttgttttagtaaaagctaaaagtaaaaaaacttcatttttgttaatttctcatttttcataatattttattagagggacttagggtatccttagtagaaacttcaaattttaatcttaaaatatgaagtttataaaatacagaaaatatgtcaatttctataagttaaatagttatattaacatgcaggtaaatgtaactaccagaaaatcttgagtaaagtatgtctattatggagtagaattgggtaaaaaactgtcctcatctaggatacaaatttacggttttaattttaagatgaactttatcttcagacaataatctgttatgacctcatgtattactggatgtaaccaagctaagactggatatagatcccacagatatttttggaaatgatgcctgaaatgaatcgttcttcttccagttctgaaagcttatggccctatgatagcataaaaatcaaacatctatcaagtatttttattttctccagtatcactctttgtaaatgatacttctatctcttattttttgttttttcatcttttatttttaaaataattttctcacaattaatatagggagaggaaaaatggtttattagttacctattcctatatttaaaaaatcctcaaaacttagcaatttaaaacaacaatcaagcattttctcttcaagtctgaaatctgagtaccttagctgggaggttctggctctaggtctttcatgaggctgcagtcatgctgtcagttatagctccattctcatttgaaaactttacaaagggaggatccacttaacaattcacctatgtgattgttgttaggcctcagtttcttgctgccttttggccaagccaggtatttcagttccttaccatgtcggcctctccacagcctgaaaaaatttcctttggatatgcaatggtcttcttcttgagggagtgacccacgaggaaagtgtaccccagaaggaagttgcattacttagtattagaagtaatatagtatgccttttgcttttagctagaaataagtcattaagtcaagctgacactcacggggaaagaaattaagctcaactccttgaagggagggttatcaaaaaagttgtggacatatcttttaaactaacccaagtaggtttggaaaaattcttcacaagtaggtttggaaaaattcttcacaagttaattggtctaaagatgatataaaaggcatgtttactttatatcattattttgaaatacaattaaaacaaacaagattaaaaaggaggcatgaaaaggttactttcattgaaacaaggaaaaaaggcttgaaaataatgaggaaagaaatatccgacaattgcctttgtcgtcagacttcaagacaaatatcagtttacctaatggtaagtcaccagcccttaaaagaaatgtgtactcaattgttcattaataaaggtaaaataatcgggtgaagtctgtgtgaaagtggacaaatgactcaggatacttcagaacatatcgaaggaggcagtgaaataagaactactatgacaagcgttttatatatatatatttttttcaatctaagtttttgtatgggaggaccattgaagttgaggcagagggaaggaggcaagagattgagaaaccgtcagattatagtcaaactcctaacctaaggattttccctgtgaaccacgcagatgtccttaaaaaggaaatagggttaatacagacatataacatctatgcatttagatattactgataatcacattactaagaacagttaaaagaagcaatataagaaaccaaagtagatataagataatagaatatgatatgtaagttttggagctcgggaaacaaatggaagagagaaaaaatgattaaagagttgaaactcttagtagtagtaatatatttgcacctaattagatagtaatacagcaaccaaactcaacaaagtcaaacaaaaaagaagataaaccattacacagtttatggagagaactttttttctttttaaagaaaaacaaggtatgcctaactggtatgaggggaatagagcaaatgagaaataaattttcctgaaaaagaaagtcataagactgaaagttaaaaaggccaactgagtcacagaaaaaaaaatcgtacaagatgactacaccaagacatatccctcaaaattattgatattcacgggtgagtaaagaatcctgtgggtgtccatgcataaaatctggtcacttaaaaatgatgacagttaggccggagtcagactacttcaccatggtaatgtccattgttaccagagggtggaaaaatacacgcaaaatcatttagttaaattagtagtgaacgtgtaatttgatacctgccaagttgtctcttaatgataaagaaagaatacatacatcttaactatgcaaaaaggaatacagcatacaagagcttgtttttggtaaaaaataaggaacttagaaatggaaaaaccatgggaagatacataagtatctagtctcataataagaactatgaataagaaactttgtaaaatatgcttatcaaacaattgagaaaatttaagaagtatacttgagaagtccatcattcttcgtagcagagaataaacagattatttccaaattgaaacaattcttttctaagaaaaaaaaaagcctcttgagtatgaccctggcatttcacagacaataaccactgacgttgtatgttcagccaactacagatacctagcagtttgttaataagagatctgatagaggaaaaaaacacagaaaaccattgcttttatgagacgttaacattgtgtgtgatgacatctgcccattacacaaatgtgtcgaaggcttctacttggttgaagagtttaattaattggctatcaagatctttgtgataatttgctattatacagcatttgaagtgttatctccaacaagttatagattccatcaagcaaaagagtgcagaatgtaagtatatggatttaaacagtggatcattatgaccagaagataaaattcactgctacagcagaatgaataaaaaatgtatctcagtatatctataatctctttacagtagaaacatcactgattatctttgctggggactgggaagctgtacgtagacatgtttcttttcccccccttaacatgaattttacttctaagatgaaaaaaggaagggaagggagccactgtttaacttggcatttgaaatactttctttttcacatttctatttactgtcatttatgttgacgcactggcttaacagcaacaaaataaatgatggagtcactgaatagggctaagatgctttgggaactaacaatgaacagcaaagagatgtctcacaaagtatgggcagtaataataaaatatatgttcagattagtcccttattatttagcctataatttaccaaatcttacttctctagttttccccagccggaccatattttatttctcttgtcctgttttcacaattttcagaacataaaatttggaaccagagaatcttaaaatcaactgtcttcttatacggctaactttgcaggagtctcctctaagaagcttggagttttcagcttgcaattagaaatgactatgatactgagctgagataattagataatatatatacatatataaaatcatgctttataaatgttagcacataagtataataagagtgagaaaaaggggaggaggaggaaaagaagcagcagaagcagcagaagcagcatcagcagaagaggaggaggagaatgaaggagaaggagaatgaagaaggaggaagagaatgacaagaatgaaaaataagaagaaataatagtcatggtagtagtaagcagtttcaagaattcaatagccttagatttatattccaggtttgacatttatatatatatatatatatgtggtgtgtgtgtatatatgtgtgtatatatatatacacacacacacacacatatatatacacacatatatacacatacatatacatatatatatattttttttttatggagtttcactcttgttgcccagacaggagtgcagtggagcgatctcagctcgctgcaacttccacctccattgttcaagcgattctcctgcctcagcctctgaagtagctggaattacaggcatgcaccccacgcaccaccacgcccagctaattttgtatgtttagtacagatagggtttcaccgtgttggccaggcttctctcaaactactgacctcagatgatgcacccacctcagcctcccaaagtggtgaaagtacaggtgtaagccaccacacccgggtatttcctttctagatttagctaattgttttctgtctcagttttgtcatctctaagataaaaggactgattattgccaatggtgattgtgagtgtttcgtgatattatgcatgagaagtattcagcataatgtctggcatatagtaattatactacaagtaaatattagttattaatcacaatttattcagtgcttgcaatatacaaggtatttgcaaatgttaataacaactgatattcctactaatactgtaaagtaggcattattatccacaaataatacttgagtagcagataatcaaagatgtttggttcatggctaaaaaatactactactagaatttgaacttacatgtgtccaactctaaagctcaggagttgtctataacacttattatatgtgaattttatgcagcatagctatttttaatgtttaagtcatagttttaatgtgtaaagatcagaaagggttttttttcccacagcgtaattctgcaagttaattcttaaaatttgatttataaaagttgtgatttataaaaatttatagaagttttccaattttttataaactcataatgcaacaacaaatacaaaattttgacaattttctctagttatttattaaatcatttatttttcttttccttattgaataaaagttttaattgacagcaatataatttggtacagtgagacatattctggttattttggtgtagtattttgctcgtagctcaaaaaaagtgcagctaggccagtcgaggtggttcacttctgcattcccagcactttgggaggcctaggcgggcggattacttgaggttaggagtgtgagaccagcctggccaacatggcaaaaacctgtctctactaaaaatacaaaaattagctaggcatggtggctgtaattgcagctactcaggtggctgtggcaggataattgcttgaacctaggaggcagaggttgcagtgagccaagatcgtgccactgctctctagacagagtgggagtgagactctctcaaaaacaaacaaacaaaaaacttgcatctaggttatctaggattcaaagaaaatactcgtcagtacatgctcatagtgactgctcaatttttatttggtttagaatactgtgaaaacttttgttttacttcgccaagacaaaatatttaaagaaatatatttaaagaaagcaaatcattttactccaaatttgttcttctaaatataaggtgtacatcttttcccagaatttttttttagctcaaatttcctggaacatttatttttatactttttttctgaatattttcttgtgattatctgcaaaagatataaacttctgtttaatacatatattggaactatgtctttactgaaataatttctctttatctgtagcagtagtttttaacaagggtcattttgatcctagagcacatataacaatgtctggataccttttttattattacacattggagagagatgctactggaatctagtgggtagaggccacggatgctgctaaccattctacaatgcacaggacagccccgcctcaacagaaagatctgtcccaaaacatcaatggtacagagactgagaaacctgatctagggctattatgtgatcaaattcatgatcaatgaaaattaagcaaaaaaagctttactttttcacaaattcacaattcactatgctatagatcttagatacgcacacgatgctctgaatgcttacgtaactgtgggctgacataacttgtattatcctctgtacatttgctcatcatttctccagctgacttggtctaaaactcaagtccaagttgacatttgaagtccatttttagtttcactttcttcatgaaattttcattagcttcaaattacttttatcacacacagaatttctctgagtattagctaactaaaatagaatcgagtgtctggtatatagtaggcaataaatttatgtgctcttcccactggcctccacttccttttatgccttttgtcttctgatcttattgactatttagttgtataaagttttgccattttaattaagttgtctttttttgaaagcatgtcttatttattccatgaaaatacctttatgcatgttacatcatttttttacaccccagaattgttagcactaaatgtagtgcttcagtgaattaatgaagaatataaaaaaatgcaagaggactaatattttcatacctgtagcacctaagtagtgacacaatattaatatattacttttgcgtgtgtattatttttaacattctaagaattttacaaactttcaggttttttaagatattgtttatgcttaatattattatccttcagtctgattttgaaaaatgaaaacaaagatatatatttaaaatataaatgtctgaggtttgttttttatgtattacacgtttaacagcatttttagttgattaaaaattatatttggttctttacaatttaataaaacaatgcagttttctagctattccttcttttgggaatttacctgttgattacaagaaaagagcaagaattttgaatataagtaagatggaaaagaaaaaaacacaaaatatcttgctagtttaaggaaatttaaaatgtgtctgttttgtctttacagaaagtgtggactatgggccagtttttgtgcaagaaccagatgatattatttttccaactgattctgatgaaaagaaggtagcattgaattgtgaagttcgtggcaatccagttcccagttacaggtaggaattcactgttaatcatttttcttaagccttaaaaactttccatcaatgatattctgacactctcagggaggattatacatatttgtcttctgattttttcctaagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctgtgagtaaaatatatgatttttctatatatatgtatatagtgtgtatatacagtatggatttttaaaatttagttcaggaaagaaaagcctaagatctcaaatcttttttttttttttttttttttttgaggcggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtttcagccgggatggtgtcgatctcctgacctcgtgatccgcccgcctcggcctcccaaagtgctgggattacaggcgtgagccaccgcgcccggcccttcttgggatattttgaaattttctaaaagatttgctgtcctcaaaataaacttgataaactagcctgacaggttgaagtccttttcatgaaagtagataaagttttagaattcataacagtctattttgaaacccaccactttttatgtgttattttcaagtctttgagttcaaattaagcttcctatgagaaaaaaaaatgataatccaaatttcttttgaaatcggattctctccatctcctttttaagatatctataattctactaactactatagtcaccatttgctatggatttctaagaatataagatagcatattctaaaacttctgcttatagccaggtaacaaaaaatacctctgaaatgctaatattttagattttgactatatctcctagatgtcccagttttcgtattgcaaaaaagatattgtatgtggctatacggacatagacacacacacacacacacacacacacacacacgaatataaacatttctaaagtagataatacacctgattaaatgaaaattagccaggtgaggcagcaggtgcctgtagacacagctacctgggaggctgaggcaggagaattgcttgaacctgggaggtggaggttgtagtgagccgagattgcgccaccacactccagcctgggcgacagagtgaggatctgtctcaaaaaaaaaaaaaaaaaaaaaaagaagtgtgtatatataattaactaaatatgttcttaaaaactcttgaaattattttacttataatgagagcttacaataaattaaaaataggctaataggtaaaaccttttattattattccttaataagtaatcctacttgaaattaagttcttgaggatagaatctctaaaaaatactgagaaagactaggaatctttatattaataattaaagtgtaattgtagtggctacataagagatcatgaaatgatttttaaattaaagttacacctggaagaatgtaataattgatatttctctatgtaatctttcccaggtatcatttctaattaacccagaattcagacaccctattaaagaagtgtgaaatagaaaaggaaagaataaagaattgataataaatacagtttgaagagtaccgagataggtcctagaaaaatgtaaatatcatattttaaagtagatttgcctaaggaattcagataggtacatttacataggccaaagacaccaagatagcagcctaaatagattcttttttattttggaaaatattatgtggtgtatcacagaacctaatactttacattatgcacaattaatcaagtagcctaataaactaaataaataaccctcataatagctcctttattcaatagtcttttcaagatagatgcagaatatcaagaaaatatgctatacaaatattagtggcttataccttacagtttggtctacagtatttgatacaaggtataccagttagctatagcctgtatgtcagttgtttttccctttgtggaagcaaatcatgccaacttttttctgcatgcgtttagagcagaaagctatttattttacatatccatatgactgtcctaggttttctggaaagaccaaacatagttgtcaaatacactcatctgaagtgatgactttggcagcagcgtttacaattcaatgaccaggcatgggaaatactgtttatctaaagtatcttacctatttagcatgaagctgtcttcaacttgatttagagcaatatctgcttatttttaacttaagcattatgggcttacataggtattcagtggtagcaccttatgactctgcccctctctactttccaccaaactcaggtcattggctacatacgcataaaaacccacaaggtacctggttaaagcagacagttacccagggaagaccaattctgcctcaaaattgtttctccacctagatgccattatgcttattcctatgatattgaaacaatgaagtcccatagatgtagtttcatctatttttccagtttatctttgaaaataaatgcaaatatgggcagtagggagaaaagatgaagatttgattaacctaccagtatacctggatgggagtttgggtgctataggattcggggactcagaatcgttcaaagattagggagagaaactgaggtaggaagttggggagaaaaaagaaaaggggttcctgaaatgaagtgaaagaacacaaaggcaaggtgaaacttgaaaaattagtccgcaggctgggcgcggtggctcacgcccataaccccagcattttgggcagccgaggcgggcggatcacgagttcaggagttcgagaccatcctggcgaacacggtgaaacccatctctactaaaaatacaaaaaattagccgggcctggtggcacatgcctgtagtcccagctactagggagactgaggcaggagatcgcttgaacccgggaggcggagcttgcagtgagccgagatcacaccactgcactccagcctgggcgacaaagcgagactccttctcaaaacaaaacaaaacaaacaaaaaattcggttggcaactttcctttacattgagattttctgaagaccaggcttgtaggtcaatatatttaatagaatatactcactgttgctggagtgtttaatgtctgaaaggatttttgtggaggaatgcttattacttttgtcacattttaaagctaaaatattttatatctaccaggctttatttatctaaaaatataaatattcattatacaactaatatttcaaaattaatatatttaatcgactgagataatgattaaagcatatttaatccaattttgttaaacatttattaaatattgaatatgagtcttaaatttattaaatgttttaaaatcagactaaatttataaatcgtcaaaatgattgcaaaacttttcactgatacagtacttataattccactttgtagctattcttgaggcatatttgcatatgttactcagtttataatagttttattgaatacttatttttaccttttacactttaattttatcatatgttgtaaaatacctttttagattatttttatgctgggctagtgctatcaggatcttctaaagtcaaacatgaaggaggactgtattacccaattcaaagtctatttttgaggtaccaaccaaatgagttttgattgcctctttcaaattcgagatctgtttaacagaccagttcactttggtgattaaccattattattgttatatcaatgatactttctaaatcttcaccttttactttttgccttttaaaatttgacaactttgcttgaaattgtgtgattctataacttgttgaacagtgtttaataaacgtaggatggggctctcctaattatattcataaaaaaggtactaatttgtattttataataggtatatacttaattgaagaattaagttatccatatactaacataatatcaaattatccatatactaacaattattatacatatttattgtgataagataaatattaaatataataaaatgtaaagatatatcatcgaagttttctttcttttgcatgaaaattacatattttcaaagaaaactttgatttttagtatcattaaagtcacatggctttttgcagattcaacatatatatatatatgcataattagtatatatatacacatatgcataattagtatactgacactcccttaatgctaggagtactcttattaaccagaaatatattttaaaatgttctgcctttccactaataacagcttgccttcctgctcccaaccccttgtcaggcatagatttacctgcttttcaatgagtgtaatgtcatagagactaaaatctaggtgctgcaggtgcatattagatagcaccaaataagttctggtggtaggtaggataacattattgctaaaccagatagtaaaaaatattttttaaaaataggttttgaatgtctcaagctcacattgacagcttgtatttactgaatgcttttgttgcagacgatgctctgtttcaaatacattaactcattttatcctcataaccaacatacgatttgttcatgttgtaaaatgtaaattcatttttcagatgataactctaatttaaccctaatagtactcaatctttccctattccagtataaatgtgtattggatttcttttttgacttagccaatttgacttcagaagttctttttctaaactttaattaaattggaatctttttaaaaatcttacatgcttgcttcctcagtcatcattttagaatttattaacacctatgtaacaaaaattaatattagtaatgaaaataagcatgcaatcatagtgttctgcatttcttctcattgttcagatttagtttaaaaccacttatttaattttccttacagaagtttaacagtttaggagacattgagtttctttccagatctggaattttgggcttatagtaattttgatgtgtaatcactctttcttactaacatattttttcttttaataaaaccttttcctcataatttatttattgaataacatacagtgaggacctagaaagctacattttctaaatgaatttgagacaggacaaagataactgcagctattgtcaaaagctgatatcatcataggtcctagctttcgcagaaaatgatgacaaggaactgagtattgacaccttttattaatatctggtgatgtagcaaaaataaaattatatatagcatttggaaaaattaagcaagtataaagcaaattaaattgtttttaaagtttcatttctattcatttgtcacccaatatatttacaaatatgaaatagcaaatgtatgcttgtataataatgttactttattaacatatttaatgtttacctctttcgaaaggtgatttttttttacttgctgtgtaagatatatgctcaagatacatgtgtaataaagtaaatatagtcctaggaaaaaatgtaccttataacaggtcaaggtagtacagaccataaagtgaaacaaatatttccctggtggtcagagcaaaagaaagaaagaaaaacatgtaaaggaatctaacagaatctatttcccctgcacacccaacacttcctcaaagaaacaaatctactcttgacaaattttcataaaaattttttgtttgaggctttttattgcaacccctacagcatccctacttcaattcaatagcaagtttaattagcttgacataaagccaaaaatttccttaaccggaactagaatttaatcatgaagccattcactttattcactgattaatttttttttctaattttgatttggacaactaacagatttagcagctgctctgtagtggttcatccacccccaacctgcctcatgggcttaaatgtctacccatgaggaacttcattttaaattctcccataaataaatatttatatataaacatggttcagcttagttagtgttaacacttagtttagcattaataaacctaaccctcacaagggtgtagtaaaaattaatgaggtggagaagctgtgttaatgaactggtttttaaggttaaaattaaaaacataagcgcaaagctggagtgatttcctagggatgattattactgattatcaatgagattatttttgacaaaagatattttattcctgaagcttatgtttgtcatgaggataatttcctcagctactgtagtgatttctcttcagtgacaagcaagaatacaccatataaaactttgtcactctcacactttgcaaacatccttcagaaatccaaagctcgtagcagtttctccacagttgggatttttagaaataattgatgccagaaagtcaaacatataatgaatcaggaataaaatctccttatgctgtctcttacttcaaaaatacctttatatgcaattcttggtaaattgatagttcctatctaaatttgaacatactgcttttcagcgcatttagtgatttagatccagaatattccattagttttccttgaagcagttgattaaaataacctacttaactctttgagagattatatgactttttaggctttggatttaagccctttaatttaacctttcattttcatataaaactcaaaaattacttctctggcttttttcataactttttctcctaaggtaaaattgaccttagagtttaaaaccacattttactagtagtgtttaatacctaataaaatgatttgaataatcccaaactccacagtatatgcaaagctttatttcattagtctctgaggcttagcctataataactttattaaatcatttgaatattaatctgaatgagtcagattgacatggatgaatttactagttgtaaaattattagatgttattacaaaataaattagtgtttgtaactttatcttccatatacaaatgactctttttttaaggaaatcacaactcacaataaaataatgtttaagtgtttctttaaaagtataattactttggtcataatagatacagtaactgtgagtgtgtaatcccttggcaaaatacagtatggattattggattaagttcagaggaaacaatttaaaaatcaaaaatacataattttatgatttactttaaaatactgtatagatggtgtctagctatttgcccaggctggtcttgagctcgtggtttcaagtgatcctcttgcctcaatcttccaaaatgctgggattagaggcatgagccaagatacccagcctaattttatacttttaaagcaaattatgaagagtgaataaaagttgaaatctgttttagactaccctcacactcttatttcttttacataaatcataaatttgcaagtttttttaattcaagtacaaccaaacaggtactttcattatgtatgaaaatcatgaataactctgtctttatgtgacagatgacctgcaacaaaatggttccattttcctggcttggcacagggtatattttatcatagtgctcttttgttttgcttttaggaattcacaaagtcagttcttcattcaagttgtaaagtaacaaggatcagggactgtatacatcttctgacctttaatgctcaagcacatttacttaattaattgtccttaatccttagtagagtgtttgtggagacctttcccaagcataggagattccaaagcactaaagaacaatagacattttaaatttcacttaattgtgtcaggttaacatgataaaatagcaacatatcatgataaaacagcaaaatatcaggatgacttatgatcttcttgagtataaagacaccaatatagtacaaaaaagtatcaacaaaggggcagtataaataaaggggcagatagagactattctaagatcatttcattccacagtaaaatatttcactgagggacaagtcagaacagaatatgtagtaccccggagatcttgcagacttaattacacctgagtcaaagaaacaacaattattatgcattgactttattccacaccaagtgctaaatgttgctatgtttcatgtgtaacgaatagatagacggataattgatacttacatagatatacatagagctatagatgtgtgtgtgaatatatatatgtagcaggtatgtgtgtatatgtaatatatatacgtatatatattatttgtatatatatatttttttgagacggagttttactcttgttaccgaggctggagcacaatggtgcattctcggctcactgcaacctccgcctcccaggttcaagcgattctcctgcctcagcctcctgagtagttgagattacaggcatgcgccaccatgcctggctaattttttgtatttttagtagagacggggtttctccatgttggtcagcctggtctggaactcccaactttaggtgatcctcctgggattacaggcctgagccactgcacccggctttatatatattttaaaataacatggtaatagtaaaatttattgaacatttaaattgtaggccaactgctaaacatatttgatgcaccaccaccccctttaatcctcacatcaatttgatgaaggaagttctattattgacctaatgtataagtggagaaaaaaaaaatgaagctgagggaagtcaaggtatttcttcagccacacagctagtaagtaataaaacagtagctccaaatcaaatctaacatcaaacttcctacttaaaatctttataatactgccttgttcaactcaaaacatactttgcattacatttttgttttgcatgtctgtaattaatgtatgcatgtagaatttactcattatctgatccctctaggacattgttctgggtgttagcctatagtgagcaatggacatattaatagtgcttgaggctagcaaaatcagtacaaaccattctatttcatataaatttccttgcctacctggaatacctgaccactttttctatttcctaacatttttcttctttactccagccccactatactccctctgtattgcttattggaattatctatgcaaaacacaattctgactaggttacccctacataaatctttgatggcttacattaattgcatggaagtttgtaatttgccctacgggtatacagaggacaccaaagaataagaatgttgccttaggaatatgtatccagagaactctgtagggaaagtcacattaggaggtcattttaatattccaggtaaaaagggcttgaattctccctctgtgggaggcttgaaaataaacgagaatttgtaagtgaatgaataggtggtggtgggagtataaaaacatatggaggagttagaatgacatcaagattctgagcttgatcaattctattgaacaatttataatgccagtacataatcaagtcacacagataaggaatgtaggtttctgggagaataagtaagtttagtctgagatagatttattctgactttcaggagaaaatacccaacatttaaaaatatttgttggtgctcaggaaaggcagatgggaactggccacaaaacatgttgagagactcaataaaaccatggaaatgtttcaccaacgacaatttgtgctaggaaaaaagacaacagacctaaacttcaggaatatatgtgtttctctcacagagacaaaataaaggtagaaagaaagaagctagtgaaagagagaagaaaggatgatgcaataaaatagagtataatacaaatgatgttcaaagtttaaagtggggactgatatcacatgctaaagtaactctcaaaaaagacctttgggccaggtgctgtggctcacacctctagttgcagcactttgagaggctgaggcaggaagatcacttgaggctaggagttcaagaccagcctgggcaatatggcaagccctcatctctaccaaaagtacaaaaatcagccagacgtggcagtttgtgactatggtcccagttacttgggaggctaaggtgggatgatctgttgagcccgggagtactaggtgagctatgatcactctactgcactgtagcctgtgcagtagagtgaactctttctcagaaaaacaaaagcaaacaaacaacaacaacaacaaaactttgggttttgagacctttaaaggccaagttcagtatgatagaaacagaaatcataatccaaggcaaaccattttccagctttctctgtaattatgaggctatcctaaactctatatagtcctcaaattaaagtactaggtatcataatgaatattgattttggccataacaggaatgaagatgtgaacaacacagcttcatggacatgacatgagactgaaaccatggtggtctttagtagtagaaagaagagagtccatctagaggatgaggctgaaattagaaaacagagtctgattagtgaaatgaatttctcctttccaagtaaggtatctagatcctctagattttcttcttccagggaaatattctgccatatggaatatagtcagcattgtaaatattatgtcaaactagaaaaatttagagtctgcactctcacatcttgacctataagcttaaactaagtaaaccatttttatatcagccaggaaggtatacaatttctagaaatattttcttcattctttagaactaattttcatttcatatccttagaatttttttcaataaaatacaactattatcataataaaactagaaaccaatatactctttccataattctctaacatccagtgaaaaagtctcatgatggttaggctaaactgataattttcccattttaaaaaatgcagagagaagtaagaggataacaattctttctaagaaggctcactaattacctacgtgttgtgcagaagggctttagcacctgtgaattcatggcctcagttcctaggtgagctttctgcagtgttctgttttgtttttgttttgagtctaattcagtattttgggcaatttctagggctacagctggaatttctcccggtaaattctaacaagtcatcttctgctttttacagagcttttttaaagttcaagtcctcttcagctaactgcagtgtcagccttggttcaaattataaatgatgctgtatgagtctgtgtagagaggctcagattagatacaccttatctttcacaactttcttagaataccctcagacagtggactttcaatctattctacaagaagttgtttaaaatggtacccctggaagttatgtttgtggtgcctatagtctaagtgtagcctcagatgtgatcagagtaacttctgtatgccagagagatgttctgctcattccatgggacttaaggggcaagtatggagtagcactgtgcactttattcttgaatctgttggaagactaaatatttgagaacacattgatcacatagtgctctttgggtcggaaaagctaaaacaatgaaaaatattagctctttgtctaaatctattcatatccatagggacagggttaatggcttatgaaatggttaccataccccaataaagttcacactcctacaaatggcctcaagaccatttattatttggactctgtcatttttccagatttctctataattattaggctgtcgtaaactatatatatagtcctaaaagtatttcatgctcatttatgatatcatgtctttatatcatgttttctctgcctgctgggcaactgttcaataacccacgtctctctgactgtcttcctctccctgttactccctccctccttccctccttccctctctctctatctatctctatctccctctctctctccctccctccctctctccctccctccctctcttcctctctctctgtctctgtctttctgtctgtctctccctttgtctcatatgattcctttatttatttctggtgacatttcattacaactatttaaaacaatggctgaagccattccaagcacaccactgactttattagactataaactcattgagggcagatttcatgtcttttttatttctttattttagtttaataacctacctctaacatgtaagatcatagtcaacacttggtgaatgctggcgtgataagtgaattaataaaatatcctccagtaccacagtagccactaccctcaaaaagaattcccttatgacacctatgagaagaatgatttcttaggaggaacatacagagccatctttaacaattgcaatagagaatcaaatcatacaatttatgcagaaatacttcatcgattataaggcccccaaatagatgatagtcaaataattgctacattgaaaatgaatattaataactatgttgaatagaattaatgttaatatcaatacaaatgttaataaccattttaatgcagtaataatatttgtactcataattttgcatactattggtaatatcttacatatcatattcgatgtctgaagcaaactaagatacccccgaaaaatataggaaagttacctttttaaaaaaactgattttagatgtgatcctaagtgcagagagaagaaaactctctgactttcctttttaaatatagttctataattctagcaatatctctttattgatctccgtggcaataaaagtttcctatccgtttcatagtgtcattgggttgtaaacttaggatatagtgacagaatttatcaaaccaagcaacaaaacgtgttaagttttttgaaaatgtatgtgcaaatgttattctgtttgaattgccagtgcttaaagtgtctacccagtgccactgccataattcatgtcaaaatatccagcaaaaaaaaagttacctctttcagtcaggtttttaaagatcttgttttccaggcaattataagaaaaaaatgaaagtgtttatgtcacgcctcttaataggtggatgaatttagagaattgtctttcctagctcacaggaaattaaatagcattttcaaaggatcacatctgtcacaacagaataaccaaaaatgtgtctataaactgtcagtaaagagcatcacgaggtcatttatatcaattctgttttcataaacatagtaaatcatccacctaagaaatcacaaccattacagacttatttaaattataattcatggaatttttgaacagtcattaaattaccaaaataaaaaattgtataatgtctggtatggaactaggatgtttattaaagaaaatctctatgtctctgtgcaccaatatgcaagcaggcctagtaacttgacctctatttcctaaattccattataagaatactaacagttgccaaagctatcaatgtttccctatcctccatttatttaaaaccctcatgagaaatagaataaatgtgcttacctttagaaagattctgtggcaaaagttttattcatctaatttagtgatattgtgttttcgagagtttttttaaagttatttcttaagatgttataaaaatattttaattgatttacctcattttagaaatgaaaaaaaaaggctttgctcataaaatagaagctacaataaaatattattaccaacttgcacgatttttaaaaatgtcagacatttagattaaatttaaacattaatgacaatgctaataataattgataagatttattgagtgattattatgttctagacactcaggtgaatgttttgcatttaccttcatttgaacttcaaaaaatcctacaaattaggcattatttacatttctaaacatttgaacattaggaaactgtgcctgaaggaggtaaccaacttgctcaaagtagcatagttaaatggagatgaaacaaacatttatctttctttacctgactctgtgtctagatctcttaagaaactaaaagataaaatctcctaatgtttgtagatgttatgcatgtgattgatctctaaatcatctgaaccatcctgagattatgcttagtattctcacaatctctaattttgagatcagactattgaactgaaaaggatcatatatcctctttatggtcacacggctcagattactgaacttaacgtatgtaatatatctgatgtacatatgcacatttaggccatccttttttattttcaattgattatttttattttctcccaactcttattttagattcagtggtttatgtgcaggtttgttacctgggtacattgcatgatgctgaggtttgggttacgggtggtcccatcacccagttacttagcatggaacccagtagttagtttctcagccttccccccaaccccacttaatagtttctagtttctgtttttgccctctttgtatccacatgtacccattatttatctcgtacttacaggtgagaacgtgtggtatttgattttctgttcctgcattaatttgcttaggataatggcctccagctgcatccatgttgcttcaaagacatctttcattcttttttatagttatgtagtattccatagtatatgtgtaccatatttctttatccactccactgttgatgggcacctaggttgattccacgtctttgctattgtgaatagtgcttcagtgaacatgtgagtgcatgggtctttttggtagaactgtttgttttattttggttatatacccagtaatgagattgctgggtagaatggtaattctaagttctttgagaaatctctaaactactttcctcagtggctgaatggatttacattcccatcaacagtgtacaagttgttttcttttctcaaaagtctcgccaacatctgttgtttttgatattttagtaatagccattctgactggtgtgagatggtatttcattgtgattttgatttgcatttctctgatgattagtgatgtggagtacttcttccatatgtttattggctgcttgtttgtattcttttgagaaatgtctgttcatgtatttcactcatttttaatggggttatagattctgaatattaggcctttgtctgaggtgtagtatacagatattttctctgactctgtaggttttctactcttttgacagtttctttttttttgttgaggatttttagtttagttaggtgtaacttgtcaattttagcttatgttgcatttgcttttgaggacttaatcataaattctttcctgaggccagtgtccagaatggtgtttcataggttttcttttaggattcttatagctataggtcttacatttaagtctttaatctttcttgagttgttgtttgtatatggtgaaatgtagaggtccaatttcattcttctgcctatagctagacagttatcccagcatcatttattggttagtaaatcctttcctcattgcttaattttgtcaactttgttgaagatctgatggctgtggatgtgcagctttatttctgtgttctctattctgttccattggtctgattttgtaccagtaccatgctgtttggttaccatagccttatagtgtagtttgaagtcaagtactgtgatacctccagctttgttatttttgctcaggattgcttcggctatttgaatgtttttcttgttgttgttacatatgaattttagaatttttttttagttatgtgaaaaatgataccaatagtttgataggaatagtgttgaatctgtagattactttgggcagtgtgggcattttaatgatattgattcttctattccattaacatggaatatgtcttcatttttttttttttttttttttttgagacggagtctcgctctgtcgcccaggctggagtgcagtggcgcaatctcatctcactgcaaactgcgcctcccaggttcacgccattctctggcctcagcctcctgagtaggtaggactacaggcgccaaccaccaagcctggctaattttttttgcatttttagtacagacagggttccactgtattagccaggatggtctcaatctcctgacctcgtgatccgccagcctcagcctcccaaagtgttgggattacaggcgtgagccaccacacctggcccttcatttgtttatgtcatctggagatttctatcagcagtgttgcatagttctccttggagagatctttcaccttcttggttagatgtattccgaagtattttttgtaggtcatgctttcttaaaatctattcaacagtgtattcacacaaggctggtggtaaacttaagcacactgattatgccgatacaatgatacaaagagaagatgcatgccaactttcatgcatgactttcatttgaatttttttttccaataattcaagcaatatgtagtttcatattatgttgaggacttcatattggttttattatgtgtaggtaaaactcaaaatagtcctaattacaggtgatataaaataaatagaattcatgtaatttgactataaatattatcaggtcatacatgattaaggggaacatcaagactgtggaagtctcagtaatgaagtcgcagtaatgtaatttaacttggttttagcttctaaaataagcacaatccagcctattgtgattgttgtactcaccttaaaagaaggcttacctttagaaattagggatattcaaatattctactttacttcaaactattttctagcatcaaaaatttatacctactgttgttgtgagcataaactaaaataaattgaatacctagtaataagtatttttctaatttcacagttaaagtttagaagccaagctttaactgtaattcaaactttattatctgagctttcaaaatttaggaatactagaaatataaaatttataatcttaatctaattacatacaatattttttccagcataacttgtatgctatagtaaatatggataagactaaatgaatatttaaatacaaaacatacaaattaactgtcaacctaaccatgtttacaaccctggcatctctgcatcatatttaatatgatacttcctttcatgttgctaaatacatttcagcatgacaactagctaagggcaaataaaatttaataatacattcacttttacatgatcttttgaacttgaaactttgtccttgcccagggtccattgaaactcttcggccacaaagcgatatccttcatcttcgcttataacagatgttttttttccctggattctgacatggagacaaattaccatcttcctatataactataaaacagaattgcttttctcattcatggattatgtggactttgtaggcctgtctcatttccaaaatgcacagtattgtacaaaggagtagaaaaaacaacaaaacagccatgtatgctgtactaactcctatactaaaatctgactttgttgtctatttcttataaaattcaattaaaatatattttttatttagtttataaagtaattactgattaattattaattatatctaatttttcaaatggtaaatcactggtaaacaatgacaggaaaaacacaaggccaaccagtgattcatcatttacatttgaaaggatcttagtaagagaaaagcagctcattggatatttaattcttgcataaatataatagctcattagagaaactttcacctactaaaacctcatttaataaatgagatgatttttctcaatggcttaataaaggcatgtaaccttcattaatttacattaatgatgataaattgtgagaagtcgatctggggaagtgtatatatatgtgtgtgtttggttgagaggtggctttgattacactaaaaagtataaatagcaatctaggtcatcaacttgtattgctttattataaaatattaatcataataaactttagaaattaacattagctcaagcaaaaactgaggattagtttgctgttggccttctgttgtgttagagaaaataatatctatcctatttatggcctctctcctagtgaagagtaaaatagaaaatacgtgagttgctctttcttccgtcaaactggagcccaatataatgaaagagatggaaaaaagcagatgcttttctctccatagaaggacaaagtcaatgagagataatatagaatgggaagtagacaaactggttagtatagtcgtaggacacaatggagtagagattttcaggtaggaggatttgccagtcacgtcaaattcagctaatttgcagggaaaagggataaaggagcaacatttgtcaattaatagagcacggttgtatataaaagtagcacttccattacaggaatgaggtagaagtatctaggatgtgaggaagtgaatatatagtaagaaaccgggaacatcaagactgtgaaagtctcagtaatgtcatttacctgggttttggcttccaaaataagaacaattcagcctattgtaattaattgttgtactcatcttaaaagaaggcctacctttagaaattagggatattcaaatattctactttagttcaaactattttctagcacctaaaatttatagctactattgctgttgttagcctaaactaaaataagttgaatacctagcaatattaagaagcgttttcctactttcacagttaatgtttagaaagcaagctttaattgcaattcaaattgtatgatctgagctttcaaaaatttgcttctttggaagttaggcaacagatggatagtggaatttacagtaataagtcaagggggtatgaaggtacacagagtgaatcttgggcaggttgttttcttatccgtaattgaggaatgaaagtaatatttatgtcataagaaatatatggggaaagacatgtgagtctaatgcttgatccctgagtctgggatccggacttcgctcacggatgtatctcaagtgctttatatggtgtctggtgcatattgttaatgcatgatatataatagtatgaaaatgttaatattactgaagttaatgttattaatcttaagaatattatagtcacttatatacttgtttttttgtcttctactagtgaaagaaatccatttatccttctaccagatattaactgaacacttagaatgaaagagatactatcctgtagtaatactaacagtaatactaacagattactactccctttctgtgccttctcttcctgccactcactctctgctatcgtcctgccactcactctctgctatcgtcctgcaggtttttggcacgtaatattctaatcttaaccctctccatatcttatttgtgcaccctttttagatgatgtttttacccttggctgccaccttggacttgctatagcactgtagtcttccctcgattccacaaacccacttgcccattagggtcttgttttctcagctgcctggcatgctgattccttggatcttcctatgtttccctctttcaactcaggatctcggctctgataccattttcctcaaagagcccctccctgaactccctaagtaattcattttaaaaatcgacttcttttgataggtgtcatagtgaaattatttgcctcggagtttttggggatttgatattgcattaatgcattagcaaaccgatggaaaaagcaataaaatattttctgtgtttataatcactcacatataaatacatgaaagtgtacattcttctcttgaagcagttttcatataccacgattactgtttgtttccactaaaaggtataaaagcttcaaatactgagataatatttgtgaactgttaagaataaaaacaatcattggcatataataaaatgcattaaattaataagtggatatcagttacatgaagaggaatcagttgcctctgccttaatctatgtaacaaatattaacaaaacacctattttgtgacaggtactggagtaagcatcttccatctctttgtcttgagaccttgtattcattcaaggtttgcatcaaatgtcaacttttcttttgcatcctctctataacctccttccttctgtgcttcaatagcatcataccttgttatattgtagcaatttttatgcagaaaattttcatatgtcttcataagaatataaatgtctgaaagtttgggacgagatctttgaattctcaagaataaagaacagtcactgggacacaataaatgtatatcagattaacaaaaaaaatgccaggaatcagaagaggaattcaaatatatgtgtaatattatctatttttaaaatactatgaaaattataatactatagattttaatcaattttttttattttaccaggaaaaaatcatggcttataaaattattaacaaaatatatatattgaaatgaatatgttatgatataaaataactgccaaatgatatataaattaatgatataactacttgagaaatatattttaagtaatctaaacaattacttacaatgaagggaaaatatcagaatttttagataaaagtggctgagataaattatatttatctcatacttactgaaaatgtttcttctaaagtataaactaaaaagtgttattgcctaagccacatgcaactcttttacaggccattaattaatagtaatgtgtgatttgttaagtttattgcattttccacaactcattaaatttaggcttataagtagctgtaacctggtttggtttcacttgttttaattattttttgatgatttaagacactagccatatggattcaagttttttagtttttattttcctacaccataccatagtagaactattactgttgttatttatattttttaaaaaattcacttgtttttctcgagaatttgtgactgatttttatgttatactgcataattcagtaatttcacacattaacaacatccagggtcatgtgaggatgagttttctagcttctgaaatgttctgaggatgtaattttttaataagaggaaatgtgatctcacagactatttgggtgttttccaagtgacttgtcacgaatggttttgctctctagtgcacttctgagtacagaaaaccaataacccaaacttttttcccccagcactcagagaatttggggaatgacacaactcagtagttattttgaacattttctaaggtacagaatagtggtaacttctcctgggtatttagtattttttttccatttaaaataaaagcttttcttttattaattacttaccttgtgcttggaacattattagatacttatatattttaatttgcaatacaatctgcaagaaagccatttttattgtaatttgctgctgagaaaactgaggctgaaagaagtccaggttctttttcatggtgtggctaaagtcttctcaaaactcagggtatctgctatgcatggtagatttaagtttttgggacacttggtactaaaatatgcatcttgtgactccaagccacttaataacatctttagagctgaagtttaggaactagtgctaaaatgagtcaagtaaaattctactgttgtatgaatctgactcaggattacttatttgctattgtgaccattgtgaggaagtgttgcagggtgctggcacctgctggcttagcccatgggcgctaaggtcagactacatttcagcaccttgggcactcctcccttgtggtcatttctcttcactgagaggcacattatagtcagtacttaccaatccctcttcacccttcccacaacatctttgtatagataggtggtcacctgagagacagacatgcttgggttatttggaattgtatagatagttggaggtttttacaattttaggtgtgtggaaactatataagttaatgcagctgttcacatagactatattgaagaagtcttcaatcccaaagcattgtccagttatttagaagtaaacctggaattccagtcttgatctgagtgacttcaaagcttgtgtcctttcaactaatgctcttgtaaagaaagagcaataaacatgttgcatcttgcagtcaagatcactgttgtccagatttaagacctatctttcccacccttcatattgttttcttcttttcacataggaaagaagcagcataaggatttgttcttaagtaaacatgtatttattgagtacctactatgcgccagtaccatgctggattctatcataagaaccagagtgcatgaggtttctttggctgttgtgacagattatcacaaacgtagaggcttaaacaagagcaaatgtattatcttaaaattttgtttgtcattccaatacgggtcttgcagagcaaaagcaaggtgttggtgggactgcattccattatggaggctccaggagaaaatcaatgttcttagattttccagtttctggctgctgcccacatttcttagcttctgatctttttcttccatcttaaaagctagaaccatagcatctctctgactttgctcccatcatcacatctgtcctgactcttctgcctcccccttctacttttgagggcccttataattacattggcttcacttgtataatccagtagaatctctctattataaggtcaggtgattaacagacttagttacatattcaatgttaattcctttttccatgtagcctaacatagtcaaagatttgaggattcagatgtggacaacgttgaattgttttgcctactacctggaaaaacaggaaattgcccaggttgtgccagatatggtatacaagagacaaaaggcaagaagtgttctacataaaactggccaagcgcggtggctcacacctgtaatcccagctgtttgggaggctgagtcaggcggattacctgaggtcaggagttcgagaccagcctgaccaacatggagaaaccctgtgtctactaaaaatacaaaaaattagctgggcgtggtggcatatgcctataatcccagctactcgggaagatgaggcaggagaatcacttgaacccaggaggcggaggttgtgatgagctgagaacgtgccgctgcactccagcctgggcaacaagaacaaaactccatctcataaaaaaaaaaaaacaaaaaattgtattctacataaaacaatcagagaacaaagcattgtataagaaaatatgcaacaacaataacaataattgtaaacagagcttaagccaacatttgttgaaaatttgttgtatgccagttactgtgcttattgctttgtatacaatagttgttttaattttcaaaacaacttgtaaagataagccatcctcattttgtgttgataaagataaataggctaaggcttggccaaggtttcctgggtaacaagtaggaaaatgagatttaaacttaggtttctgatttcaaagactgtgctccatttcgcaaactattcatatagtaaaacagggtttagaacaaaatgatttcaagttggttcccaactttgaagagtgcatccagcatgttgtcaacaggaatatgctgaaagaggcgaaaagggagtgaatggaagtaggaagtggtaaacagcatggtgtgtagtaaggaagattgactgttggagagtgttggagtttgtgctgggaagtcagggagataaatactattaggaaaaatgagggcgttttagctggtctttaatctcttgagtctgcacattcatcagcaaataagaggggacacgtataggtttttaaatgatgaaaccatgttttaggtacattagtctgacagcagtgggaagaatgggaaagaaaagaagtagaacaagttttaaaatgctgacaggcaatagcagtgatttcaaacaccaattaagttggaacgttcagacccaagctcctgtgactggtaatcacccctacagtgtcttctgattcagccccacttattatatttatcaacgtctcaaaacttaatctttttaaaaaataaaactcgttttacctaataaaacattatgtttcagataactttaaaaggatcatttcctccgtagatttttgttaggtttaggtctttgaatgtttataaagtgttctcacatacattttcatacctgggcctgtgaatttggtgaagcacatagactcacatgggatacacagaggaaattaaaactccaagaaattgtgaattgtcaaaatcaagagtaacaatttcaatccagaactcatctcaaagatatggccctttgtgttatagattgttgggtagtagataaatatatataaaatttaacattttgaatatatcttacattaaagagaccctaacttttgtttatttttatgaaactggtataattttaaactgagattacttaagaattttagcaaacatgcaaatgacctcttcaactatccactgcctaaatgtcctttccatcacccaaacggcaatcatagtcacttctacttccgctgtatattgtaaatatatagcagaaacatactcatttcttcagattacacaccaaaaaacacagtcaccagctgcaactttctgacaggccaaaatatgaagaattgttaatatatgatcaattgatctggatcgagcagagtgcagcttactgtatgacatgttgcttttcatagacgttatctctgttcaatttgcttctgcatttaagatattaaattcagatctatgtggcaaagatgattagaaaaaggtaactcctcccttagggatctattttaaaatgtcaaaattaaaattttccagaaagttttgagcagttttagcctcctggctgatgcaatatattgagtagcactgttagcttaaggatgctgtctggaaatggaaatgctgatttacccttcccccctgccatgccacctaattaaaaggcaccactctcagtggtaggcacactaatacatgattttgctagtggaactgggaatagcataataaatgtgttgtgattgaggatatatgctgtgcctatatttggaaagaggaaaatgtttaattgctctttaaacaaatttgattgcacaaatgtagcatgaagaagaagaaagacgtgatttttttttaactgaaggcaaaaggtatactcattttacctccaggttgataattctcctgtgacagtgtgaaagtaattttgtccaaggaaaaaacaatggtttccaaacagccactgtcacttcactcttccactccttacacgttccaaccccactttaccatcaatatatttgacaataatataatataaataatagcaaggaagcttttctgttagagtaggccatgtatggatataaatgtcatttttatgtcataactagacatgataaaatataaataaactgatatagtatttaaacataatgacaaggtcacaaatacatctttttttactgtgtaagccaaccaaactaacaatttcaattataagtttagtcagaagtaaacattctaccatcaatggtagacatagacctctgggtcagaaaattaaatttacatttaaaatagcaatgttttccctagcttttctttgtaattacggacaatttgaaagctgccttaggaattaaaaaggcagtgatctcaccaaaaccttcatcatatttcccctctccttaaaggatgaaaacagaagtgagttatatgttaatctcatatactttggaagaggttcaatgattttgttacatttgagaggttttgtctgatttctcagacttttgagtttcatagcaataacatacattgaaagcgaatatatttatagccattatttaggttccatatggccgattgtatttcttgggaggcgtgacctaactatagttagagctagcatatattgccttaaaaacatgggaacactgggtaaaatgcctaatttatttgtaagtagcaatttactaataatagaatcaaaccaatcttagttattgaatttaagaaactacaaaatttcacagttacatgttattactattgttgatcccctgagagtagaactaagggaaatataatcactaagccctaggtaataaaatcagttcttgtagaaaatatgaccacaaaagagaattttcagtgtatagaaaaatattaagcgaaaattataaactagtagacatttaaataatcagagctctacaattttttaatgagcaatgaagattgattaaaatacagaccctggttaatataatcattattcagatgatcttaacattagtgagcctaatctggattgtttaaattgcaaataattgctgccttaattgctattaacttggaaaaaatgattttcttctttcaagattaatcatcaggctggtgttaacagctgtaatttggatcatgatgataacaaacacaaaggcagttctcttgaaactccaactatccagcatgtgtttaatgtcaggtactgggaaaacgtgatttatatacatttatggcttagaaaacaacaaaaggacataaagttgaagggaggaaaaatatgatgaatatttttgtggatccattgtcttttttctagcacagcttttgatttgtccacaaattttaaaaaagctggaaaaaatcctgctgaaatgtaaagttgattttgtcaccaagaagtctatgtttaaatgcctgatggtacaatgtttacttctgattaaatctagtgattgaaattattagtttggttggtttacacagtaacataatagatatagttctgatctagccatgatgcatattggctatatgcattctttatatatttatatataaatataatattgtaacaaatgccacattaatattgttaaatttattaaagaaaaacatagcccttagagaaaaataaatggaaacaatggttatgcacagtaaaacaaaacaacttttttaaaggacatatttatgaacactgtattctttattgaccattgcctgtcatctgcgggtcacaatagtagcaatacttttgaaatatatcaaacaaaacattttgttgtatccaaagtgtccacctgtttttataacaagtgattctaggattcatcacaaaattaacacattaatacactatgaaatgaaaaaaaatttgaaattggcttttgtttctttgctttactggaaatatattttgtggtgaattcatctgagttattttttacttccagaaagatgattaccatatgtattttatttataaatttcggttctgattccaaaaacacaatatttaatgaaaatgcatagaacaaagccttgagatgaaaagtctttaatattaaaatattaaacacctatgtggaaggaagtttcttgcctcattccctaaggacagcagttggctaaacaagtataagtgaaagaattacaattgaagataccctgcagaagagaaaagaaaagtcctgccacccggtactctgaagacaaaaatctgtatctgctagcaggagactttgtttgcaagacagcagaggtgattcctagaagccggactttctggtggaaatcatgatttttggtttcatctagtcttccaataacaagcaggttgagtcctgaaaaagcataagcacaagatggcattatatgagtaacatgtaccagtttctcaaaacatttcatttaaagatatctttacttttatgtctgacatactgtccttaatagcaatcttaacacttctgaattttaaattgttacatatttgagattatattttcataaatcatctaaaaaataagaataactctatatagctaaccaaccgtatactaatgaacaatgtggctgagactaataacatattttggtaacaggctgtgtccacttgatgtttatttcatttttacccttataaatgtaatacaagcaaaacagaccacaacaatttttattttttaatgaatcactattacaaacacttttgtaactgccacccaggcaggagctagaatttcggcgatagtttcagtagctgtgccacatcccaatctcagacctctctcactaaccatacataaccatgttcctgaatttaaattgttacttccttgagttaacttagtttgtattacccatgagttcattcctaaagtttgattttgcacattaaaaaaaaaatacgcctttttaaatggcagaaaatatttgaaaatgatgcctcaggataaataattagtattcagaatctataagaactcaacaagaaaaaaactaacaaccccattagaaacgggtcaaaagacatgactacacatttcacacacaaaaaaaggaataaagcagccaaccgataataaaattctcaatatcactaagcatcaaagaaatgcaaattaaaaccacactgtgatatcatcttaacaccagtcagaatggcttttattaagaggtcaacaaacaacagatattggcatggatgcagaaaaaacggaacactcatacactgttggtaggaatgtaaattcaatctttatggaaaacagtatggagatacctcaaagaactaaaaatagaactaccattcaatctagcagtcccactactggctatctacttaaaagaaacgaaattattatattaaaaatatatctgcactcatgtttatcatagcactgtttacaatagcaaaatcttgtagctaacctatatgtctatcaaaggttgaatggacaaagcaaaggtgatacatacatatcagcatggaacacaatgcagccataaaaaaagaatgatatcatatcctttgcagcaacatgaatggagttggaggccattatcctaagtgaactaactctgaagtagcaaatcaaatattgcacattctcacttataagtgggagctaaacaatgggtaaacatggacgtgaagatagaaagaataggctctgggaactctgaaagagggaggaaggaatggggatttgaaaaattacctaccaggtataatgttcactgggtaatggatacactagaagcccaatacctaccatttcacaatacatccatgtgacaaacaagcacatgtagctcccgaagctaaaattaaaataaaaaagatatgtctgtttaattcctattaatctgcagggtcttcctccgttcctttccttttcttaaactcatctgttgaaaacttaagttatttgactgaagaaatccccacagtctggattaggatttttctgattagacacacatggtttagagctcaacatgttgccagaattggtgtatttcccacacattggcagctggatccagaggcttgagcagactcaggttggagccctttgatgatggtgatgaattctttcctcaggagggaatatctagttgtgtttctttttgtgttgttagtagctattgacggataatacctacatccattaacacattaggtttgcaagttggtgatattctaatctatcatttatctttttatttgttagttggaatacttttaaaaggaaatacatcttcgtaatctgctattaaactacctaatggtagatgccataaagaaaagatatatgcttgattcatcccctttgtcagttccaagtcaacaaattgaattatttgaagatgaacaatttacttgataaaaaagtaatttatggatttaaatacattgatagatttgcagttcaataacttgcaatcattattcttttggaagctcaatttttttccttttggccatgggagtcccttcaagtaggctcctggagccgttcacaatgaccctaatagtctgtgccagcttcctctcagtgtgctgtgacaagccacaaagttaaaattcatcatttcttctagaaggtctagtttctttggttgggaaatggtgtttgaagaacacagattactggaggtgctcattgctgtagcgttagtaagaatcaaatatatcaaattatactgatacatataacccaaattgaggattatagttttcttaatcttttctgaacatctgtatccctttacctccacactgaaaatctttgttctaacagttaccaggaatgacagaatagatctctcctaattattctttaacttcatctcacatacacacgtgaatctcagaaaaataatacttcgatcagtgaaaagtaattactgagaatttttcttttcatacgttggtatgatttttatttagttcatagatttgtttgaatctgtttatcataactgggaagttgattattaaaacactcttcatacttaaagtggagcaaaataacaagttatcaattttctttcatttgctttttttctatatgctcctgttattaccactgaataatataggaagctcataaattttcccatagcactaaggtattaaaaattataaaatgtggatgatatgtgtacattcgtagttctgtgtgcactgtattcttttatatagctcctggaaaacttcagcttcctcagatatacctccctaatctctcatattattttgtacagtcctaaagcattccatacccaaacactcgacacatttgtggtaactctttccaaattgtcttgctaaaagtctgtacactctggtgtaccttttttaaaggatatatatatatgaaatacataatagacaatacacatttgcaaaataaatgactcaatgaataaatcagccttcccatattttacataagtgttaaaaatattgacttaattgtataagcactgttatataaggtcatttttgtagtgatttttcacaccataaaaggaaatcacaaaagttcaacagatttttatatgctttaattaacactctaaccctggagagttagaagaactctccaggctggacattgataatttaatactagcacaaaattaggaataatgagtgaaatactacatatcatctcctgctgaaaggcatcaaataagctttctcatttttttccagttttgtgatgcatagttgctactgtctagaatactctgtaactttcactgagctgagctatccctatgccatgcgaccaacatccgtaaggaaactcctcacatttccttatggatggttgttcaggacctgcatctggaaccccatggcttcaaatgttaggccctttttcctaatctgttactgctaacctctgtttctggctttttgcactgtccgctaactatacctttgtactgatatatgcccctgatatctggaaattgatgttctagtcttgatcccaggctcccctcattggttaactgtgttcccttcctacactgcattctccctttgttccaggcaatgcatgagccctatttagcttctttctcatgatccagccgcactatatgtacctggagttgatgttgcattaaggagtacagtggggggtatggtctgaatacatgtacatttattgtactataacacatgaggcattcaagtttcttggtcgagttatcaaatgaataaatgatctttcagagactgccacagaagcatgaataacatagtataaaaattagcatcattttagaacttagcaaactttcttacatgtattatgtcaatgcccctaaaccttgtagcaatcctgaacaaggcagattattcagttttacacttaatgaggctcagatatattaagtgattttctaagttcacactgaatttaggtgagagaatatgattgaactccatcaccttattgctatactaaatgataaatttcattcttgcatcaccaattgtgtaatagtgaccaaacttcttaacttttgtgtgcctcagtttcttttattcttttattcttttaaatgattttctctgtagaagtgagttatctatgtaaattgcttttaaattctagggagaaaaaaagagctgtaggagtgataattagatgccatgatatagatggttttaaatggagttgaaaggttcatggaataaaattctttccatattttcattaatatggatttttaataccctttggaaattaactttaaaagtgttttccatctttgtgaaaaagaaactttatttccattgactataaaattctttataatagaacatgctccagttttatgaaaccccgtaggataaatagtggcttaaatacaccggcagacagatctatctttaattgaactactcagccagatcccattgggagtaaaaatctagtctttcaaagacattggaaattttgtttctgaattcaggtccagtatatcaacagtgacatatgcaagtaggaactggttctgctcatttactctgcctttgaaatttaccaaaaccacattcttggctcctaagtgacagagataagtctctttctatggatcccacagcattaaaaaatctaaacacaaggtaaatttatatctgcatttccaatcaaccattcagatttagtggatttttaagtttatttcttcataatctttagtttaaaaaaaaaataaggaaagtgctgttttaacatgtagaaagggtaattttaacataacagtcttaattgcttaaaattacatgctgtagtaatatacaatactgtgcagctttatacagtactatatctgcatttgcattataggttttcaatcatatgttaagctttcctcataactattaaatctgttcatattgcctattgactttgtaaataatgcataagttttccatgtcagtataataccaatttatttcaccattcactatcaaaagtttttaaaatattcaccacattctcatcttccagtttattgctttgaagggtaggattctgtgagagtgcatggtaatgaacttcatattaagcagtctacttcaatacagtctgccttaattattacttattaagacaccccacaagtttcacaccagctattttctgttaaatatgtagcatacattataactgtaccaaaaaatgatggcatctggaattgtagagcagaaagaaagtttgagattatttcttttaaccttcttattttagaggcaaatgaagttagatctaggaaattaagtcttttctaacatgacagaattgactgttgagagccctggaatcagagtcaaatgtcttggctcccattcttaccttctttttgctttttcttttacactacttcttctgtgtgttttgtcataaaagatatataagttgactttactttgatgaagggaaagctactaatggcatgtgagagaaggactgaagtggggataaatagttattgtacaacttacaattttttcaaattctgaacaacagtgcaaggtagtgatggcatgtgcaataggtgtcatgcacattgtaaaaaaaactacaggtaaaataccattaaaaaacacactctaagaagcaaagcctttctgtcattaatcagtactttggttttgattatttaagatgatacctctggctcacgcctgtaattccagcactttcagaggcccaggcaggcggatcacgaggtcaagagattgagaccaccctggccaacatggtgaaaccccgtctctactagaaatccaaaaattagccgggcgtggtggcgcgtgcctgtagtcccgctactagggaggctgaggcaggggaatcacttgaaccccggaggcagaggttgcagtgagccgagattgggccaatgcactccagcctggcgacagagcgagactccgtctcaaaaaaaataattaataattttttttaaaaaaagatgatactcccaaaaggttctggtgaagatacatgttttgttttttgtttttgtttttctcttgagacggagtctggctctgtcgctcgcgctggagtacagtggtacgatctgatctctgctcactgccacctctgcctcccgggtccaggcgattctcctgcctcagcctcccgattagctgggattacaagcgcgtaccactacgcccagttaatttttgtatttctagtagagatggggtttcaccatgttggccgggctggtctcgaactcttgacatcaggtgatccacccacctcggcctcccaaagtgctgggattacaggcgtgatccaccgtgcctggccagtgaagataatttctggtaagttagtgggaaaaggaaagacctcacaaaatcaaagagtaagggaagccttaaaaagtagaaagggaaaaataaataaacaaaactgcatgaaagcttctcttccctgtcattataaaattaattttttcttagttactgatgatatatatcaccggaccagatagtacacattggtagcttttggaaaaacttggcattttgaaattggacagaacaggtaaacatagaagctcccaaaactatgcagagaatgaaatgctacaggtttaagaaacttctatcgatgttacttctgtctacatcatacctagtgcgaactgtgtttgagtttgggttttttttctgatttgtttcattttgtttttaactgtggctcctaaattttaaaacactgctagctaccgtttattgagttcgtttatgggcagtcctatgtcaaatagtattaacactttattccatgcaatgcttacgacaacttttacacaagctgcttgaaattatataggtttgcaaattatataaaagaaagagattaagaaactggcctaagatcgagagtgtgtggaaactgggatttgactttagtaggtctagcaagaagtctatgtccttaacaactccatagtcctcctgcacactcattttcaggagaagcagtatttatttattaaaatacttttcctccttaaggacaaaaatgtcaacaaaaacaaaattcattgcagtctgtgagaatatctttcaaagtgaggtgggtttccctactagccaaccaggtttttctccccgttcactattcttgaactaatgccagattgaagaagtaaactgtatatagttacatattacattttccctcacatgcatagcgtgtgttcattaatattttgcatatgatcaatgaggcaattgaaaacattttatatcatggaaaatcatgaaaatataaatggacaataaatagcattcatgttgccattgctctgtgtccctcttttcctctcacaataaatgttttgtaattcacagagtggtacatggctaacagttgcttatgcaataatactcatagaataagaaatagtactcatagaataagaaaatagtactcatagaatcagaaaagtaaatacaaatatgaaagagaataactgtttctactccattcattttttttcactcgtggttaatgaaatagaacaaaacaggactggcactgtaaatgaccaactggcgattaaaataagcttcaaaagtttttcggagttgatgaaatccttatttcatgccacaagcagctcccaagagactaatgtttgatgtgcttgctcaattttacaaatacaattgaaattgaaggtgtataaaaaatctgtagacaccaacattttctgtaatactatgaattgcttttgtcctttgcaaaatgttattctctggccttgacaaaaaataatttgtttaaatcaccttctcagtggagaatttcaaggatattattatacaacagtagggtaatagaattgtcatctctatttaggtgtaggaaatattattttggagatagtaaaaactcacctctaccacttcaaccatctatttgtgaggaagcacagggaaatgttatgacttttttaatatttaaaaaaattgtctctctttgaaataaaacttataaagtgtacctaaaaattgtcatggttcattagaagctatccactgagaaaattaaggctaactatggagatagtaattgactttaagagttgcaaactagtttcaattaaaactggcagcaattatttagcacacatctatgatttattggaaattcagacagattgtgcagtagcattaatagaggtatgtttctggattggtacaggtatgatgagtgagatttttttctgtgctgcaggcagtctaggaacaagagctgctggaggacacatttgatctacatactacacactcttgtgaaatacaaaccacagtacatggtttcacaggataggaaacagtttttaagttttgacagttgaattataatgattatacaaaataaaatgcctactcccaacttttgtaaattatagccagaacggagaatgtttttagttccttatgaaatgatttatgtaagtgatatttatgattttacatggggaatgtatggtacatttcctgagaaaagtcactttgattctacattagttatgctttttaaaaattcattgaagtccactattatgaattacagcatcattgttctcatatcagtagcatacaatatgtcaaaagggatttaagggctatttaaacattttaaaaacttgagtcctcaggtagtatatagtgataacaatgttgttatttttaaaataaaataaagggggggagctggcttagtaagtgctgcgtataaactaaatctgccctgaggcaatgattttttactggtacagaagctgctagtgctgggttttcggtcattactatgatttgtagcaaagctagctctccctccagccgtgtatcgcagagcttgcagtttattcagccgactactatctgagagttgcacagtattgtctgataacattctatagcttccaagtaagttactcctatctcatcttgttcatcacagtagatcacagtcttagctattactgttgatcaaatatagcactgaatttaccactactctgctgagcctgaatggggacaacagaagcctgacagataagctcagatagtgtagtttagcactgaaattgtggagaggcatataacctgacacaaagccatctcagcctattttagcaaagatgactgagggactgtgaagctaaaaggcaaaatgctaataaagtcttctgctgaaaataagtttaattgtaaaataatacatagataacacccttaatggtcatggtttatattttatatatgagttttcatcagtaagtgatctagatactcttgtgaagctctcctgttaaaagacttatggttttcataaaagataactattgctggacttgcatgaagtgggatgaatttataagagcacactcactgccagcctatgcacccacccctccaaagaaaaatttttgctaaaaatgaactttgagcagtaaacacccaataaaagagatttggtttaaaagtagacgctgaagtcagttatacattcagtagcctcaagcaagaaccagcagtaaaacattctgagtaaatctgaacacaattttgagaacaagagatctctaaatcactcattttttatttttttaatttaatttttgtgggtacatagtaggtgtatgtgtttatggggtacatgagatatactgatacagacataaaatgcctaataatcatatcatataaaatgaggttatccatcccctttagcatttatcttttgtgttaaaaacaatccaattatatatttttagttatttttaaaatgtgcaattcaattattattcgctatagttagcctgtcgtgctatcaaatagtaagtcttattcattctttctgactactttttttgtgcccattaaccattcccatgtcctctttattccccccacctccattcccagcatctggtaaccatctttgtactctctatcttcatgatttcaattgttttgagttttagatcctacaaataagtgagagcacatgatgtttgtctttctgtgcctggcttatttcacttaacataacaacctctagttccatccatgttgttgcaaatgaaataatctcattcttttttcttttgtggctgaatagtaccccgttgtgtataagtaccacattttcttcattcatctattgatggacacttaggttgctttcaaatcttggctattccaaacagtgctgcaacaaacatcggagtgcagatgtcactttgacatactgatttcttttgggtgtataccaagcagtgggattgttggatcatatggtagctcagtttttagtttttttgaggaacctccaaactgttctccgtagtggctgtactaatttacatttccaccaacagtgtatgagggtccccttttctccctatccttgccggcattcgttatctcctgtcttttggatataagccgttttaacaggggtgagatgatatctcattgtagttttgacttggatttctctgatgagcaatgatgttgagcacctattcatacgcctgttagaaagtcaatttctaaatggaatgattggcatgggcctggcttccttgttaacatgctcatggtgtttactggcagaaagattatgaagagtccctattaaacaaaacaaaacaaaacagtgaaaacaaaaatcccctaatcactcaggatactcctggcctgtcttgataacctattatgtatgaacctggagtttatgtatttataaagtatggctgtctggagagtgagaaaagtcactatcttctatctgttgaattaaatagaaaccaggagagccccaaaactaaatcagctttctttaagaacagcatgtccacacccttttcagactcactatatgttaatcaaaaacaaagcaagtcctgttacagaagataagatattagaagccacgtcttctgcaactcatacttttccagaaaggaatgttaattttctgcatgatattgcttctaccttttaaatcactggtaaaaattcatattggggaatatgtacaattaaagtgattctgttttcacctttagtgttcaaacaagttggaaggtagctgtaacggcccccaaacagaagcacccctgaatcctgagaagcaaatggaagtgctccctggaggaaagatcctgaatctatattcagaaattctatatagacctcagaaattctaaaagttaacatgaactatatatgaaataacaatcaaacatcatcattcataaaggaaaatgttacaacaaatagtaaaagatcaaagagaaaaaatattagatttgtaccctgaaaactaaaataatataatttgtagatacggaatataacataactatgtatgaaatgtttgaagaaaatagtaatttaataaaaataaacaagaactaagacattatccaaattgaccaaagagatttgaaaaataatcaaatataacttttaaaatgaaatatgtttactgaaatatttaaagagtagaatagacattgttgaagcagaagagaacggaaataatagtgaaagaacaaatatttaaagatgcagtggctgagaattctccaaaactcataagaattatgattccacagatattgtaggtacgtatatactgagcaacatgaataataatgaaatccacagttagacacattatagtgaaactgtagaacatatattacagagatgttaaaaacagtaagaaggctgggcacggtggctcacgcctgtaatcccagcactttgggaggttgaggcaggtggatcgcctgaagtcaggaattcaagaacagcctgaccaaaatggtgaaaccccatctctactaaaactacagaaattagctgggtgtgatggcatgtgcttgtagtcccagctactcggttggctgaggcagaagaattgcttgaaccagggaggcagaggttgcagtcagccgatgtagtaccactgcactccaccctcagcgacagagcgacaccccatctcaaaacaaacaaaacagggagaaaaatccaggcgtggtggctcacacctgtaatgacagcactctgggggggtgaggagagtgtatcaccttagcccaggagtttgagaccagcctgtgcaacatggcacaatcctgtctctacaaaaaatacaaagatagcagggcatggtggcatgtgcctatagtcctagctactgggggcgctcaggtgggagagccgtttgagccagggaggtcgagtttccagcaagctgtgatcatgctgctgcactccagcctgggcaagagggcaagatcctgtctcaaaataaaaaaaagaaaaagaaagaaagaaaagagagaaaacaaaagcagtgagaaaagacaaagctgcctacacaataatgacaagtaaactattcagcagcaaccaaagaaaccacacaacttggtgataaagtcctcaaagtgatgaacaaaaaaatagctgtcaacttagaattgtgtcttcagaaaaataatctgtcaaaaatgttatttacaaaattgtaaataagcaaaactgagagtttacaaccaataattataccctcaaggaaggattaaaatttttatctcaggcaaaaataatcctaacaggaacgttttaagatgcagtaagaaatgcttagcaagatattggtgaattgactatccagccaaatacgcatcactgcacataataataacatttttgtagttaataacgtagatatctctagaaagtttggtgagtaataaagagataagacaaaaaatatattaagaatgagaaaaacggcacaactccaagtgtaatagagaattgaaagaagataccatgaatacatttggcaatgaaattgaaaatgttgcaaaaagtcctccaaaagtaaaattttccaaaactgattcaagaggaaattaaagcttaactagaactttgaacattaaaaaattaatcattaacttaaaacatttctacagagaaaatactaatccatttttattgtaaatcaattccatcaaacttgcaaggaaaagatcactaggaaaatgtgtatctacattaaaaaattaagtttatattcaaatataatctctgataactttgagaattaaatgtaaaagtcaaaactataaaacatttagataaaacatatagaaatatctttatgatcttgaactagggaaaactaagatgtttcactgtaatatattcacatattcagttgcattcatattaataactcttatttaaaattcagcataaaaatgtacatactaaaatctgaggaaaaagatctggacatatataactgacaagtgattagtaatcaaaatatataaaggacttctacaaattaaaatatgtgtaagtatgtatatattttatgaaatagtcaatgcatattaataggtatttacctaagggaaaacccatggtaaaacataaatatgctcaaacctaataaatagaaagattcaaagtaagtccatattttataccatttgatgtctaataagtagtcaaaaatgttgaaatttcataatatcaagtattagagaggtgtgggttaagaattcataaacagttgcttgtaaaaacatttgggaaaaccatataccatgagacatataaaagactgttcttagcaggatcggttgtcttaacaaaaatactagtaatgacgctagtgggtatcaatagaaacatggattaaaaaaatacagtacattcagaaaatgaaatatgttaatatgttacagcagtgaaaactaatgaatccaaatgcacgcaatagcatgaagaacccttaaacatagcattgagtgcaagcaagttgcaacctacttcatttttctaaaattcaaatgtaaacaatatattttgtgataagcatatgtgaggaaacttcttttttttaaaaaaggatctataagcgcttatctcaaaatattaggagaggggcaggaggaatataaaagataggaagaaacgagaatacaaaagaccgattatactagtcaggttctgtttcttaaatactgtggctggttcattggtattcattaagttttccataactcaggattatgttacatacatgattttgatgataatattatataattattgtgtggttaaaacattaaatattttatttctttatgttcatgtgagttggacatgcatctgcactttctctcatcctgctttccctaaggcagtcaataacataactgccaagatttccaccgtggttttgaccaatgatgtggtctctgctaatgagacctgagggagaataattcataaagattggcagagatggtaattttttgtaaatgtgaactgagatttataagtcctttaaaactattatttcagcagtaaggaagtgttacataatcattaagaacatggtcaaataaattttatgggatttctagctctgtaatttactagctgaatgtcctagtgtattagtcagggttctctagagggacagaacttataggatagatgtatatatgaaggggagtttattaaggagtattgactcacacaatcacaaggtgaagtcccacaataggccatctgcaaactgagcaaggaagccagtccaagtctcaaaacctcaaaagtaggaaagctgacagtgcagcctttagtctggtctgtggccgaaggcctgaaagcccctggcaaatcactggtgtaagtacacgagtcgaaaagctgaagaacttggagtctgatgtttgagatcaggaagcgtccagcacaggagaaagatgaaactgaaagactaagcaagtgtagttcttccagcttcttccgcctacttcactctagcctagccatgctggtagctcattagttgatgtccacctagattgagggtgggtctgcctctcccagtccactcactcaaatgttaatctcctttggcaacaccctcacagacacacccaggaacaatactttgcatccttcaatccagtcaagttgacactcagtattaaccatcacacctagggagtgttatttatttcctaattctcggttatctcctgttcacaatagcttctacatcataaggctacttttagaactaaaagaggtaatacgtatatagcactgaacacagtccctggcacatatttatgctcattatatgttacgaatcattatcatcgttccatgcacttatctgtcatataagaggtagatgcttactcttctattttcctgaattgctaaggagaagggatgtacagccacagtgcaagcaagttgcaacccacctcacttttacaaaattcaaatgtaaagaatatatattttatgataagcatatgtgacctgaaatgttttcatttttctttgcaattaatactacttgacaaagttgaaatgttgatactactctaacaatatgttaacttagatgactgaaaagagcacagagactcagatgttaaactgtgattgacagtcaactgacaacaggaagtgcctaataagcctatggtactagtgacaacatggcagggtaccatcggggaaacatctggggcatcaagaaagagagctgaaacaggcttatttttatttctaagatcagaaagcctgaagctgaatcacatttgttaggcattgattcattcttggtagtgagctgtcagcaatgggcaacatcccaggaaagaaaacctctgtggcaataacagagagataaagaaaggaaatattaacaggacattatcctcagtgctctcaaaaaatcaaaatcctgagaggtgaggaattacggaacagttgagcttacatactctagtgtaagctggacctgagtttgacacattactgcgtgacgcagggcaaatttaatttctctaagtttacattatgtcatttactaaatgaggaaaatgctcacagttttgagttgtcaagaggaagaattcgtataaaatgcttaacattgtcattagcaaaagggagggttcagttatttaattttcattattgccatcacttaccatcatcatcatcatcataatcatgattaactgacatccgtagaattttacaagtatagagagcaggcaaaatgaaatttgttatccagcaacgatccttattatttaacaaattgagagaataaatagatattgtctaaaatgtcatacaaacatacatatatgggcattgtcataacctgcatatattacatttcctaaaataagaaagactggatgttgtcagcatgggcttatgtcacattctggttcctttctccagagcaggtgtgtgtgtgtgtgtgtgtgtgtgtgtgtgtgtgtgtgtgtgtgtgtgtgtgtgtgtgtgtgtgtatatatatctctccatcatatatatgaaatgtgataattatgagaaagtaaaatacagtattctataaatagtgacacataaaatagattatatagtcctctgtaccattaaaaaaaagtccaacaagctcaaaacattatgtgttatgttgaaaaattccactagacattcttttttttttttttttttcttttgagattgagtttcactcttgttgcccaggctggagtgcagtggtgcaatcttggcttactacatcctctgcctcctgggttcgagcgattctcctgcctcagcctcccgagtagctgggattacaggtgcccactgccacgtccagctaatttttaaaatatttttaatagatactgggtttcaccatcttggccagctgggcaggctggtctcgatctcctgacctcaggtgatctgcctgccttggtctcccagagtgctgggattagaagcatgagccaccatgcctggtctagacattcttatacttccaaaatactattgaggtgtttttgctacagaaaataacttatctaaaaattatttttaaaaattatattctacatactgatttattttatcttcacctcgataagatcacctttttcattgtcacaaaaaggactacaattagagatcttagttaatcacatatgttttctcatagtgcttatttgtcatggaccaaataaattattactcatggacaggaaatcagaaacttatgttgggtttcccctcaatgggcaatatatttgacatgaagaattgaataaaaaagcaataaagtggaagaatgtatgaaagttctcagaaacaacaacaacattccacagtggtgggatatgtcaacaggagccaattgaaagagctcacaatggcagaagctagaacaatgagaaacaaaagaaagtaatattgaattataacacaaaatataaaatatctatgaatcatactgaagtatatatatctcagtatataaagaaatatattccttctctctcttccttatatatatatatcagtatcaattcatagatacttattttatattttgtgtaatattggattatatataagatatattcaatgttgaatatgtacatatgtattcaataatgtaagtctatatacatatatgactgaaacatacatgtatgtatacatacatatatgattgaaatagacatgtgtgtgtgtatatatacatatatgattgaaagaattactaaaaggagagaatagacaaatttcccattcagagttccaaataatttttgaagatactccgccctcatggagacaaaaaccaaaccacccactgcttaagtgtggcatgtacttagagatttccttccaaagaatcagcacggaaaaagggaaaaggaataattttatagaggggaagcctggcaaacacaatctcgactaagggataaaaatcaacatcaacatgtcatggtgataatatgaatcctggataagctgtgtttgaaatggcactttacctctgtgatctttctctctcaaaccaatatccccagtaagataatgggggaaaaaaatcagaccattgccaattgagggacattttgcaaaataactgaccaaaactgcaaataaaagggaagtatgagaaactgtcacaaccaagagaagctgaaaaagacatgacaacaatgtaatatggtcttctggatgggatttgaacagaccagaaaaaatacattaggtcaaaacttaggaaatctgaataaattgtatactttagttaataacaatatataaaattggttgattattgtgacaagtctgccatatttatgtaagataagggaatctggatgtgggtatatggggactttctttactagcttctcaatttctcttacagtctcaaaccattctaaaatgaaaagtttattttttattattttttgatgtcccaatatctttttattattattattatattttaagttctggggcactagttcagaacgtgcagatttgttacataggtatacacgtgccatggtggtttgctgcacccatcaacccatcatctacattaggtatttctcctaatgctatgcctcccctaggcccccaccccccaacaggcccaggtatgtaatgttcccctctctgtgtccatgtgttctcattgctcaactcccacttatgagtgagaacaggcagtgtttggttttctgttcttgtgttagtttgctgagaatgatggtttccagcttcattcatgtccctgcaaaggacatgaactcatccttttttatggctgcgtggtattccttggtgtttatgtgccacattttcttaatccagtctatcattgatgggcatttgggttggttcgaagtctttgctattgtgaatagtgctgcaataaacatacatgtgcatatgtctttttagtacaatgatttataatcctctgggtatatacccagtaatgggattgctgggtcaagtggtatttctagttctagatccttgaggaatcaccacactgtcttccacaatggttgaactaatttacactcccaacaacagtgtaaaagcatttctatctctccacatcctctccagcatctgtcgtttcctgactttttaatgatcgtcattctaactggcctgagatggtatctaatagtggttttgatttgcatttctctaatgtaatgatgagcttttcttcgtatgtttgttggccacataaatatcttctcttgacaagtatctgttcatatccttcgcccactttttgatggggttgtttgctttttttctcgtaaatttgttaagttctttgtaaattctggatattagccctttgtcagaaggatagattgcaaaaattttctttcattctgtaggttgcctgttcactctaatgacagtttcttttgctctgcagaagctctttagtttaattagatcccgtttgtcaattttggcttttgttgccattgcttttggtgttttagtcatgaagtctttgcccatacctatgtcctgaatggtatcacctaggttttcttgaaggatttttatggttttaggtcttacatttaagtctttaatccatcgtgagttaatttttgtataaggtgtaaggaaggggtccagtttcagttttctgcatatggctagccagttttcccaacacattttttaaaatagggaatcctttccccattgcttgtttttgtcaggtttgtcaaagatcaaatggttttagatgtgcagtgttgtttctgaggcctctgttccgttccattggtctatatatctgtgttggtaccagtaccatgctgtttttgttactgtagccttgtagtatagtttaaagtcaggtagccttgaggcctccagctttgttctttttgcttaggattgccttggctatgtgggctcttttttggttccatatgaagtttaaagtagttttttctaattctgtgaagaaagtcaatggtagcctgatggggacagcattgaatctataaataagtttgggcagtatggccattttcacgatattgattcttcctatccatgagcatgaaatgaagcaatataactcctaaatatattgcatgagcattaagtgctctatttggaggaagaatagaatcttttcagctgggagtctcagcaaatgtttccaggaaagattgaggactgagatcaacactgaaatataaaaattaaccactccacaggaatttttcatttagtaggaaaattccagaacatgaaaatgcctttacatcaaaaaggtccacttttaaattttacagtggcatctccaatatgaacaaagaatatcagtgtcattttcttccccaactatgtatcaagacactcttataacaccctaaaaaagcacatgttcttatttgtcattactatcatttaaataaatctgattattattttgagcaaataataggtggacaacttggactaccacatcatgaaagatttttaaatttgttatctgctctcttgctaaaccttaagaaactttagaaaaaaaagtttgcgttcagatagtaattcaataatgtattaatttattagacaaatgtttgttgagcacccactaaatggcagacaggatttcagacacagaaagcacaataatacctaaagcactgcagtctctcacaagctgatgcctctgtgttcatggcaaggatactgcaggaaggatgtagtgagttgtgggcaaagaaaaaaaatcagatcctttttgatttctatttaggttgaatttgattgtctccaattcaatgataatatggtaacatatgttctgataataaaattagcaccattctatccattccttcacattaagctaaccaacatcacattgtctttatctatctatatatgtgtgtatatattaacataagcatatttatatattttgtcatatatttggctagagcaaataatatatagtttttaaaaaattatctggctttgcatagtttaatcatttggggctaaggatcaagagagagagtgagagatagcatttctctttgttttctgatgtttgtgcagctgttgccactgccttgccagggttttttttttccaaaagggagctactggtatccttaatgccagctggtggcattcttttattaagcaagatgaaaataaaattatctcttcctgctgttgctatagtgactgctgtacttaccatctcccgttcccacctagtaggtggtatataggtttttctggagccaaatatattgctcatggtggcatagttcacatttcaacctggtgcttcatttgtccacagactgttccttgtttatgatgcaaatgatctttctcgtcctcactttctaagaagcaaggtttaagttcaatactattaatctctgttaaatgtaaaggcttataaagacaccagagtcctaaatgtgatgtgaatagttctggataaccaaaacctaaataaacaactggagagtttcaaattttataggtttttttttcacaagctatttttgtttaccacctgcaaaaatctaactacaactgaaaaaaaaaaattcccagtatattatgacaggtaccagcagcaaaaaaaaaaaaaaccaaaaaacaaaaaacaaaaacaaaaacaaaaaaaacaaaaccaagcaaaacaaacaaacaaaaaaaccatgaattcacagcagttagatcaataaattttgagaactaaatatttataaacagacaaaaatagggaaatgacttttggttagctgttccttggaaagttttttcaccttactaataaaatatcaatgattatgcagaaaaacaagtgctagctatgataattttgaaatccaaagtcaaattggagaggatttatataaaatgtaagttacgtggttttggatttagaaacatctaaattttaccttatgaagaagattagctctgcttactgaaaaaacataggaagacatattgtccttcctcatggcataccatcaccatcagtgctactgcccaaagtcaccagagtatttttcttgacatgccccaagcatttacaataatttgtagttagcacttcctataaatatataaggcagaaatcaggtaggcctagaaaaggcacatcgcatttgaattatataaccccagtggataaagtgctaaaggtagggcataaggatattaagaaccttggtagcatcagataatagaattgtgatttttgctgctccccatcagttcagtgtcagtactaggcatccaagaggggacaatgtctcaccttagtccagcagagctgtcctagataaatgtctgctagacctgggaatttgaaaagggctagtcaatattgacattccctatagttagttaccatagaagaagacttgatctgtacagtaagtgaaatgaaaacttctcataccctatctggtggcaaatgtcaaatgaagagatatctcctcaagagacagttaagaggtttcagttcaagatggctggctagacccagatagtgccatgcctttctcatggaaaggaaacaaaataacaagtgaatactaacacttcaagtggattatctaagagatcactttgtgattcaccagggaagtgacaggacccacatagagcagagaggaatgaagccatgaagctgaacattaacccacccagaactggtatggagccgaggaaagctccctaagttgggaaagtgagtgggggaagagtgagtgagtaagagtctcccctggggatcacacttctgccatggacttttgtagttcagctcttgactccctcgggcttccagaacagcagagagctatgtggagtctgtgcagaggcactgctcaagcccacatggaaccaaccccacaagcttttggttttctagcagcccggttccagcagccactgccccactgagaaaggagacacagcatttttccgtgtccctagaatagatggcgcatccatagtactaagaagcagctagactccatactgcgtaagtccttgcctctgcagctccttagtaggtgggactcactggcttgggtccccagcacagcctccctgaatttcctgaacactgcagtcatggctctgtttctctgagtgcataactcccagaggtagctaacaggcccttcactatcactgctgccttcactcctcctgtccccaagccagggagggaacaaggaggtggggcacatttgtggacctccagtatggatgtcatagctgacatatggaggaatagtggtaggcttgtgccccacaagtccctgccttcactgctctctgccaaacagggcttgctgcctttcggcccataacacacttactcatcccctggctgatcactgcggtcatggctctgtgttctgagtacataccttccagaagtagctgataggccctctgtgatcacagctgctgctgtctctgcacatgctgctcccagattgagagagactgaagagatgggtcactttcatgtacctccagcatgggactccatagctgagatacagaggagtagcaggcacgtgatgtaccccacaacttcccacctctgttgttccctgccaaacagaactcactgacttccaatctccaatgcagcctttccacccctgcctgatccctacaatcatgggttattcctctaagagcccagtttcctgaggccagcaacaaatattcacaattgttgcttccattgattctgcccctaccacccccaggccagttcaggagcaagaaggcttctcacctttgcatgcttcaaacaatgaaatttagaactccttgtgtgggagggaggttcaagcacacaacatgccccatagctgtcagctgccactgtcccagctgagggttcctgctcttccaatgaagggcccacgtcacagctgccctgccccagcctgaatatttaagctttgacccagagccctgttaaaaacataaaccccacaggcctctgatattcccttgggatcccaccacctaagcattctgcctgccctgacctgaaagttctgccagtgacccgggtaccagcccatccctccccatcatagcgagcatctgaactagactagaccaagtggaagaaagaacttcaatgcgtaaaaactgttcttttgaactagcccagtcagttgcaaataaagaaaaaaatttaaaaaacaaaacctttgagaaataagagattatgtaatgtaactaaacctacaagttattggaattcctaagagagaaaaagaaaaagtaaacaacctggaaaacatttgagaggataaataattaaaaaatattgctagaggtagatattcggatatgaggaaaccagagaacacctatgagataatatacaagataaacattactgaggcatttggttactagactatccaaggttggtgctaaagaaaaaatgttaaaggcggctagagaaaaggttcaaatcatctacaaaggaaaaccaatcagactaacagtggacttctcagcagagaccttacaagccaaaagaggttggtgttgtatttttagcctcctttaaaaaaaaaatgtcagctaagaattttatattactacaaactaagcttcataaatgaaggagaaatactctttcccagacaagcaattactgagacaatttgtcaccactagaccagtcctacaagaaatgctcaaaggaattctaaatgtggaaactaaaggatgatacttggcatcagaaaatgacagatatatacagaactcacagaccctataaagcaactgcgtaattaaaactccaaaacaactagctaacaacactatgtcaggaataaaaacttacatatcaatattaatcttgaatctaaatgacctacataccccacttaaaacatgtagtggcaaattggataaataaataagatctaatgatctgctgtcttcaggagacctatctcacatgtaatgacatccataggctcaaagtaaatggttggagaaatatctgtcacacaaattgaaaacaagaaaaagcaggttgaacaacagcatcaagtcagaaatcaaaataaaaagtttaatgaaaatagcaacataacatacaaaacctcctgaatacagtgaaggcattgctaagaggaaattttatagcattaaatgcctacataaaaaatagaaaaatcttcagctggaaatgtaatgctgcatctcaaagaataagaaaaacaagaacaaatcaaacctaaatgtagcagaagaaaaaatactagagcagaactaaatgagtttgaggccaaaaaatgatacaaaggatcaatgaaataaaaggttggttctttgaaaggataaaggaaattgatagaatgctagctagcctaaggaaaaaaaagagagaagattcaaataagtacaattggaaatgattaaggtgacatcacaactgataccagaaaaacaaaaaaagatcatcagagactagtatgatcaccttgatgtacacaaactagaaaacctgaagacgtaagataaatagcatagttcctgcttcaataagctcacttattcattcactcaatcactgcttctttcaacaaatataaattaaatgcctattatattctagacacaggcactgatgatacagcagtgagaaacaatgaatttgccttttgaagaacactaattgttttcattcattttgttatttaaagaatattcctagaaattatgtattttcattgtgtggtgactaccgtgatttttttttcattttacaatttctgctttatgaaatcttactactttttatctttattctaatgattctctgagtttagcagatatagaaacataacattcccaagtaatgttaaatttatatctcttttaaacaattttatatcctgtatttttctcatttcacctattctactgaattacttagaatttcaagatcaacgtaaagttgcttctttagtggaaatgcctctaatgtttctctattaagtataatatttgtttcaagttagatagaattaatgaaactaagctgttgagatcttaatttggttctcagcttgaacattattagcgtatggaagtgctactgacttttgtatgttgatttttgtatcctgagactttactgaagtcactaatcaggtctaggaatcttctagaagagtctttagggttttctaggtaaacaatcatatcttcagtgaacagagataatttgacatcctttttcccaatttggatgccttttatttctttctcttacgtgatagctctgtttgggacttccagtattatattgaatagaattagttaaagtagccatccttgtcttttcccagttcttagtgaaaatggtttcaacttttccctgttcaatctgatgttgcctgtagtttgtcatgcatggctcttattattttgaagtatgttccatctatgctagtttgttgagggtatttattatgaagagatgttggattttatccagtactgttttttgcatctattgagatgatcatatagttttcattcttatatctgtttatgtggtggatcatgtttattgatttatgtatattgagccatccttgcatcccttgagcgaagcacatttgatcatggcaaattatctttatgatgtattgttggattcagtttgctagtgttttgttgaggagttttgcattgatgttaatcagaaatattgacctataattccttttttattgtcattttgtccttccctgattttggtatcatggtgatacaggatttgtagagtgagttaggaagacattccttctccttgattttttggaatagttttagtaaggttggtaccggcttttctttgtacatctggtaaaatttggctttgaattcatgtggtactaggctttctttttgttaggagattttttcttattactgattcaatttcattactcattgttggtctattcagggtttctatttcttcctagttcaatcctggaagtttgtatgtttacaggactttatccatttcctctaggtgttctagcttgcgttcataaaggtcatcatactagtctctgtatcggttgtgatgtcatcttgatcatttctgattctacttatttgagtcttctctctttttttttcttagcccaactagcgttctatgaattttctttatcctttcaaagaaccaaacttttacttcattaattctttttatctttttttttttggcctcaacctcatttagttctgctgtaatatttgttacttttttctgctacctttcatttgttcttgtttttctagttctttgagatgcaccactaggtttctaattaaaaatcttatattttttgtgtttactgatttatgtatattgagccatccttgcatctctggaaaaaaaacacatttgatcatggtggattatctttttgatgtatttctggattcagtttgatagtattttgttgaagatttaatgctataaactttaatgctataaacattcctcttaccattgcctttgctgtatcccagaggtttttgtatgttacatttctactttcattcattaattttttttttatttctgacttgatgttgttgtttaacatgatcttttttgttttcaatttatgtaatagatatttctacaaccctttactttgaacctatggatgtcattacatgcaatgtgggtatcttgaagaggtcaaatgattagatcttatttatttatccaatttgccactatatgttttaagtggggtatttaggttatttacattcaagattgatattgatacatgatgttttgttcctgacatagtgttgttagctagttgttttggagtttcaaataatttatttacatcttaatactccctttttttcatcactctgtttcccagctagcctcatacatgtctctaaagctttatatgttactatatctttatggtcaaaagatctctacagtgattcagaatgtcggctctggcatcagacatcctacttggaattttgcctctattatttactaattgtgtaacattgggcaaggtacatagcttctctgagcttcagtttctcacaaaagtgtctaactaaaaggatattttaataagaaatgaattaaaacacacatatataaatattcattgtatagtgtgtggcaggtagtgagtattcagtaaatggtagctatcatcatcaccatcttgtctccattgtcaatactttttaaatgttttgggtgagatgacattagaactataaactggtaagattttctgagaacttcttttggtcatacattttctattttttttttcttgaaatggagtctcactttgttggtcaggctggagtgcagcggcacgatcttggctcactgccacctctgcctactgggttcaaatggttctcccacctcagtctctcaagtagctaggattacaggtgtgcaccaccatgccctgctaattttttgtgtatttttaatagaggtgggtttcaccatggtgaccaggctagtctcgaactcctgacctcaagtgacctgcccactttggcctcccaaagtgctgtgattacaggcacgagccaccatgcctgacctggtcatacattttctattcatgagcatagaatggtttatttttttctaaatctaaattcagctcaccactgagatttattcattcaggaatatctattaagtacctaatatggtgcttggcacatatgcatgcaattaatattagtttaataaaggaaaaagctgtgaattaaaaaagaaaactgaactgttatttggtatacatggtgctagatgctggatacaaggatacatatgctacctttttatgttatttaataatggctgtcatttattaagggttcagtgtaagttaaggtctgtttttggataaaatgcaagcgttatcccctgacaatcattttgaggtaggtattgttattcctgttacacaagtaaggaaattgaggtttatctaaggttacatggttaataagtggaagagatgtaattcaaatccatgtctttctgattctagaggtcaagcttttatacattgcagatgtgtaaataacttgacctcccaccacaatgacatgaactggcaatacggaaaagtcattgactttctaatagtagaagattagtaaccttttctactcctgctaattttagtgaaccagagcgtggatctactcctctgtttttgtacagcccgcaagctaaggagtttttttttttttttttaacatttttaaatgtttgaaaaatccgaaagaataacacttcatcacatgttaaaatcatataacagtacctacattataccctcaattttgccttttgccttgcaaagcttcaagtatttactaagtgaccctttctagaaaacatctgcctaaccttgaactagactatttgggatgcccttcagtaatgtgagtaatgcttatgccatagttgatttacagaaaaaaatgtatcactagtaaatagacatattagtcctacacagtttctggaactgttttcttacacttcagtgcaaaagagctagagcaacaacaaaacagaagcaaaaatcaaaagactactagtacattgggctgatgcttcatgtaaaaatgagattcattctctcaagaattaatttatataattaatgaaaaattccacacaaaagtaacctgttaaaaataaatgattttaaatacccttttaaatgtgcagacaataaactgaatccttccttaaacttgagtattacccaaagattattttacatactagttgagcctaaatgaagatcacaaattaaaactttctgaaataattaaaagataggaaagaaagaattgggccaaggacggggagcagatttgctttaaggcaaggcatgaagtttttagccaagatgtaagataagttgaaaattgatcactagtcaactgagttatgaaatgaaacagcttccaacgattttttaaattaaacatggtataaattattcagatagaactgttgagtttatagcttataagagaaaaaatgcaaatctatgttacttgattaaactatacaacagcaaatgagctaagggaatcaagaaagcaagcaatttacttcttcaggtacttgatcaggaggccaggactattgtgagtgctctgcaatacacgaatgaagttgaaaacaaatttggcagagcaaaacactcaagcacacatatgcgaacagcataagaattcctgtaaagggctgtttagatttttactttggttatggtataaccataaccaaaaccgtaaccatagtataatcatggttataccataaccaaactaaaaattcaaaacagtcctttacaggaattcttatgcagtttgggactggattggatttgcaaagggaaaaaaaaactatttctttatgaaaatgcagttatcaggttgaaaagcataatgttatactcacagtcaaactgtcttaaaaatctactcaccagttaattatgtttttctcattggatatgtggaaaagaaataactgtgtcatctagaggggctgttctaagtagagtctagtggaggcaaaaattgcctgaggagttgaaagaaacatagcagagggaaatttctagtagataataactgccatcacccttggtcagaggaacaccgttagctttaaaactatggtagtttccaagaaactctaaatataatttttttagagagaatattttcaaactattcatctgacaaaggattaatatccagaatatccaaggaactgaaataactcaatagcagaaaaacaaataatctgatttacaaatgggcaaatgagctgaatagatacctatcaaaacaagacatgcaaatgggcaccagataaaagtattcaacatcataatcatcagggaaattcaaatcagaccacaatgagacatcatgtcatcccagttagaatggctgttataaaaaaggcaaatataacagatgctggtgaggatgtagagaaaggggaactctttttaatgatatttttgttttcttttattgcttgcaaatattgtatatagttctatcatcatatatagataattttgtatcttatatatgctttttattatacgttaagttcttgaatacatgtacagaatgtgcaggtttgtaacataggtatacacttgctatggtggtttcctgcacccatcaactcatcatctacattaggtatttctcctaatgctatcgctcccctagcacccaacccccctccccaagcccggacaggtcccagtgtgtgatgttcccctccccgtgtccgtgtgttctcattgttcaacttccacttacgagtgagaacctgtggtgtttggttttctgttcctgtgttagtttgctgagagtgatggtttccagcttcatccatgtccctgcaaaggacatgaactcatccttttttacggctgcatagtattccatggggtatatgtgccacattttctgtatccagtctatcattgatgggcatttgagctagttccaagtctttgctactgtgaatagtgctgcagtaaacatacatgtacatgtgtctttatagtagaatgatatataatccttttggtatatacccagtaatgcgattgctgggtcaaatggtatttctggttctagatccctcaggaattgccacactgtcttccacaatggttgaactaatttacactcccaccaacagtgtaaaagcattccaatttctccacatcctctgtagcacctgttgtttcctgaccttttagtgattgccattctaaatggcatgagatggtatctctttgtggttttgatttgcgtttctctaatgaccagcaatgatgagattttcttcatatgtttgtcggctgcataaatgtcttcttttgcaaagtgtctgtgcatatccttcacccactttttgatgggtttgtctgttcttttcttgtaaattagtttaagttctttgtagattcttgatgttggccctttatcagacagatagattgcaaaaatatccctttctgtaggttgtctgttcagtctgatgatagtttcttttgctgtgcagaagctctttagtttaattagatctcatttgtcaattttggcttttgttgtcattgcttttggtgttttagtcatgaagtctttgcccatgcctatgtcccgaatggtattgcctaggttttcttcaagggtttttgtggttttaggtcttacgtttaagtctttaatccaacttgagttaatttttgtataaggtgtaaggaaggggtccagtttcagttttctgcatatggctagccagttttgcaaatagcgtttattaaatagaaaattctttccccatggcttgtttttgtcaggtttctcaaagaccagatggttgtagatgtgtggcattataattgaggcctctgttgtgttccactggtctatatatccgttttggtaccagtaccatgctgttttggttactgtagccttgtagtatagtttaaagtagggtagcatgatgcctccagctttgttcttttttcttaggattgtctttgctgtacgggctcttttttggttccatatgaaatttaaagtaattttttctaaatgtgtgaagaaagttaatggtatcttgatggggatatcattgaatctacacattactttgggcactatggccattttcatgatattgattcttcctatccatgagcatggacgccttttccatttgtttgtgtcctctgttatttccttgagcagtagtttgcagttttccttgaaacggtccttcacatcccttgtgagatatgttcctaggtattttattctctttgtagcaatcgtgaatggaagttcactcatcatttggctctctgtttgtctgttattggtgtataggaatgcttgtgatttttgcacattgattttgtatcctgagagtttgctgaagttgcttattaaggagattttgggctgagacgatagggtttgctatatatacagtcgtgtctcctgcaaacagagacaatttgacttcctctctgcctattcgaatgctctttatttcttcctcatgcctgattgccctctctagaacttccaatatcatgttgaataggagtggtgagagagggcatccttgtcttgtgccggttttcaaagggaatgcttccaccttttgcccattcagtatgatactggctgtgggtttttcataaatagctcttattattttgagataagttccatcagtacctagcttattgagagtttttagcatgaaggggtggggtgttgaattttgttgaaggtcgtttttgcatctattgaggtaatcatgtggtttttgtcactagttctgtttatgtgatggattatgtttattgatttgcatatgttgaaccagccttgaataccagggatgaagctgatctgataagctggtggtggataagctttttgatgtgctgctggatttggtttgccaatgttttattgaggatttccacattgatgttcattaggaatattgggctgaaatttctttttttgttgtgtctctaccaggttttggtatcaggatgatgctgccctcataaaatgagttagagaggagtccctcttttctactttttggaatagtttcagaaggaatggtaccagctcctctttgtaccactggtagaattcggctgtgaatccatctgatcctgggcttttttttggttggtaggctattaattactgcctcaatttcagagtttgttactggtctattcagaggtttgacttctttcttctttagtcttggaagggtgtatatgtccagattttctagtttatttgcatagaggtgtttatagtattctctgatggtagtttgtatttctgtgggatcagtggtgatatccactttgccattttttattgtgtctatttgattcttctctcttttcttctttattaatctggctagtggtctattttgttaatcttttcaaaaaaacagctcctagattcattgaggtttttgaagggttttttgtgtctgtatctccttcagttctgttctgatgttagttatttcttgtcttctgctagcttttgaatttgtttgcttttgcttctctagttcttttaattgtgatgttagagtgtcaactttagatctttccagctttctcctgtgggcatttagtgatattgatagaaataaatttgatttttaacattaggcagagtatccttgaattcatacaatatagaagagtaggcatttaggtatagtgctacttatgctacagctcttcaaactgcagagcaccgtcaggaggttggggtgggtatttttacattatagtcttttctatattcttcaaataaggaacaaaactatgttgtccagttgcctattattttccaaaaagtgtatcctggaatcttagaataatcccctttattgttacgtcttgtaatacaaagattggggctgtatacatatattattaaaaatatttttactttatttaaaaatatatcttttattatatgtcaaacactataaaaggctttaaaatgtaattaattatgatgtgaatataaagtcttctaatgtataatttaatagatatatatgacacattttctcaactgtaatggaagaatattcatttcagcaacttttttctatgttaggtttctgagataaatcatgctaaaattacagaaagttgtaaagttgtaaataagtgggatgaatttttatactgataacattgttttgctcttagagtatcaaatcaattatcaaaatataacatattttacttgctattcattgtaataatgggtattaggaaaattctttcataaatgtgaacctacccattgaactaagttcgaaattataggtaatataaaattacacgttgaaaattgttctgaactgacagtcataggctgtgagttaaaatcatgaagtttttagcatctagagatgtagtcccagtgtgaaaaactatcttgcttcaggctaaatctggctatacaagtgtttttgtttttttacacttgcagtgtaagagcagaataggcagatagtccaatttaacaaaggctgaagttgtgccaggggaataaaatgaagggagaaaggggtaaggagtcatagtagtaggcaagaaagtaattatataaggaaatattatgaaataactgaagagggtagttaagcgtgaaagcttgagagacaatttaatacatctgcaagttataagaattgctatactaaacgattttctggttttactatgacatccttttctcatcataatggatttgtagtactcaaactctctgtgtatgttgtatttatcctttcacatttttctttttaatgcttagctttaaaatttcctaagatttttagtcaattaagactgatctgaatttggaaaaaaatgaacttagaagtaaacaaattaggattattatataattgtttatgtagatgttagaaattttatcaaatgtataaaacctctgccagagttcatagactatattcacattaaacacactgatatacaactttttcattgtagattagttatcatttgtattattcagtgttgaagtagctttttgtaacacatgaaatacaggagaaaagacctaagatcaaaaatatttttatcacattctgtggacagtttatcatttcacaaaagcatttgcaatttactgtttcacttatgatgtaattaaaagtgtctttttcaagggaagcatatgctggttttctttggtttcttttttataatccctttggaggactgattaatgtctgataatatgtaaagtgaaaatggcaagccatagcaagagattactcatctgacctgttatatataaccagagaaaaaacggggctaatgaaagtttcattacaatttgtcattatctttacagattttccttcctctttctccagctgaatcttaattcaattcttatcttcatataatggatgttagtatattttttgagatacctataattagctcaactgatattttggagagacagtttttattaaaagttaacatttcctaaaggtgatatgttgtcccattcataggtgactgataacaaatatttaaaagaattatagcattatcaaatcaaaaccacaatgagataccatctcacaccagttagaatggtgatcattaaaaaatcaggaaacaacaggtgctggagaggatgtggagaaataggaacacttttacactgttggtgggactgtaaaccacttcaaccattgtggaagtcagtgtggcgattcctcagggatctagaagtagaaataccatttgactcaaccatcccattactgggtatatacccaaaggattataaaacatgctgctctaaagacatatacacacgttatgtttattgaggcactattcacaatagcaaagacttggaaccaagccaaatgtccaacaatgatagactggattaagaaaatgtggcacatataaaccatggaatactatgcagccataaaaagtatgagttcatgtcctttgtaaggacatggatgaagctggaagccatcattctcagcaaactatcacaaggacaaaaaacgaaacatcgcatgttctcactcataggtgggaattgaacaatgagaacacatggacacaggaaggggaacatcacacaccggggcctgttgtggggtggggggagaggggagggatagcattaggagatatacctaatattaaatgacgagttactgggtgcagcacaccaacatggcacatgtatacatatgtaacaaacctgcacgttgtgcacatgtaccctaaaacttaaagtataataataataaaaaaagaattgtagcattatatcatgtggtgtaataggaaagtatttaatcaaataattttattgattaaaaacattgtaaaccaagagtatcataatagctctagatttttaaatgctaatttcaaagctgaattagtcactttgaaaactcaaatcttttctgctgtgagttcttattcttgttacctaattttagtgaatgtcagtgtcctaatcataaatggacataataagccctcccatatctgtttacaagttgatcacagacccacaagtttacatttgccaataaaataccaaaaaccttcatttttctatggcttttctgtcaaggtaccattcaacactcacatttttattttaagaactattattaagaatcttatttgctctagagtgtgttatggtagccattctgtgcagacaaatgactatgtattagagaatgctaatttaatttttttctcaaaacatgtgtaagaactgctttttctattcttcctcagaaactggtctttaataagatgtccttattgaagattattttaaaattcctaaaattagtgtggtttaacttccaaacattgaattgcttttgtcctggtatagtttttaaaactttagaatcaatcacattgactttgatttgccaactctattaaatatatgactgcagtgaattttttacttgcttttcacatagaaaaacaggaattagtatctacttccaggaagcctggcatagagtaggtatgttagtagctagtgtaactattttcattcatttccttttctctcttttctcttttctaaacatttagaaggtcaaaaatagtttgtgaatgaagtttgactaatttttattatagggtatttgcatggaatgcaaaaaaatttacagtgacctgaataatcctgatgatagtaacaggaacaatgaatacagccaatggaagacttcaatatgcaatcactttgcaagtgaggcagcaaataccaagtcagtattacaaaacttgtccgttgtttttacagaagtcatagaaattaaagttgaaggcctctcatgttgagaagccagctcagttccttaatctttcatataatatatatgacactcaaatgtaattaatgaaactttataaaatttgtctctgacacttagtctaatataatttgccttttcaatggtctttttgtaaaaagtcaaaatctcaattttataaaaaattttaaaatttgcattaaatcgtatctgtgttcacagcacttttagagaattaattgagaatccttggagcactgatagtctaaaactcattagggccacctacaggataaatgtatagccacgaatacctcagtattggcactccattcctcttcctttttccaaacacacctcctataagctcaacattgccacttattcagaacagacttaagactgggaaacataagtccaggagacaaatcaaccacagcgttttacttctaattgtatagcttttattctcctgtcttgagccttttcctcactcctccccaataactaaaccaagctattatatttaacatacgtaagatacaagatcagtgtccagaatctcttatgtactatctcttttgatagtttcaggtactctatttccctccaacactttaaaataatgctttttagggaataatttttgaaatatttttcaggtgtttgtgtgtgggtacatatagctcacattctacctactcaacatgtctcaggaggttaaaaaaaaaaaaaagaaaaataactttctgagtagtttgccaagtttctctgccaactctattaccacgtgttatctttatgaagtctatgaagtctttcaggagaaatccccttaggattgggtatatctctaccttgttttggctcctcttaagtttagagtcaaatttgtagccaacttccaataatttacaacaatatatagtgtatattcctaaatacttgttttgccctgcagccttctcaccatgcttattttgtcttcacctagaattcctcaactattgttttatttgtttacttattattattgaggcagatacatattttaagctacctcaaatactttgtggaacaatacagggatgaaaagagtaactgaagaatgtcaagaaggaaggaagacaaggcaaaaaggaagaggaagaggaaggaagggagggaaagggaagaaaaaaggaaggaaataaaggaaaaatctaaagtctgtgtgtatgtgtgttcatgtattaatagctcccatttagagaaatagtgtgaagtgctacatggtaaatgttcatggtatgtttttggtcactcatgagtgtggctgtgacaagctgagctttgaggatttgggcttatatacctatttggtgacccagactcctgtgagctatgaaaagttggcccaagtaggtatgattaattcatttatatatgtatatcctttacagtttttctgcataaccagtacctaacacagtttttaatatatagtatgcattgaataaatatttgttaaataaattcataaaatggttcattttacatctgatcaatatggctcaaatctcatatcccaagtctacactccatcatctaaagctcttaataacatctattattgtatgtttttcatagttttttttttttttcgtagttcttctaggatgaataggtgcagtaattctccaagctacagttctagttacagctcttcttttaaaccctgtgtgagcttcttaactcagaaaaagaaaggtcagagcaaagacaaagtctagggccctgtgacttttgatcacaaaatttctcatcttgtttcttaagttgagtatttgtaaatgtgccttatagtaagtccagaaagatatttatttcagtgtgtaatttgaacctgaattttagagtcttcgtattgtgatttttatttttactcccttttattcctgtaaaggtataaaatagaacacacgaacatgtatttttgaccttgtgtaattgcaataaaacaattcaagccaatatctataaaagcacttggtcttttttccatttatcttcttggtacatgtaacgtgtcatctattaaaataacatgatagacactgaacctgcacatacatccaccgaagtatttcaaagttctctgattaaatacctccaaagaaattaactcctttctcttcttagtgagagatgaacaaacagttaaattttcactcaggctattcagtctaaccaccatccccatcaaccaagaatttttttacataaaccattctgccttagatcaaccatcatcttgcttggtacagggaccacttttacattgtagataataatgtttcacttttctttatggtaggaaagagttaagtgagaaatgtacataccccatgaaagtacagacttctttttagtatttatatgtcttcaagaaagaaaaaaaaaatctactcacaatataaaaaaatctatttatctttgggcttctggtgctaaagttcccaggaaataatgacacagagacaattctatgaggaaatgttgaattttgcttgtattaaaagctggtacaaaataaagcaattggagtgaagtatcatcttttgggtcattgggatctcaaaacacaatttaggtcatagttattctataattttcttttctttgtgtgtttaatttctagggcatgcctgtacttcaattcctcagaaataggcattaatttaggactgttttctattaatcttgtaaatacaataggttgatttgaaatgtcacaaaaataagcataatataaacttgtagtaaatggattgaaatggatatttatgttttagagaccattttaaaaattcagttaaaataaattgatatcccaatgaccttccagaatttgtagattcgatgaagatgaaaagaggaaagtgaaaccacataatccctagagatattaaaatcaagcatggtggctttcccctataatcccagtactttgggaaacagaggccagaggattgcttgagaccagtgttggcaacatagcgagactctgtctctacgaagaatttgaaaaattagctgagtatattggcatgtatctgtagtcccagctactcgggaggctgagactggaggatttcttgaccccaggatttacagactgcagtgagttatgatcacatcctgcactccagcctgggcaacagagggaggaggctctcaaaatatacattaaagtcctgccacaaccactgcctaactatcttgtattgtatttctaggagtaaagtaaaaggaagtcaaattagaaatcttgccatgctttgatttcatattaagatcattttttggaaaaaaaagcctctaagaatcagtccttttgagtttaaagccatgatttgcatatatttgtttgtttgttacagacaatcatgtgtatgttgtattatctcatacatatgaaattcaaaaagagacaagcataatatttggtaatagaaatcagagcagtaaccttgtaggtacatatatttgaaaatgactgccttgatttttactgctactgaagttagtgtatatatttttaaagtaacaatcccccagaaaagtagaactagaattgctctttttcttttgtcctgctactttatgaaaagcttaactgtttataaagaaacattgaattttgtataaaatcttaaacacattctgcaataatgaatacttctctgtttctttatttggtgtcatgtcttcactacttattagacccccatgattttggatgtgtttaagaagatttggttatacattcagcaaaataattagtaaattcttacccatctcaaaaatataatgtatagaatttttcttagattgttatagactagtaatttatctccttcatatccactagtgtattttcttgagtgttcagtttatttgtcaaattaatattaaatttgaagctctaccttgtattgctacaaagcatattattttagcatgaaataattaaaatatattttaaaaatctattttacaatttgtgcctaatggaagaaatggcagaacatttctaagaagcatttcttatcatggaaacatgatttacagacccagaattctgggacagtttatttataaaaatattgaactcctaccatttgcaataaagtagtctaaaagttgtcttattgatcaacctatcccaggaaaaaggaaaggagcgtaagtactgagatataaatagtttaataagcaataatagaattacaatttaaattacacatcattcccttttggaccattttctttttaggaaaatcttttcaaattgtgtaaatgcaacatagtttaagggaaggccattgatctccaatactataatcccttttacatagaagtgaatatttcgttaactaatactcccagactaatcaaaatggatgagagtagttaattcacagagcccattctaggctttcataaaatgaaagtcacataactttcttattcacatttatagaaaaagaatgctttttctatttttactatattttgttagagcatacaagcctctctaatttggcatgctcatgcttggttttacacatcattcttagcctgacatataatgaagaagccggtgggacaccaagtcctctaaccagttctgtttctcttttcactatgagagaatgggcgttattggtagtagaaatatcactacgtaggaaatattataaaaaatgactctttgtgttaaaaatgctatactccctagcatctatactggcaacttgaatggactgtaaataaaaataaagagtgtggtttttctatgggtggtatagatttatttccattgtggtatttaaaattagatgatgtagatatatgttaaagccttcttgtcactgattaacaaacaaaagacaccttgtgaagataacgatagaaagtaagtacaagttacaatcatagcaattctttacattcttttctgccttggatctaaatgttttattatgttgacagatctgggaaattttagtggccggacaagaagtgcagtctctgtgagggaaggccagggtgtcgttctgatgtgctctcctccgccacattcaccaggtacagtaggatctcattctttgctgctgctgctgctctcttttgctatgtgttcattcttttagacagtatattgatgggagaacatttcaggtgaaatgtgcatggttttcttgacatctatcagagtgccagatgagtaattcaagatcacgtactctaaatatcattagacaggatactgaactccaataagattgttttattgccattctaactgttaactgtcactgttatgcctctgtcttccatcagtgaagaatatattgcctagagcacaaaggaagcgataaactgagagaatgaaaacttttcaaaatagtttggagtatcagagttgagttaactgaataccaatatgcgtcttgtttcaaaagataaactggatacttagttgtttatggtgctctttgccacactggaattagaacttctaagaaatgctttttttgagtttcaaacaaaactgcaatttagttagtactttttggctctttgaggtcttgtttgtaaaagtcatggtgagtactttatgtggcttgaggaagcagaaaactaagctctgctcagattaattatacgtccttttgcaagcttacacctaattatatctattttgtttgagtttcataatttgagatgagtactcctttggaacttagtatagctttactataagttaagagtgaccagcatcagttaaagagagagagaaagagaaagagcacaaggaagaaccaaggaatgaaggccttaattaacaactggtaacagaattgaaggtcttggtatgtcagtaattttttcttctttaattagagtgatggccatatttgtttctaggttatattatcagggtagtaatggagcacaatttggctctactgtacatatttttttaataacaaaatggcctacattgattttcttaagacttctttatctttatctgatcccccttctatatttttaatcgaaagtatgctgcatatcaacagggacatatttttgaaaacacttttatttgaaactcagataataattacaattagggtaattattgtttgagttgtacccctccaattgttgagttgtaccactccaattcctgtacaccagtccagttattctaatctttctgtgaaaggtttgggaagtttacattaaacatatctattcttgcctgcatctaaatccagatttaggttctttcaagacaacatctgttttaatttttttaatggataagacaaaaatttttattacatttagggaaagtgtatagcattaatataagtcatgtctcatattggttattaaacagatttcatccaagggggttattagttgaataattgttagagattgcagaaaaggggaaaagaaggggaaggagaaagagaatataacaggctttatagaggatgactgatccatcactagactgacaggagttaacaacataaagtgacccctgtgggaaaataagcaagattttctgagatatgatctttattttaaggctggggaacgtgtatttttaaacaaagtgaaatggaagaggataatatagaagtcaaaacttcgggattacacataaattatccaattggcagagaaaactgtatacagatttctggtgggagaatatagtacaatgaattgcatatatggtaagataaacataagataagaataggcactaataactgattaagtaataatgtgatctctgattgagatcaatatatgtaaattaaatgactgttcagtaatcgtgttttacatccgaactcatctgcttgaccaaggccaacttgatatgttattaccacagctgcagtctctcaattgccatatttacaagcttcttattttctgaacagcatccactgtcttctactcacccctttagtaccctgattgcaggagtcctttcatgtcatggaaatctacaaatcattgatcctaccctattttcattctactccacctcctttgattcttacttttctccttcagttattatcatattcttttatacagcttcaattttgtcatctctcttttgctttcgcacactgacattccagtttgcaaaaccctaatcacaatatagatccaactcttagcctacttcacatatgaatctattcagtttaatattactgttaaacaatcccaaaaaccaaagcacacatacaaaacaaatgaacaaaaaaccagttatacagactgctgtcaatttaaaataaaaatgatgaactttacatcttaatgttaactagaatttttttaaaaacctattatttttactatacttttgtcaaatgttttatgtgtcttccccagtctcactctcaggtgataaacatgcatcctattacgttgtgaaagagaaagcaattagaaaataacctccacaagctctcatcaccaagtcacacaccaattagcatttgtagccatacactctgacttcccagtttttagtatatattatagtatatagtacagtatatggtacagtatagcatagtgtactatagtagagtataagtcagatacaaaagaatttccttttcaaaggtttggcttattcagcatccctgttcttcgtcccctacttccaaggccacactaacttccttatcctttgttcctccctattttaatttcagtaaacaactttcccaacagtccttatttacagagcccacatttgctacccactctgtaaattacccctcccatcgcaacagcttttcctgctgaaaccgcccttcctgccagtgtaaccacattcctgcacctttcaagttagccagccaggttcagcttagattgtgcagtccaactccagccagtggaggcaggacacagtagcagggataagctgcattaaggataaaaaccccttcctgcctttgtttggtgtgctctcatgaccagacttgggagcagcattcttctgcagaagcaaattttgccttgctgagaaatcctgtctttacgtgctctttttcttgcgactccaagctttacttccaacggtatagtatagcatatgcatttgttgcagttctaagactaatctctcaacttgtgtggcgctgtagttcatctttttttgcctactttaagaaattgtttcagcagtaccccttcttctgcatttttatcagagtttgattcctcttctggagcagtccatcaacatggaaacctgctattctttcctccatataaaaataaaacaaaggaaaactccatcggccaatgccctcttcattcagctactacatgatttttggtttccctttacagtaaaacttcaaaaactttgtctttatatactctatccaattctattcctctcagtcagtctgtgtgtttctctctcttccccctatttttgtctctactctctttctaacagatttattgacatgcaatttttatcccataaaattcacgcattttaagtgtacagttcaatgagttttggtacatttatataattgtgccttcatcaccacaacttgaaagatacttccatcatttcaaaaagtcattcaatccctctcctactcatgtccctaggcaatttttgctatgctttctgtctctatagttttgacttttctagaatatttattttattttattttattttattttattttatttaagacatgtttttgccatgttactcaggctgttcttgaactcctaggcttaagtgatccgctcacctataatcccaaagtgctgggattataggcatgagccactgggtccagccagaaatttcattttaatgcaatcatacaatctgcaatctatgtatgtgcacgtctgtgggtgtttggtttcttttactgggcagaatctgagattcatctgtatcatggcatgtatcaatagtttgttgctttatattgctgagtagtatttcattttaaggacacattccattttgtttatccatttggattattttcagttctcatgtgggttatttctttctccataaaacactattttcacttagcttaaaagattcctcactcttgatattcctccactctttcttcttaatctcctttgctgatttgtctcatctcctcaaactcttaattttatagtcccccaagtgtcagtactataacttcttatctccttaataaactcacactttgttagttttcacctgataataaagctttaaatatctaaatatctaaaatctccctaacatacatctctaacccagactctggcttgtatgtatatccaactgcctatcagtatttggctaataggcacttcaatcttaaccatgtctaaatctgaactcctggttatttcttccccaaaccttctctagctacagtcttttccacctctattaatagaaatttcattctgtacatcaggcctcagagccattcttcacttctcactttctctacaccctacatacaaaccatcagtaattttactggtgtcagcccactttctggtccatagacaacttcttgctgtgtactcacatggtggaaggggccagacagctctcttgggccttacttataagtacactaatctcattcatgagagcttcactctcatgacttgatcacttaccaaaacacttgccaactaataccagcacattggcagttaggatttcaacatactacttttgaggggatataaacattcagaccatagaaggtggtatttggagatggggcttttttttagttttatatgaggccttgagggttgggcctttatgataagattaatgactttattagaagagacaccagagagctctctttctctactgaatgtgagaaaacaaagaaggtgtccatctgcaaaccagaaagaaagccctcatcagaaaccaaccatgctgtcacctaatcccagacttccagcctccataactgtgggaaaataaatttctgttgtttaagtcatccagtctgtggcacgttgttatggcaacttgagcacactcatgcaccatctcattcagcttaatatcaaagccaaagtccctaccatcgcttggagaaccctcgccatttgcctccaattgatctgtctgaactcagctactgctttccctcctactctctttcttgtagttattgtcatttccttgatgtctcaaacaaccagacaagctcctaccttaaggcctttgcagtcgctattccctaggcctggatcatgtatatcccaggtatatgaatggctcactccctcacatccatatctttctttaaatatcaccttagtaaaaccttttacaatcttcctcttttgatttctactccacaattcgtttctccatctttgctttatttttctccgtagtactcacagcattacatatactgccttaatttttctccataatgctcctagcattccatatactgcacgcatttacttacttcgttgttcatagtttgtctccttcggttacaatgcaaattctactaagacataaattctgcaggttttgttcactgttattaccccattgcctaggacagagtatgagctcaaaaatatttattgaatgaatctatgtataatattcagaaatatatgaaatgagcccaggttttaataaatatcagaaactttgatggaaaagtcataaataagaataggaaaaaaacagatcagctatgtaacaagaaaacctttcttaaaatttacctttttctcataattatattgtgaaatggtgcattaattttaatgtcttgcttatttgcttaaaagaagaactttgaaactctcttgggaaaatatagtcaaaaaagcttgctgaagaaacagaatatattagtccattttcgtattgctgtgaagaaatacctgataccgggtaatttataaagaaaaagaggtttaatggactcacagtttcacctggctggagggcctcacaattatggcagaaagtgaaggaggggcaaaggtgcgtcttacgtggtggcaggcaagagagcatgtgcaagggaactgccctttctaaagccaccagatcttgtgagacttattcaccatcatgagaacacaatgggaaaaattcacccccatgattcagttacctctcactggatccatcccacaacacgtagggattatgaaagctacaagtcaagatgagatttgagtggggacacaccaaaccaaattacagaggaagtgagaaaagaataatccagggtgaagtttctgatctgacatttattagcaatgacttcaacaactgcctttgtttgggtggaatgagattgatattatgaaattagtaaataacctgatacgtgctagaaatcttagacccaagtttctgtttcatccaaatagtcatgtagattatcatagcatacttgttcaactgatgcttgattgcattttgtttcccaatcttgttttacttccgtttttcaaatcataattagtttgttattttatctattggaacaatacaatgtaaagtgtcaggagtcaaattttattatttttatctttccaagtagattatatgttctttcagtatatgaagcttaccaccttccacttcatattcccaatacgtagcacagtgtctgatccttactaggtgttcattaaacgcatgttaaataactgagtgaaatgcagattctaacagttgagttttgcaaggttttagacagtttctgtcagccttctggtattagctcattgtatcctatattcatgacagatatttgggtcacttaatatcacattcatgtattgctatttcaaattgtagcagctactatgattcagtggaagctgtatgaaatgataaaacagtttacacatcagagaatattaaaaattattcagaaacagcccacagatccattttcttattacctcaaatagatgtgcaatgcccatttttcttcaaataaaagcaaaagcttgaattgacttgatagctaaatttctcagttttcttcccaagagatcaatattaatctctgtcagcaacatatgtacatgaaaataccttgtttggatactgaggtggttattcatctataagacaataaatatatatatttaaaatgttaagcacacctagcccaaatgagttttgattgccaaaaaacgtgtttttcagtttagtaattttgaaattgagggttatattgtaaaggaaggctttgtgaaaatgtagaaatagcctcataaaacctataaacctatataaagttattttactatttagaagctatcatttatagatactttctacataaataagtcatttattactattttacttacatatttgactttattatgtacagaaatattcaaaagcttacgttgaagtggtttatttactttggggtatatacccagtaatgggattgctaggttgaatggtaatctagttttagttctttgagaaatgtccaaactgctttccacagagactgagctaatttgcattcccatgaaaaatgtagaagtattcccttttcactgtaacctcaccaatatctgtctatctaatctatctgtctgtctatctatctatctatctatctatctatctatctatctatctatctatctgacagagtcttgctctgttgccaggctggagagcagtggcatgatctcagctcactgcaacctccacctcctggcttcaagcgattcccctgcctcagccttccaagtagctggtaggtactacaggcgcacaccaccacacccagctaattttttgtgttttagtagagacagggtttcaccatgttggccacgatggcctcaatctcctgacctcatggtccgccggcttctgcgtcccaaagtgctgggattacagacgtgagccgccacacccggcatctattatttttgttttactttttattaatagccattctggctggtataagatggtatctcattgcggttttcatttgcatctctctgataattagtgatgctgaacatttttacatggttgctggctgcttgtatgttttcttttgagaagtgtctgttcatatcctttgcttactttttggttttgttgcatttgcttttgagaacttagtcatattttttttgcctaggccaatgtctagagagtgtttcttaggttttcttctaggatttttatagtttgaggtcttatatttaagtatgtaatccatcttgagttaatttttgtgtatgatcagagatagggatccaacttaattctgcatatggttagccagttttcccagaaccatttagtgaatagggtatcctttccctattgtttatttttgtcattttttttgaagatcaattggttgtgggtatgcagctttaattcaggggcctctattctgttccattggtctatgtgtaccagtactatactgttttggttactgtagccttgtagtatagtttgaagtggttatcatgctttttctgtggtttatttgccctctttttactttcacctatttttattaatatgtttttaaattgtaattttccttctattcatttcaaaatttaatattttatatgctgttttcaaaattatatgtaaaatcttaatatagctatttaacattatttttgaacagtttcaatgcagttgtttttggtgattaatgaatctgttcattcaaacagaatttgaagaagtaagggtgtgtaaatttctggctctatgaaatacagtacctaagaaatggagaatttggtttaggataggaaaagattagttgagttgtgaatacatgaagtcttatatatctataggtagctcagaaaactggatataaatctccagttcttgatacacctgactcccataaagtgcaaaaccatagacaggtatatctcacttaaatatgctctccaaacaatcagtttctctactatcactcctccagttataggtggaattgtggtggtatgcatatccatcagggggaatactagtgttgtatgtacattggatctcagagggaaggaaaataaaatcataataatcagttaagtaggaagcgccaaggcaactggagtaagtgcataaagtgagtatttgcagactaaacttattttatttctgcatataagctttaagccatcatagaaaatagctgaatttataaagtaatgagctatatagcgaagcttaatcctgagcactcagcaaacatagtgtataatgcatttggttgtccttttaacactccttcattgtaaacactctaacatatagtatatccagtttggaaataatagtcaaaatgcaatggacactgaaggactaaagatgctgacacctttctagctgctaaatctaagcaacccctcattccccttggccttgagactccttggaagtattggttagagtagagcaaagaggtcttcagtttttgtgtatgagctgtaacacttcagctggggcatttcctattaaagaaagaaagaaacaaaagagataatttttgttttgtgggttttttttttcttttggattctaaatacttcttcttcaacctagtttaagacaggcagacaggttcaccattctcaaaaccgttgtaaagacagataagatataagtaaacaaatccagagaatataagaggtagtcccaagaacactatgatgaaggaataccagatattctctgcttctaaatagctatattgtaccatcatatttcacctgggatttggtctcagacatccagggattctcatcctggctctgacatttaccattggtctgtctgttaaattaagctttaccttgcctgtagcgaaggaataataaaagctacctcacagcattgttgtcagaattaagaggtagtttatgtaagataattagctcaatggttggaggacagtgagcattaaattaactttgtcttgataatctgtcttcaaaaaccctctttaaaatgcaaatgcttttgagaaaggggttgccttaaatcattatctgctaacattaattaacagttggcagagattagttgacatcaagctgacaaggcaactagaagatgaatggcacttggaaatgggaatctcagagtttaagaaggggaagggatcaagaaaaggaaaaatgaatcctgacagttaagtgaaagggcatcaagtatcattgctatcttcaggagacctctttatcctaaaataataaataaataccagaaattgttcctttaaagctatataaaatggcaaccaaaatttcacagaggtaaaaacaaaatatttttgatggtagttttatttaaaatgagattttacattatacaatgtaaatcataatttaaaatgatgtaattacaacaagtacaagaaaaatggacaagacttttttggcatctttaatcttacaaaatagtaagataccatgatactccttgcttcaaaattaacttttataccacaaacacaaaaagtaattgttccaaaaatatttaaggatttccacaaatttctaaagatttcttagttgttttatttcaaatcactatatattaaattacataagatctttattctgtgagagtttatcacacagactttcattttttgataattttgctttattgattgaagctgttttccaaatgtgtctttgttaaattaatgaaacccacaacttttacaagatttacagttttactttgaaatacgttaatgttgtattcttacattttataaataacttatgcaaaagatattggcaagatggaaatacatagattctaggaagtgtaattgagtgagactaattttaaaagtaatcaattagtcattattatgtgattatgacttcttttcctaaaaggagcttgtaattagggttacttgagttatattatttggacacagagagctctatttttaagttttgcctagaattagccatctctttggataaatggaagcaaagaaaatcagtattttacattttatgtatcctattctatctttatccctgttttataagtaagttattgttaccaccacattgcaaatggtaatattgaagctcagagagcaagttgcctaaaatcccatggctaataaataaaaacacagagatccaggtctgtgaattcaaaccctatgtccttttgactatatcatatggtccttacacattcagtatattgtattgtattagtgcattatcccgctgctatgaagaaatacctgagactgggtaatttagaaaggaaagacgtttaattgactcacagttctgcagggctgggggcctcaggaaacttaaagtcatggcaaaagggaaagcaaatacatcctttttcacatggtggcagcaagaagaattgccaagcaaaaggcggaaaagccccttacaaaaccttcagatctctggagaacttgctcactgtcatgagaacagcatgaggataactgctctcatgattaaattacctctcaccaggtccctcccacaacatgtgaggattatgggagcttcaattcaaaatgagatttgtatggagacacagccaaatcatattattccacctctggcccctctcaaatctcatgtcctcacatttcaaaacacagtcatgcccttctaacagtccccaaaaatcttaactaattctggcattaactcaaaagtccaagtcaagtcttatctgagacaaggcaagttccatcctggtatgagcctctaacatcaaaagcaagttagttacttcctacatactatgggggtacaggcattggataattacacccattccaaatgggagaaattggccaaaatgaaggagttagaggccccatgcaagtcctaaatccagtgggacagtcaaatcttaaaggttcaaaatgatttcctttgactacatgtccaacatccaggtcacactgatggaggaggtgggctcccatggccttgggcaactccgccccttacagatttgcagggtacagccccctctcagctgccttcatgggctggcattgtttgtagcttttcaaggctcacattgccagctgtcagtggacctactattctggggtctggaggacaatggccctcttctcacagctacactaggcaatgcccaagtggggactctgtgtgggggctccaatcccacatttgccttccacactgcctcagcagaggttctccacgagggctctgtccctgcagcaagcttctgcctggacattcaggcactcccatattctgaaatctagccagaggttcccaaacctcaattcttgacctctgtgtacctccaggctcaacaccacatggaagatgccaaagtgtggggcttgcaccctccgaagccatggcttgaactttaccttggccccttttagccacagctgggatgcagggcaccaagtcttgagtctgcacaaagcagcagggccctgggcctggcccacaaaaccattttctcatcctaggcctgtgggcctgtgatggaaggggctgctatgaagacttctcacacgctctggagacattttcctgattgtcttggtgattaacatttggctcctcattacctatgcatatttctgcagctggcttgaattcctcctcagaaaatgggtttttgtttcacattatcaggctgcaaattttctgaacttctatgctctgtttcccttttaaatgtaagttccaactccaaaccttatctttatgaatgcataaaaccaaatgcttttaagagcacccaagtcatatcttgaatgctttgctgcttagaaatttcttctgccaggtgccctaaatcatctctctcacgtttaaagttccacagatccccagggtgggggcaaaatgctgccagtctctttgctaaaacatagcaagagtcacctttattccagttcccaacaagttcctcatctccatcggagaccacctcagcctggacttcattgtccatatcactgtcagcattttggtcaaagccattcaacaagtatctaggaggttccaaactttcccccatctttctgtcttctgagccctctaagtctctaggacattccaaacattcctacatttttctgtcttcttttcagcccttggaactgttccaacctctgcctgttacccagttgcaaatttgcttccacatttttgggtatcctttcagcagtgccccactctccgtggtgccagtttactgtaatagtccattctcatgctgctgtgacaaaatacctgagactgagtaattgataaaggaaaaacgtttaattggttgacagttctgcagggctggggaggcctccggaaacttacagtcatggtggaaggggaaggaaacatgtccttcttcacattacagcagcaaggaaaagtgctgggcaaaaggagggaaaagccccttataaaaccatcagatcttgtgagaacttactgacttcatgagaacagcatgagggtaactgcccccgtgattaaattatcctccactggttccctcctaagacatgtggagattatgggagctacaatttaagatgatatttgggtggggacacagtcaaaccatatcacctattgttactggtggcaagtctgaacagggtccttggtcctcgattcttgtcctgttggaagaaagaatttggccaagaagaggtagtagatttaaggcagaaatgagagtttattgaaacaaagaaaagtccatttggaaggacccaagttggaaactcaaaagattgactgcctcgcctgatccttagctcagtgctcttatagacttattatttcctgctttttatcctggtcttttccccttgtccttcctgttgggcaggatgttggctaatcgcagtatgtagagtgacttgccagtgtctgggaggggccacatgcatcatttggtggttgaggttatctgcgtgctctcttagagcagttttcccttgccaatctagctcccccagaggaaggtcatatactgatcaaactgccattttgctccttactgcatatgcctgaatatattctcagaaaaaggtcacaatctgccattttgtctcttactgtgcatccctgaacatgtcccaagaggaagatcaaattccaccattttgacccttactgtgtatgcctggatgtgtttgttcaattcctaggatcttactgggagtttgttgcccaaaagctcaaggtgtttcctatgtgttaggaaatgttccttcccctcgtgccagtcttgaccactcatttctgaggagaccgcctgacaattgcctgacagtcacctgacagttgcctgatattctttggggccctattctgccctgttcatatctgcctatctacctactctaacaacatggtctgaaattttactaaaaatgtttattttgtgtatacgtaggccacttgttaacatgtttgttatgccaattcaaataaacaagagatttcatcaattattttgattgacttaactaaattgttgtctgaattaaacatttaatgcttcccaaatcaaggatataaacagtagataaaaataaacacatacacacaaacacacacacacacacacacacattttagtatttttaccaagtaaaataatgcagtgcttaagtgtctattttagcagttatttagaagccaggcaacatagacaatacaaggatattgaaggaaatgcttgagaaataaaggaattatttatttttattatatcatgtctgttttcctttgtgagtaaaaaatgtataaattatatactctcaaattaatcagaaaaagactgcttcaacctaaactgtgttgtccattgaagcatttgtaacaagtgctttaactagttacttaataatatctgaatgtagtgcttatcaacagatacattttgacattattttaaaatctgcagagatcattttaaaaatattttactttaaaatatttcaatagaaaaatgttttgttcttttcattgcttttcctgtacttaattgtaatatattttccagatatcactagaaaggaaaactcaatgtgtttcagagtctttagttttttaaactatctgacaaaacttacacatggaaaactaaactatcacaaagcaaacacttcaatatggagtttgttttagaatatttagacacagcataaggaaaaagacttagaacactgcaataaccttggttttttttacttagattggttagggattttgacatcaagcagctctagtttacctaattatttttgattgtttaattggatttgaccacatagtaaaaggatttgacccaagtccttaaaatagcctatttttgtttcatctttatagtctacacagaaaaatgtaaaaaataatggatcaagaaagcaagcaactcactcctttgataactggttcccattagtgggaataactagtgtttccatgttacgttcatttggtttggccaaagtggtcaaccagtcaaattagtatgttaaatgcagacaagttagtgtgcaatatttgctagtagtgcttgctctaaaactgaaggcaggaagaaagaaatggggtaacttatgtatgggttgagcatgaaaaatgtggatgtgtcagaatgtctggaaagttacgatatccttctaattccagagagtatctaagctagtcctccctatctgtcatatgatgatatatttttcatatgaatttatcaccatagaaacctccaatatctccccatcacctgtaaattaactttaagttccttaacctggcactcgatccttttttgagtctcctgtatagtttgccatttgactatgaagcacctaagcttctgtttatcttactcactgtattcatttttttcagcttccttgcctttgatcatgtcatttccagtgccagaaatgcttacccatctcccttatgcacttttgttgaaacgtgtattttattttattttatttttttgagacggagtctcgctgttgtcagcccgggctggagttcaatgggtcgatctcggctcactgcaaccttcgcctcccgggttccagcaattctcctgcctcagccttctgagtagctgagattgcaggcacccaccaccacgcctggctaatttttgtatttttagtagagacggggtttctccatgttggccagggtggtcttgaactcctgacctcaggtgatcgacccacctcagcctcccaaagtgctgggattacaggcatgagccactgcacccagtcaacttgtatcattttttaaagtacataccttaaaataactatagtatatgtatacatatttcttgggctctagggtcagaaggattcaattttgtcacttatcagcaatgtgactttggggaagaaatataacatgttcttaccataattcctcattttcaaaattttacatgtatatgctgaaagatttaatgagatgatatatgtaaagtattttacccagtgcctgcttcttggtaaatactctataacttagtgatgatgatgatgatgatgccctcttcattttatccgtttatggttaacaaagtaacaaaggatttattcttctctcctggccccctgcttcctcattagcattcctaagtgcctatgaacaagttttcttctcttgtctaaatcttgtcacatccttcactgcacaacagtcatttatgacatcttatttttcctactcgatgtaggctactgaggcagtcccagtatctttgtatcttttatagatttgctgacatagccctggatgttatcaggtacttgataactactgtttattaattgttctaaagcaaataatgaggcctgagtaccccactttaaatagttaattttgtatatttcaaaagataatgttacctttctttatattttttcaataaagaaatatagtgatgtagttatttgatcacatataatataaatcttactctagagaaatagaaacaaatagaaaatgttatcttcatttaggaatttcaattaatgttctcagttggcaaattaatatttgagtcaacccttttctctttgttttatgtcacttattaaatatggatcatttttaattagttttattgaggtatattaacatataatgaacatcagcaacttttaagtgtataattcagtgaattaagataaaagaagtcatgtaaccactaccataatcatggcatagaacatttccatcaccacaagaagttccccagtgctcttccctttccaatcaatttttcccccaattctcatccctgatattcattgatgtgatttctgtccctatattttgttttgtccagaaattgtttttgaagaaattctacagtatgctcctctcacttggcataattttgagattcaggcatgttgctgaggcagttagttgggtttttcttaaataattgctgaatatttcattgttgcaatatattaggttggtgcaaacgtaattgtcgtttttgccattaaaactaatgatagaaccacagttatgtctgcaccaaacctaatgcttcaggtgtttatccatttatcagttgatgtacatttcagctgttttcaatttttgactattatgaataaagctgctatgggattagtatataaatcttcaagtgaagaggtatatgtctttgtgtgattttatgttttcatattataggtgcttacttcattttctccatgaaagtaacttgctttcagcatttatatctgtggagctataggaaaatcttgttattaccctttatgttgctatcattctatgtttgaaaatttatacataattttgatgatagtatatattgtttgcagcattttggaatgaaatatatgtttttcttctgtgtgaatttggggactttatagcacatgtattttcctcctttcctagttagcattctttccatttctgtctgaagaaatcaaatattagtcatacagatgccattacaatgaaagtgcaaacagctgtggttatatttacttgctttttctttctcttagttgaagaatctttttcttaacccagagttcagctatatctttacagtttctagacagaagcattagaaattgtaaccagccacatatattaatacacatatttttgagtttaaataacaattgacagttgttttaaaaatctcaatttatattggaggtccacgtgcacgtgataaaagcaatcaatatatatataattgctatatttgtctcatataaacattttctaaattattcgtatcccccaccacctccatttctttcaaagaagtagaaaaaatagtttaatacgtacaacgattctataatgaaattgaaaatcaaaatatgggcggggcatggtttctcatgcctgtaatcccagcacaaggccatggtgggtggatcccctgaggtcaggagttcaaggccagcctggccagcatggtgaaactctgtgtctactaaaaatacaaaaattagctgggtgtggtggtatgcacctgtagtcaggaggctgaggcaggagaatcccttgaacatgggaggcagagattgcagtgagctgagatcgcaccactgcactccagcctgggcaacagagtgagactcagtctgtgtgtgtgtgtgtgtgtgtgtgtgtatatatatatatatatatatatatatatatatatatatatatatatatacacacacatatatatggtgattagtcctaaaacaatacaaattacaaatgtttatagtgaaaaagtactaatatctagaaaatggaaatacatctccagcatatatcttcacatagaaatatatcttcacatagatgtatatctatatcaatataattaaattttatacgatataaaaatattaataaattagcaaacacctgctattgttcagattctatgaatatatgacctagaatagtgtattgaagctagccattgtcaaccagggttccaaaagaaaattgagccctatagaaaatgatatgattgactgttttcttagttcccccaagaatggtacgtaactaaaatcattctaaataaatagaagataagttagtttattacatataatacatgccttaggaccttagagattaggtttttttcaccgagcattatattataaacatcattccatgttaaaaattatttaatccccaatttttaatggctgtatgtattccagaaagattatttaatctctaatctgatactagaaatttgagggcattttcaaaaatatttcttattgtaaattgctttgcaatgaacattaatagagaaccgtgtgtgtgtgtatgtatgtatatatatgtgtgtgtgttgtgtatatattatatacatatatgtaattattttttgataccaaatttctagtggtggaatttccttgtgagagaatcagtattaagtttgttgataagtattgtcaaactgtctttcaaaaagagtgtaacaatataagttagcctcacctagtcatttgtgcactagttttgaatctcttttctcagcctgctggtaatctttactattaccctttgctcaaaccaatgaactttaagttgccagactactagttagtcttctgtagaggaggttgtgtgtagagcaaagagaacaagtatatttcctagcctttcttttatcctaccatgctggaattcagttcacttttagttttatagagggcattcattgccattctctcacgtatgttttgattcttcctgtctacttttacgttgtatttccaccaggaataatgaatcctatcccttccatcaaatctatttcaagaaagacactttgcaaagcagaagggctccaagagcacagctctagtctctcttcaatgtttataaggcacagtcattatttttacccactgctgaaaacatttgcaggggttattaaaaaaattttttacctaaagatactaaatagcaggggttgcagacataagcatccacctgttcactggcttattcacttaaaatataacaagcatgttgcctaagcaaatgtccagtaagttttctttctgttgtttgcgtttagtaaagttctaaaactatacaattttctctttctttccttcagactataataggaactgggtgaatattatccaattaattctgttacacaaagggccttatcttttttcttatccttattttcaaaaggacactgcctgctacgtgcttagcaacaagtagtcttttttttgaacaagatgagaagaaatccagactatcctataacagtggaagagttgtatgtaaaccttattaaaaagtccaaacaatatcaaatagtataggcttatttctctctagcttgctgcaaggttgacatcccagagaggatcagggcatatggggagtaatagtcctgcagatcaagcagccagatgtgactaagaaaatgatgaaagtgaaatctgaagcactactgtcattgttgtctcatcatatttataaacaaaacattcctggttgagatggaagtcttttgtgttaaatgtagggttctccttaaatattaacaacaggcaaggcagggatatgttataagagttaaatgtaaggttcctcttaaatattaaccacaggcaaggcagggatatgttatagaaatgtacatttcattagcaaggaaacaaccatgatatcgatggagttcttaccacatgagacgcacagggatgattaagtgtatgtaatacagtacatataaggtaggtctccatattttattctcctgctaaaaacactaaaggaaaaagaaaaaaaataaaacaggatcttgagctagatctatgatctttctaaattaatttagttaagatagctttttcaaatggattccttttacaaaacatgttgttaagcagagttctttagagcataaaatatagtaagcggtgtaactgtaattagaatatgcccatgtatgatggggagacgaaagtcagcacctaagagctgcagttctgagatctctctgcaaagctggtctggaggatagccatataaatgcgttctcttatgctgttcttacacattgcaaaaaggcatgaagctaacaagcatcgaaaatgagtgccgttagacatggtggatcattcactggaaccgttcttcccctcagggagaatgaaagtctggagagagaaaactggctgacctcgctcaatcagcacagtctgaatgcaggcagaatggccagcggtgacagggctgtgcttcggagatgtgtgtgctcaggctgcggttcaggttatgtcaacaaggatcactctgggtgccattttagtggctccatgttgtacataagagaaagacggaaggagaaaagggaaaactgtgggccactttaaatgtacttgagaactttgcttttcacttaggacatgaactctctctcagcctgtaagcagctgcagctcgaagcttgacaaacaggccaggaagatgggaaagtactctagtagcagcattgcttctccagtggaaaaccgagagtcctaaatgttacagtgcttcagcctgaggtttaactgatagaatgccttgatcttgaaactgaaccaggcatcagtaaactgtagaagtttagcctgttgtgcatagaagatacaactttgcattttataccttttactgtgtttaacaaaagaaacaaaacattccaaaaacctcttattaaatacatatcctgctttctgttttggaagtagtgtttgtatcatgcgaataggctctaaagcttttaaaatatatattctctattctaagaatggatctaacaaaataaatcaaaaggaattttatttttaaaggatttgatggaggaaagggtgagatctgtgatacttatagcttccaaatctgtaggttcataggacaagtgactccctatgcttggaaagtcttcactattttaattacattctaggattctagttataaaccatacccatgtcttgtacaggaaacaaaatacataatttcatcaatccttcgtttcaatagaataaaatgaagataaacaataatattattgcaaataatagagactgcttagcaaaatatctgacacatagtaagttcttattatatacataggtactaaaacggttactatgtaatatttgagagacagatttattcttggagcaatcagctcttagatctatctacccagggaatcatggcacataatgggaagtacaagaagccggtaatagttctgaattattttaagccatggtaaatgggagaaaatagagtattaattcaataccagttgaattagaataaccttgaaatttttgtcctgatatatagaattgttctgtctcaaaaatcttctttatctaaaagatattctaaactaataacataatcaatttagtaaatgcttgcttgctagacaccaagccgcaatctacatactttacttaaatcatttctatgtaatagttacaaaataataagaaaaatatatctctacttctcaaatagggcaacaaagactgaggaacatttagtaaatagtctaggtgatagaaataataaatggtaaaggaaggatttgaaaaattttaaactggaaatttgctttagaaaatctaattgccttatatctgaattagtatttgtatgatttgactcattctaaattatgaggtcttacaatttattactctttgtaaacactgaaacttgtataggtttgcccacagtagactgactaccttttattgagctgatttatcaaccctccggtgtttctaatttctgtattctaaaaaaaatttaaaaagatgaactcataagtcaacaaaataccttaaaatggtgatttaataatctgaacatttctctaacaatgtaagaaattgatttctttcttttctatttagttcagatcacaagtaccttaaatactcgtgcaaattgcttcttcctcctttattatgtttactataaatttgcgtttttcccattatcttgaagtaatttatattagcttcattttttagcgcaaccaaataagttctagaaatacatattttgttattttaaaaacgtgaaaaaataaaattaacctcaaaatgattgagtaaaaagaagtcagtttaatgcattgattcagaattcttcacattatttgcaagtctgtatctctacaaggtaaattatttatgcagaatcaaacaactgaaaaactcttttaatgcaaacttttttctacaatgtgtaagattttataaaaagaaggaaaaatgacaatctaatagtgtccatgtgccactgtatcaatagtcaaccaaatatttatttttttaattattttgatatttaatagaaaaaaatagggcccaaatcactaccaaaacatgatctgaatcattaccaaaatattaagctatattttgacccattagatcaaaggtaaataagtcccttatcattctgtgctgtgaatatgattgagtcctaatttgaattcagtttaggaaacggtactgagaacctcctctatatgtttgtgttatggaagtaaaatcatgaaggaggtattgtgttctgctcttaaaaataaaatgaaaactcaaagcagttagcttttatctgttgatctatctatttttaaaatgaaataatcaccaaataacccaaatggttggcaaccagaatatttcacttctggattagttctcaaccaggaatgattttaccgtcaggatacatttggaaatgtctagaggcatttttaatttctttaataggagcagggggaggagcagcaggatgctatcagcatctagtgggtgaaggtcagtgacgctaatacacatctgcaatgcagaggacagtctctcatgacaaagaattatcagcccccaatgtcaagggtgctgagattgagaaaacttgatctagatcatatggaggttatgcattaagatgatattttacatcaacattaaatttatgtaatttgtgctctttagcttttagatcctccaaatattagtattagtagagattgctgactctttgaaataaagagacaataaactaatgaactaaagtaaaactggaaagaaggcatagaccatgagcctttccaagaggagtatagtatttcaaagttattaacatttaaatggccacataaaggctagtacctagtgttctcataaagatactcctacatcatttaatcataaagtgtttatttaggtacagtattacaacgacatcaacattattagtatccccttagtcaccttctacatatgcattttcatctcttccttgataaaattattgatgaaagtattggtgtatgagacagttcttgtccactttaaaatacagttatgttgtgttttaaaattttggcagtcttagctgagaacttcattagagagttcataaaatcaatgatgtgtgcttaccattccaccacaaagatctaccactggaaaatatggtatttttctgcagatagattaaagcatacattttgatggaatttccttgtaattaaaggaaagactcaggctaagttaaaagtaatgcaaaactgtacaaggaagcaaaatctcaaaatggtagtcttgatagaaaaataattaatgaaaaaacaaggatggcatgttttgtattaagaaatattcaccctaaactgaatcagtttgaaaaaggtagggaaaaacattgggacatagaaatgtgcttacaggtcttccagttcatttaaaaattttatacgtttcattaattttctctcccacttccaacatttgtgaaagcaattaataatcatattgttgcctctataaattttatttatgtcaatctaacgggacctatacaatttagctagaatactggaattggttcaagtctcatgtccttatctcaacatatctacctatatattaggatacatgcattcccagggtttctagaaaaacttccagacaaatcattttaattattttatttatcatcttataaagaggtaaactttacccaatataatagtttttaaaataattattttatggcacatggtagggaaacattttactgtctgcatttattttattttttattcattcaaaaattatttattgtgtaccagccactttttacactactgaggaggtatggtaatggacaaagcagataaaacatagtcaagatttcttccctaagaaaacacttactgccacgcaagagataagtaatagaggtaaatacataagacaaacacacacacacacaaagagaaagagagatagatagagattgattagattgattattgatagttctagttaaggtcagcaaatccataaagacctcccacagggagtcatttgagcagagacctaaaagaagttaagtaatgagccatgcaggtaactggggaatgcgtgtttgaggttaaggtaaaaattattgcacgtgtcctaagttggaaactaacagcagggccagtgtggctagggtggattgaagaaataaaagacagtgttgtagttaaaaagagtcaggcaaaatcatgtcagtcctaatagagtttataagtagaacttataaatttagtctattaccaagggttgaaataggatgaaaagaaaacacctgatttcactaaacttaaaataaccaaacactgcattcatcatcagaaagggcttcataaactacttactggatactctagtgagttgaaaactgtttttgaaaattagagtaataatacccattagcaatttggggcaactcaagatagctccaactatctttactggtaacataacactcttttcaaaatttctaaaattaaattaatttaaataagtttatttttcacctgtatgccacgtttgcacagtaagtgtatgacagagttcctgctctagatgagtatgtgatctggtagggaagatgatgcatccagagaactatgggagaacataggaccactacaagaggaatgtgttgtgtggatgatggaaagggcgtagggagaccatataatatatataaataatatccaaactggatcatttttgagaatgaaaagggggaatattaatattctttctgggaaaactggtgtaaattggcagtgttgtaagcaaactggtgcacgagttaatgatgtatctacaaaatttcagaaaagaagggtgaattgtaaattaatgtgactttttaaatctttaagttctgggatacatgtgcagaatgtgcaggtttgttacataggtaatgtgccatggtggtttgctgcacctataacccataatctaggttttaagccccacatgcattagatatttgtcctaatgctctcccttcccttctcctccacaaccccgacaggccccggtgtatggtgtccccctccctatgtccatgtgttctcattgttcaagtcccacttaggagtgagaacatgtggtttttggttttctgttcctgtgttagaatgctgagaatgatgaattccagcttcatccatgtccctacaaaggacatgaactcattcttttttatggctgcatagtattccatatgtaccacatatggaatatgtggtgtatatgtaccacattttctttatccagtctatcattgataagtatttgggttggttccaagtctttgctattgtaaacagtgctccaataaacatacatgtgcatgtgtctttatagtagaatgatttataaatccagtaatgggattgctgggtcaaattgagtatctggttctagatgcttgaggaatcatcacactgtcttccacaatggttgaactaatttacattccctccagtaggttaaaagcgtttctatttctccacatctttgtcagcatctgttgcttcctgactttttaatgatcgccattctaagtggcatgagatggtgtctcattgtggttttgatttgcccttgtctgataaccagtgatgataggctttttttcatatgtttgttggccgcataaatgtcttcttctgagaagtgtttgttcatatcccttgcccactttttgatggggttgtgttttttcttgtaaatttgtttaagttccttgtagattctggatattagacctttgcaagatggatagattgcaaaaattttctcccgttctatatgttgcttgttcactgtgatgatagtttcttttgctgtgtagcagctctttagtttaattagatcccatttgtcagtgttcgctttcgttgccattgcttttgatgtttcagtcatgaagtctttgcccatgcctatgtcctgaatgatattgcctaggttttcttctagggtttttatggtttaaggttttatgtttaagtctttaatccatcttgagttaatttatgtacaaggtgtaaggaaggggtccagtttctgttttctgcatatcgctacccagttttcccaccatcatctattaaacagggaatcctttccccattgcttgttttcgtcaggtttgtcaaaaatcagctggttgtagatgtgtggtgttatttctgaggcctctgttctgttccattggtctatatatctgttttggtaccattaccatactgttttggttactgtagccttgtagcatagtttgaagtcaggtagcattatgcctccagctttgttgtttttgcttaggattgtcttggctataggggctcttctttggttccatataaaatttaaagtagtttttttttttctagctctttgaagaaagtcaatgatagcttgatgggaaaagtattcagtctatgaattacttcaggcagtatggtcattttcataatattcatctctgggacacagctaaagcagtgttaagagggaaatttatagcactaaatgcccatatgagaaagcaggaaagatctaaaatcaacaccctaacatcacaattaaaagaactagagaagcaagagcaaacaaattcaaaagctagcaggagacaagaaataactaagatcagagcagaactgaaggagatagttaagaacgtatctcaaaataataagagctatttatgacaaacctatagccaatatcataccgaatgggcaaaagctggaagcattctccttgaaaaccagcacaggacaaagatgccctctttcaccacttctattcaatgtagtattggaagttctggccagggcaatcaggcaagagaaagaaataaagagtattcaaataggaagagagaaagtcaaattgtctctatttgcagatgacatgattgtatatttagaaaacctcattgtctcagcccaaaaactccttaagctgataaacaacttcagctaagtctcaggatacaaaatcaatgtgcaaaaatcgcaagcattcttatacaccaataatagacaagcagagagccaaatcatgagtgaactcccattcacaattgctacaaagagaatacatacctaggaatacaacttacaagggacatgaagggacctcttcaagaactacaaactactgctcaagggaataagagaggacacaaataaatggaaataatgtgactcttaaaaccttctttgaggcagtagtacttgtacttggattgtgtccaagtgtgcaactgggcagaggaaggtgggagtgcattctagtctagggaaataacatgatgaaagacacatggatttgagaatcgcccaatgtaaaatgaagcattgatgatagtgaagagtgggtgatagtatcggatggttaagaaagagatgggtacaggtatgacagcaaaccagactatcatagattttaaattccatgacagagttccatatcagagagccatttaaggtctgttagtaggcctgtgacctgtataaagagtaaaactactcctaaactgcaatttgatatgagattggaatactgcagagcaacatatactataaaatttacagatattttagttctgcataatggataatttttgcatggtaaattggaacaagaatagaatatgggtgtatgactgtcctgcaaagtcaaatgcctcttttatgtatatatgtagttttaggtaagaggctatgttttatgaagtttttttagaatgactgctaggatgattctgcatagaaggtaaacatagcaaaaaataaaacctctgtgcgtgtgtgtgtgtgtgtgtgtgtgtgtgtataggctagaattttcaataataatgacattttgagcacttactatatacctgaaataatgatgttaacacttttttttctgaaatttcccacaaaatcctacccgctcagtgttattatcatttcatagatgaagaaacagaactgaagaggccctataaacaagctcaagactgcaaagctgctaggtgatggtgcaaatattcaagcacgtttttgcattggtataaaggcatctttttctatggtgccacattaccttacacgctcatcgagttgagccccctgtgtctcagttcttccccagaggtctcagctggaatacgaatctaggcacttaatacacatttcatgtcactctactataatataaattgtgttactaacaccagtgtttaagctttttattttttcactacaaagaaggcataagtacaagcatgaaaaaaaaaatctattttcttaccctgttcgttgtttgacataaagtatctagatttttcttgatttccagtttaacagtttgtgtgcagtcacaatttctttgggtgatccccaccaatcagtatctctcgatctcatctttaacggtcatctcctaaatcagtgttttgtgaataaatttattcacctaacaactggtttgtattcttgaaattttcagtaatccctacagatatacagttctcctatttccacaactataatattgtgtaactctcctgggttccaagaaaattatagtatttttatttaagctataatagtttctagtcttgagatttgggaaaatatcaccgagtcaatcaccagaattattaattaacctacaaactaggaacagaggcttagtgggaaaaatatattacagagcccacacttgtggagaatacacaaaacacatctgagtgatcgatactcaacaaagaagtctgaacacgtttagattttaaatagtcaatctctgctgtatcttggaattagaaaaactgataaagactgacagtatgggaactgaccaagggaaagccagtttagaacaccaaatcctagaaaactactgggcaaaaaagtaagagaaaggggaaaaataacttagggagaatcaacaatttattattccatgaaaacctttcatccatgtatccatagtatgtatattacatatatctctgatagaacatgaatgttaggttcaaaacagtggccactcaattactttaaatatgacaattttttccaagatatactttcttttttatgtgttctttaattgtttaaatcccctattagtactagaccttattattttacagctatgcaaatatcaaaatacatttgcaaaaaaaattgtctagtaagatatgatgatgtctactttgcaaatatattttgatgataatttgatgaaattaactacatcaatttcaagattatgaaattaatgtagatataaacgtaattataaaaattaatatataagcatgattctacatgattatgaaaatgagtatgttttacattataaatgtgattatgatataaacaaaattagaaaaaatataaacatgattataaaaattaaaaactatgtgattttacagagaaaccccttgtagaataagaaagaaaatgcattcttaatagtttttgtactatttatattactagcataacttgtaccaatttttctacttttgaaaaagaactcaactaaaaaaaaccccagccaaaactttcatgttatgtgcatatgaattaatagtaatttaagatttattacagtgattacatatcaacagagataaatatgtgttttatgattaggttttttttttttttaaacaggtgagcaatagggacaaattcttgatgtagaaaataaaccatttcagtgcctgttgataaatagacagtatccactatttcttcatggtgcatggcaacgtgacaaataaattaccttcattaaagatttgcatgaaggattaatgagcattagttaagccataaaagcacaaaaaacatttttgaaaaattacattgaatataagaataagttgaggggcagacaatctcgttataataatttatcttgcctgaagattctctgctgcacctatgtgataaatgaagcccaaaagcaactcaagttccacatttaacatagaaaatttaggcagttcacaactctagagggttttgtcctctgtgactcacctacctataagggggacaatttataaaacacttatttgtttctgttagtattcagactgcaataaatcttcaaattttcaccataaaatctgcataacatgaaattaaaagaagttaagcatttttaaaaattcatagtgaaaaaatgttgagtgttttaaatacctgccttatgaattttcttttgcttttaattcatagagctaagttaaaatttaattattcgtgttatgtataaatgacaattatcctttggataaaaggtaatattttactaagtaaaacacaggaatataagaaaactttattttgctaaccgaggtcttaattttccttcatttggaatactgtccaagattaaacctttctacgcatcaaacactgtcatcttgtggactgccattgatttcagaaaatacaggctaatttaaaaattattatctgtgcgacttttcatggtaaaatatttggacaactctgtaaatcttaatgtaagtggagatgaggaatagtatccttgtttgtaactgtgcaataatgaagcttttacatttatgaacatctgtatttcaggtccccgtgctggtattttatagtaggtctctacccagcaggccacatccttactgtttgatatggttaagacttgcatggcattgtgaccatggtttaattacagtgtgacttaatggttaatagaaataatcaccagcctgcttttgttctggtctggtgagtgaaatctagacaccgctctaattagtcactatttcaaacatctaacttttatttgcaaaattacatcccatgcatataaacctcaatctagtaaacatttgaaaccactattcaccaggtttccttttctcttttcaaataaagatcgatgctttgtaataattcttaagttattggcaactctatgtcttagttttcccatttgtaaaataaggttacctattcctatgagaattaaatgaattaatatacatagagcacactgcctggcacattctaagtgtggtacacatttactagattgtattggtgctccatccagaccttcacccgatgcgtgcgcacatccagcagctgctatgaagattggctgcttcctcttctccagaaaatttgccacacctggaaaatcgtgcttcctgccctcattgcattccacctgccccagccagcagctaataacttatggatacaggggagagggtgcaaatagcctttgctgatactctttgccttcttttgcctcacttaccagtgctgcagtgaaagttgtgtttgagaaccccaagtgggatcaatcttaagctaatctccaacagggaccacatccctggttagctttatttttttctccctcatcttacctcgcttctcttagtttttcctcctggaaaaatgttgtcaaatcatatctgagagtcctcttcactgactctatttctataaacccaatgaaagacaataagtatctactcttgttgttgtcgttatgcccactggtgtcttgatttaatgaagggtaaatgctgagattacctttgtcatgtccaaagttgaacggagtccatggaacgactccacagcctttcagtagttctccatatatatctttttttaagctaacattttcacaaatttgataagcacattaaggtcatagtccctggcaagattctggggcacaaatagactgttgttggttaaggcagggatttgggggctttatcagtgaattatgggaaacctggagtgaatgctttttaatgcaaagtttggaacctaggttgagatcgttccgctgactcttgcacactgttgagtaaacactggccctagacctgctaagagcttacaattcaatacaacgtaaattaaaaaccccttagcaaagcaagaaatttaggccgccttttgaaaagggttagcaatgacctttatatctagacacagggctcctgggataaaaatgtcctccacactgtgaagtattccacagagaaaagaaaaatagttgctgtcacccagttggtataatcacttgaactctagaacttggaattcactagctcagacctgcttaagttgtggatcatgagatgacgccagtttagtactgttcttattatacatattattttatttatcttatgtttttctaaaggtgttttgaattaaatgtgcataaaatattttcctgtcttggtgacataattatgaagaactctgcttcttttgactttaggtaacaaacataatgaaaatacttgtctccaaagcataaaaaagagaaaattattactttgttttgttcaaccaagataactaaaatttaatgtaataatacagcctactttgttttaaagtaatttcatttttcaaacatatgacaagtattctcttttgcattcttcacaacatctttaaaaatatcttgattctgaggctgggcacagtggctcacgcctgtaatcccagcattttggaaggccgaggcgggtggatcacgaggtcaggagatcgagaccatcctggctaacacagtgaaaccccatctctactaaaaatacaaaaaaaaattagccaggtgtggtggtgggcgcctgtagtcccagctactcaggaggctgaggcaggagaatggcgtgaacctggtaggcggagcttgcaatgagccaagattgtgctactgcactccagcctgggtgacagagcgagactccgtctcaagtaaaaaaaataaagtaaaaaatcttgattctttctcttggtactaaccaagagtcagacagctttattctattgtaactttcaggatcttcgtctctggttgtgtttttatagatgaaacttttgacacttggaaattaaatccaattgtacgaggtacaagatgaatttatattctacaaaattgtgctttatgctagatagtttatcctgagccaatagctcccctattgagcagtttcttcatgttgaacactcatttaagtggcttgtgtaattctcagcattactaccacgtagacattattgtcccattttatggatagtgaaactaaagtttaggaaaattaaattacaataatgaaagaagattaatataatgataaaatataggcttagagtgagaagagaagttttaattttccctctgactctaatcagctgtaattttccactggttctttcacctatttgagcctcagacctttgatgttgaagatgattaaaataataataactatatttctgtagaactaattttacatgaaatattgcatttaaccttccctttcttccatcagttttagtttacagatgagaagattaatgcttgagcaaaattaaatagctttcctaaaggtcatgtagttagtaggtcatgcagccatctttgaatgcctggtctctgtgattttgaagtccatggtcttactcaaaatgctaatttctaatgtgtctgtgtgtaatagggaaagtggggcgcacagaccaagggaagaactaggtaaaaaaaaaaaaacatgaaaagtatgtgactcacggtaaactcttatgctaattttttcccagctctatctgatattttcataatatcctcaactgtgctttgcatatttcactactacttgttgatatcccagttgccttgatctcagttcccaccccaaatctaggagccaaaatgatttttctatatgatccattaaataacttgagctgccaatcagcttcttcaacagaatattaataagcatgctcaagcagaggcaaataattggtcatccatgaggctattaacctctgatagggattggactacctaaaatttaatatcccttatctctaatatttcatctaacttacctagtagaataaatcatgaagttatttgatagtacctttgtaaaaatgatctttttctcttttgctcattcacagtacattccagattgttaaaactgtctatattactataataaatagagactcagtgtctctatttagcccaacaacaagcatcctctctgactcatattctcaaagccagaacaagccaattttgatcttagaaaatttgtaatgaagtttaatatgtgaaaataaatccactcttgttcttaaaatttagggaggtttgtataaatagattatagatacatttctatctcaaatatgcatttattcaccaaatatttatggagcaactacacaccaagtatcttgttgagttttaaaggtatgatggtgaagaaggtagattcaatctctgctcttcggagagtaattgacatggctaatagtgactttttctgtttcaatcaaggtacacatcagcattgtaaaatatatttcccaccaatttcaggttgtccctcatgctcagtagtaatgaataattaagcggacaattctctacaatttctatcataatgtcactaattcagagatccaaagtggtaggattgggtacaaactttcaaaaaagaaaataattgtagtgaaaatttttaaaaccctatttttctccaggaacttactaagttatcctatttaagtgtcttcacttcaattaagtcatcatgaaagagaggagatgagtcataatggatgatggaattatgaaaataaatgtgattaaaagacaatttgtaaatattaaaatgctcctgacatatactctcctaagcagcatcagtaaaaattaatacaagcatatagaaaataaataaatgcaaaacttgaactatttaaaaaacaaactaaaagttatttattttttatttttttgatttggggtctaactctatcatccaggctggagcgcagtggcacagtcacagcttatggcaactttgaactcctggcctcaagctaccctctcacctcagcctcccaaagtgcggggattacaggcttgggctgctgtgcctggacaaaagttatattttcataataaagaacaaattataaatatgatttttggcaaatgaaacattaaatctcatattacagaaataacaaaaaaatagggattttggtaaataaggcctgttaactgagaatcttaccataaagttgagcattttataaaaatagagaagcttctgatttttaagtttttctttctgtacttacagggataaagaaaataggctccctgggacagtttcgttattaattgagtcattcaacaactcagatgctatatccattgtgttctctccaaattctttgacccaaagcctctgatgtgtacacacactattagaaagaagaatggttatttcccaacatgtagttatattaaagaatgttgaatcactgtgattactcattgaacttgttttcaaagacttcagagagtccagtatgcagtttcattccccattctcacactttttttttgttaatggcactgcagttaagagaaatgagcatcattgtccacatgtgtactcctgtttttgtatactctgtagatgtggaaatgcgtcacttaaataatcatctttttaggggagcaaagagaagatcttctgtttattgacactgaatcagttgcagcaattgcatagaaagtctgcaatatttgaatccctaaaatctggacattcaattagggcaggagacagctaacctggaaatgttctcactaccaaaatttagaaatgatgactgaaataaagcagcgaaaattccaatatgtagctgatctcacaagaaagaaaaggaaatcccgaagtatcagaaacaaataagaactaaaatccaaagtatactctctggtgttaaccctgaggagatcttggaagcaaggtacattttttatatgttacagaagtagaccctaaagtctaaaacctagaggatgaatgatcatgccaagggcaaaggacaagtccttgggcctgcctaagaatggaagttgaatagcagtgtctgcccaagtcagactccagatggaatgacctgctggttcagagtagaagacaaaaattccccaatgagaaaccaaaagcctatgcagcacatgtatttgtggcccaaatgcgtattaccacatagtatcaaaaatatgcgattgaaatttaacataaacattgatccttttgttgcaattgcttttggtgttttagtcatgacttcttttcccgtgcctatgtcctggatgatattgcctagattttcttctagggtttttatggctttaggtcttatgtttaagtctttaatccatcttgagttaatttttcataaggtgtaagcaaggggtccaggttcagctttctgcatttggctagccggttttcccaacaccattttgtatacctgtgtaacaaacctgcatgttctgcacatttatcccagaacttaaaggataataataaaaaaagaaagtaaactacatagaaaaatggggaaaaaaattgatcctaagtagggttcatgcaaaagcattctcgaggaagactttcataacgtagatgcacagtatatctcaaagtggtcattgtctgctgaaatagggactactcactgaagaatcagaccaagaacttctaaaacattttagttgctttagataaccatactgttaaaaaaaaaccttaaaaagtgggaaaatcatagttgaccaactaatctcaatatcttctgaaatgaatgctactactactaaatgtttaccaccgaataagatcggcatgcattcaattatttttaagggccaggtgcagtttgtatggaagaaagtggtgtatgaagctaaaggctgtggcaccacagctaaccatactatttccctgaaatattttatagttctcaggttacaatgtaatactaaaaataattatagatttatagtttttttatgattactttgaaggcaatattaaataaatgtgaatagataattgaaaaccttataggaggaagtaaacaggaatattaaaagatgtttagctcagtccaatattttcatttttggcactggcagaaaatccactgcaaactcaggttgtcagctcttctattgcgtactatttctactttttatacttcttggaattatgaaatgcttcactacatgaaactgaaaacttacttgaagaactaaataagcatttttgagtccccaaatacttacccatgtgtaatatctgagaaaataccaattttgtgtaaatgtttttctcctattctaaaaatacaaaacattaactcaacaaatatcatctgtgtaacagaaacagtatttttaaatttaatgaatgatgtcctgtaattgttagttgctttcttttctctgtaactttaatataaaccaaaagctaagaaaacccttattttatattagattttagtaaaataataaaaaaatttgattttagtaaattatctaaaataaatatatattaaaaaatatatgaattatgtgtgaatgacaagtaacacttccattatagcaattaaagggattcacattgttaaatgtgagaaagccttgaatttagagtctacttgagctgtataagaacaagttgaagtatttcaattatactttatggagttccttcattcctttgagtaaagtcatgtggatattttaaataaattattaataaaatattaaatgtactgaaggctgtcaactgggtgatggtaacagtaaaaaacacttttctttataaaacaattgttaaaatatttgaaagttttggattttgtatctgtatattgtaattatgcattaatgcaatacaacatttcaaaattctcaggcttctgctaaatatgtaatttcccctttttttttgagacagagtcttgctctgttgcccaggctggagtgcagcggcatgacctcggctcactgcaagctccgcctctcagttcaagccattctcctgcctcagcctcccaagtagctaggactactggtgcccaccaccaggcccggctaatttttttttttttaatttttagtagagacggggtttcaccatgttagccaggatagtctcgatctcctaacctcatgatccgcccgcctcggcctcctaaagtgccaggagtacgggcgttagcccccgtgtgcagcctatatcatttattttaataataaatattagcgaaatcttgcttagaatcaatgttcaactcgtcattgaaatttttctgtggaaaacagacctgaaaatatttaagtatccattattccttcagacttgttttatatcctctttactgtttttcttatatttaaatggtgcaggtagaaggagctcctaacataataatgtttagttaggctgggatgataacagaaatgttacttttcatattttatgaatgcatattattcattaagttcttaggtacgttgtcttggtggaagcttatgaagtacgtaatattctaattatatgaattttaaaaatgaacctcaaaaagttagttaaatactggctcagtttaaaccatcatactgtctctgaaagtcccaatgaacttaaacttaatttagaagttaaactaagttacaaaatgggatgtgtgtagagaacatttggacagaagacatgtagtttgcctttctttgataagtttaattgcttaagtgtccctgtctcacaccttctttacaataaggtctatatctgtatcttcttattctacattgtttcataggtttgggtaaattttcttcattaaattgatctttgagaatggaaaattgtctcttacctttctattttcagtgttatcatagttctgagtacctaaaacatgttcagtacacattggaattgaaagaataaataaacgagtcaaggtcagacatcgtaagaaatatttcagatctcaccgtagtcattaacaataatcctttgaatataaaatactaaattatatagatacatggatcaaatatgtatgaccttgcaatatatctaatgctttctaaaggctttgttgtttgagctttgtctgttaatgaaaaaatcaaagtctttcgttgaccaaattttgtgtattttcagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtaagttgcttggcccgttaaaatggtcagccaactctaatttggaaaataaagatgtattagtgtgtgttttttttttaagacctggaacttacaaataaaataaaaaggcatttgccatatttagacactacatttttaggccaggattttgcatgccttagaataaaagtttagacataagaaattgatgatccatggttgagaaatattcaccataatgctactctaatgccagaaagggagaaagaatctgataaaaagaaccataataaatactccacagttctttcctttgctcttcagtgcctctatataacatatgtgtatgaattgcaagcattttatgggttcacttttcattacatttttattttagctgccttcaaattgaatgctcaggttttaatacttcatggtatagttataattgtgattattacttttccaataataggagcagttggaactgtaacttttaggtgcaaatcaggcagaagtgatgattctataattatagtattgccatctatccaaagtatcttcaaatttaaacacctcatttgtatttatagacatgtacagttaagcattgcattaaagaattcaagtgctatattaccattgatatatgatgtgtagtttgctctgtcatgcagcaaaaaatctatgaaggcgttattaagaagcatgagaatcctggttgattgtgaaacttaaaaaataatctatttaagtgctgttttttcatatgcttggttttagaatatatgctgctggaatgtatgaccagagctatatcacaagatttttgcttactacttagtttatatagactttgttgtttgcgtgtgtgtgtgtgtgtgtatatatgtttatatgtatatatataaacatttaaatatgtgtatttatgtaaacaagtctatgaaacttcataaactgtgaagtatgtattatatatacatatatagatagagatacacagtattatataaaatatatataatagtaacaacaccatcaggtaaagggtaaaaatgtaatattcattttaaagagaagaaagccagtattaaagaaatgatgaaaattgctaaaggcctcacagttaggtaacggcatggagaaaccagtagaaaaaagaatgctgacttggaaaccaattcaggggctacaaaaactaatccgccaagaggcgataaatgactgaacaaaagcagtgatggtagcactggaggacaggaaacattaactgggatattaagaaggtaggattaccagcatttgataattaatgaattacaggctttggagtaggtggaggctagcatacacaaatatttcaaggctttagcagagttcattgaatgggcgatgattctcctcatcagaaaagaacacagctgaagaagtagagaagtagttaaaaatgaggaattcagttttgaatatgagatacagggtacatgggaaatccatgtgaaaattgggaataggtaatcagatacatattcctaatacccataagagagagctgggctactgaaagagatttaaaagtcatcattgtgtattacatcaccatagaataatgtgtatatattatgccaacttcaagattgtgtaagagtgtctatagatggaaaataaagaaatgcagttttacagtttatctaattaaaagctttgaattaattctctataagctatttctccaaaacttctgagcccctttctccctgatttcttaagacgttattgcattcttatctgaaaattataacttttttggctaacaattaattccattttcactatccatctgtataataatactttatatttgaatagtgcctgaggttgaggaggctcttccaccttcttttcacaccagagacctctttctacacattgccgatcacaagggagagtagcacatgtgtaagacagtgtccatgtgcaagagtgttttgcacttttggttcatggcccagatatatcacttatctttacgttctaccttccatgggcacacatttcatgaataatcattcgctgatatttaaatccctttgcctctgtgtcttctgttgcccttgtttggcaaaaccccaactccagtgaactcaattatactcttaccctgtgactgccttgagattctgaaagctacctgaaatgtttacacccaccaggggttcatgatcatcaatttcaagtgggctctcaacattgccattcaatcccaagtttctgtggacagcttaatttgctactctcccctaaatttttggaaacttctgtgctttccttagactggattgcctcacgaccaccacttcacaaaaactgtgtaccttatcaaatcatcttcctactaataaaatttaaatcttaactgcatctccatctgcattgttatctcccatcctatttcaatagagatagtatactgtccatcctcctgttacaaccaattcctccatcctgtactattgagaatcattccctccagcctttcagaaaattacactataagtcattgcttcttatataacagaattctaggtcactaaactaatactgttttggtcattatgttaattgaactgactgtagcagttgacgttgttgacacttttttcttttacaaacgtctatattttcaaaaagtcattatttgagaagtactatataaaaggctcaataaagcaagtataaatcaataaaacaaaactgttattttaaggttgacatttaacaaaaacaaaaaaaccaggtaggaagcatctgctaaatttctgttacatcgttcagtaacagtcttattttttaccagagaagctacaaaatttacatttgtttttttctgtaacttacctaaggctattgctttctcggcttttatttgtccattttttttttaaatccacattgaatgaatgtagtgacatagaaaaacaaaacaaaacaaaaacccacaaaatcctactcacctctccctgccactaaatctcacgctggagagccaaacttctaacttcccttttttgttgttgttgttccataaggttctcataaaatgctagaaaatatctgcacgtcttggttactcaagcttaaacaataactgtttattccttcatttgataagtgtgcataagtttcttccttccattttaatatgcatttttaagtttactgttgcttatcctttaaactttaataatatactgaaatttctactgctcttttaactcgagtctaattcatagctttttatgtcatgaaatgaggatcattttattcctcctttttccttcatctttcctaagctacttttatgttttttttcttctacttgtattttggcaattctgtgcagcaaatacaatcttatcttctatacttcttcttagactaactctataaactggaaaatcaataaatatctacagattattaatatataattatgacttaatatgatatttttccaggtttttaagccacttcctagacatgtatactatactggatgtgtttttcatactaactgaaactttgaattaaatataacctaaagaaaaataaggctaataacattaataagaatgcagtatagtttggatgtagtgtttcttaaagttctgctgtacaaaaacaattagtagtttggataacagtgttcagaaaggaacatgagtcactacagtgaaaatcgtaatgaaggcattggtgtggttaagaaatcacggggagagagtatgaaatgagaagagaagtgactgtaaggtcaagcctgaactaatctacattacattaggagggtaaataatgaaaatcccacaaaaaataatgaggagaaggtagagagataataagataataggaaaaacagtagaacaggccaggcaccgtggctcatgcctgtaatcctagcattttgggaggccgtggcgagcggatcacctgagatcaggagttcaagaccaacccaaccaacatggagaaaacctgtctctactgaaaaactgcaaaaattagccgggcatggtggtgcatgcctgtagtccccactacccgggaggctgagacaggagaatctctggaacccgggaggcggatgctgcagtgagccaagatcacgccactgcactccagcctgggccatagagtgagactccgtctcagaaaaaaaaaaaaaaaaaaacagtagaatatagtgtcaaggaagccaaggggaaataagggtttccataagaagtgggcatgtagttaaacatggtggactggatgcatgcatttgctacctgtcgcccttctcagatcctacaaaactaaatctatattattaatgagaatgctgaaggagaggaagagcatcaccaagtgagacatttccatatatttctgaaagaatgaggaaggattgagttaaagtattaaagaagtggagaaaactaaaacacagaataaagtgtaaggggtctaaagaaagggttgaggaccatatgcccaatggaagcttgaggacattctgaaatcaaagttagcactaagaagggatgtaagaaatgggattcaataaaggggattgaagacataacacactgaacaactatttcaataaaatgttgaacaccttttccttctctatcgctatatgcaaaaagtccaaagactcatctcttaataatatgaatgagctttccgtggaaagatgaagttttaaatgtcaacagtggcactctagtgcaaaactcttattctagcattcgtatgccagcagcctgagagccagctccctgtcctcacaccaaagcagagcctggtcatccacacaccccattcagtcatgacccccacacacctcagtagagaaccaattcttcagacacagcatcaggggaactcacaccaacttgcaaaattttcgatatatacgtagagagacatatagatagatatagttatatatacatatacacacacacatatatgcaattctaagttaatagttactgttgaaaattcttgtgcttatagagtgattacaaaattcatactaagataatatgaaaaaacttgaaacataaaattactctaaggaagacgtagattagaatggaattatttttattcaaaaactgtttttattataccttaagttttagagtacacgtgcacaacatgcaggttagttacatatgtatacatgtgccatgttggtgtgctgcacccattaactcgtcgtttaacattaggtatatctcctaatgctatccctccccctccccccaccccacaacaagccccggtgtgagatgtaccccgtcctgtgtccatgtgttctcattgttcaattcccacctatgagtgagaagatgcagtgtttggttttttgtccttgcgatagtttgctgagaatgatggtttccagcttcattcatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttggttatatacccagtaatgggatggctgggtcaaatggtatttctagttctagatccctgaggaatcgccacactgacttccacaatggttgaagtagtttacattcccaccaacagtgtaaaagtgttcctatttctccacatcatctgcagcacctgttgtttcctgactttttaatgatcgccattctaactggtgtgagatgatatctcattgtggttttgatttgcatttctctgatggccagtgatgatgagcattttttcatgtgttttttggctgtataaatgtcttcttttgagaagtgtctgttcatatccttcgcccactttttgatggggttgtttgtttatttcttgtaaatttgtttgagttcattgtagattctggatattagccctttgtcagatgagtagattgcaaaaattttctcccattctgtaggttgcctgttcaatctgatggtagtttcttttgctgtgcaggagctctttagtttaattagatcccatttgtcaattttggcttttgttgccattgcttttggtgttttagacatgaagtccttgcccatgcctgtgtcctgaatggtattgcctaggttttcttctagggtttttatggttttaggtctaacatgtaagtctttgctccatcttgaattattttttgtataaggtgtaaggaggggatccagtttcagctttctacatatggctagccagttttcccagcaccatttattaaatagggaatcctttccccatttctttttttgtcaggtttgtcaaagatcagatgattatagatatgcagcattatttctgagggctctgttctgttctgttggtctatatctctgttttgatactagtaccatgctgttttggttactgtaaccttgtggtatagtttgaggtcaggtagtgtgatgcctccagctttgttcttttggcttaggattgacttggcgatgcgggctcttttttggttccatatgaactttaaagtagttttttccaattctgtgaagaaagtaattagtagcttgatggggatggcattgaatctataaattaccttgggcaatatggccattttcacaatattgattcttcctacccatgagcatggaatgttcttccatttgtttgtatcctcttttgtttcattgagcagtggtttgtagttctccttgaagaggtccttcacatcccttgtaagttggattcctaagtattttattctctttgaagcaattgtgaatgggagttcactcatgatttggctctctgtttgtctgttattggtgtataagaatgcttctgatttttgcacactgattttgtatgccgagactttgctgaagttgcttatcagcttaaggagattttggggtgagacaatggggttttctagatatacaatcatgtcatctgcaaacagggacaatttgacaattcctcttttcctaattgaataccctttatttccttctcctgcctgattgccctggccagaacttccaacactatgttgaataggagtggtgagagagggcatccctgtcttgtgcccgttttcaaagggaatgcttccagtttttgcccattcagtatggtattggctgtgggtttgtcatagatagcttttattttgagatacgtcccatcaatacctaatttattgagagtttttagcatgaagattgttgaattttgtcaaaggcctttttctgcatctattgtgataatcatgtggtttttgccgttggttctgtttatatgctggattacatttattgatttgcgtatattgaaccagccttgcatcccagggatgaagcccacttgatagtggtggataagctttttgatgtgctgccggattcagtttgccagtattttattgaggatttttgcatcaatgttcatcagggattttggtctaaaattctcttttttttgttgtgtctctgccaggctttggtatcaggatgatgctggcctcataaaatgagttagggaggattccctctttttctattgattggaatagtttcagaaggcatggtaccagctccttcttgtacctctggtagaattcagctgtgaatccatctggtcctggacttttttttggttggtaagctattaattattgcctcaatttcagagcctgttattggtctattcagagattcaacttcttcctggtttagtcttgggagggtgtatgtgttgaggaatttatccatttcttctagattttctagtttatttgcgtagagatgtttacagtattctctgatggtagtttgtatttctgtgggatcggtggtgatatcccctttatcattttttattgcgtctatttgattcttctctgttttcttctttattagtcttgctagcggtctattaattttgttgatcttttcaaaaaaccagctcctggattcattgattttttgaacggttttttgtgtctttatttcctttaattctgctctgatcttagttatttcttgccttctgctagcttttgaatgtgtttgctcttgcttttctagttcttttaattgtgatgttagggtgccaattttagatgtttcctgctttctcttttggtcatttagtgctataaatttccctatacacactgctttgaatatgtcccagagattctggtatttgtgtctttgttctcgttggtttcaaagaacgtctttatttctgccttcatttcgttatgtacccagtagtcattcaggagcaggttgttcagtttccatgtagttgagcggttttgagtgaatttcttaatcctgagttctagtttgattgcactgtagtctgagagacagtttgttataatttctgttcttttgcatttgctgaggagtgctttacttccaactatgtggtcagttttggaacaggtgtggtgtggtgctgagaagaatgtatattttgttgatttggggtggagagttctgtagatgtctattaggtctgcttggtgcagagctgagttcaattcctggatatccttgttaactttctgtctcgttgatctgtctaatgttgacagtggggtgttaaagtctcccactattgtgtgggagtctaagtctctttctaggtctctaaggacttgctattcaaaaactttcacatcactatttgatctctcttcaaaaaatatgattgaaaagtacgttcataagaaggacactttcctgaatgttttcctaagtagatggcacatattaaacacttgttctgaaaataaaaatagaatatatattgcaccacggtcagctgaaattcctgctgggttttagaaacctctcaatgcagagataggcattacaatgaatgtttctgcaaatgtggcaaatgcctctgtaggggtttgaatataaaaattatctttaatctgctgtgaccatagagctggctaaaaaaaatcatttcaagaacattgtgtttttacacttctctgaaaaaatgtagacctttctaaaaataataagggacatatgcaaaggcagtatttttcctttcaagtagaaattgaattttacttaataactctctcttataaaatgtattatcttagctttggttcccctaaagcaaagctgggaacaaaaattgcttgtaggtagtttatttcaaatttatccccagagagcaggattaagagatgtgatggcattgataggtgaagccagaggagagatgcattacagagatgaccgcttctacaggcatcttgagcttgagcccacaggaccagagccttacaaaatgcactcagaatggtcaccttggagggtgtattgatggactttcatctcccattcccagagtgtaattctcttagcacttaactctcttgttctttgaggttgccctcaagttgcagctttgtgaaactggttgcacctacatgaacctggttgcagtagcatttgtaggagtaaaacatctggtcaagatatgttgaactagcacacaagaagtatctgaaacatagatggtagtgagcgtagatcattttcacagccctagcacacatttcttagagaaagtgactccttctaatacttacataaattcaaatatcctaatgttgaacaaaaaaagttgactttctgttatttattcagtttatatgttgcttccattttgcatttggtgacatatatatgaatatgtatctgtggtagggaggggctttagaggggcttgtggactagtgagaaagattattactgtacaaaatgctgtgatagattgatagatatatgttactttggtaacccctaatagaaacatccaacccagatgatacataagagaatgcttcctggaagaggtgatatctgagtttagttttgaagtaatttggtattaggtgactaaataaagagaggatatttgactatccatcaagtacaagtatagaatacacagactataataaaattgcacttcagtccagattaactaaaatgcaaggctatacgaaggaacagaatgtcataccatgaaatgctttgttgaccatattaccaaagcagtggtgaaggtttggaagatttgaagtgcgtagaaacacaatcattttcccttactgacatggtgaaaaattattctcatgcattcacaaatgtgtattgtctgcctattatgtatcaggtattttgttaggtacaggggatacaatggagggtgaagcaaacgtaactatccttgtgtagcttccaatccaatatgaggtaggatattcccataaaaactgacacagattctgtctgtaaccgcgcactctgggatttgcctgtccttgttcagcatcctgatgaggccaagctcactattattgcactaaaaacaagaccaactccaaaaggatttatgagtaatacagatgtttattaatgtcttggagggtaatgtatgaggcgcttgcgttccacaaaacagcagaatttattgaacactccccattaaccacatctaatttttccgagccgtaattcctcaacagctataatttcttcctcaaacacctgtgcctctccctgtaacagtgttgcttccagtctcccttcagggtcttactacctctgtcttacttggcaattttgtaccttcatttttccactcatttgagttcccagcacagttgttaattactttctaaaaacttatttttatttaatctacacttatgttttctgcatgggaagcactgttttaaaaatggtacaagtattaaagtaaaaatgatggaaaataaatgccaacaaatattaactaaaaagaagttgaggttgctatattaatatcctgtattaagcaaagatatagcaaagctgtacacatcttcgcaaaattcaccatgtacacaaccaggcttctcacctttctttcagtccatgtgggatctttccctacaagatctcactacttcctaaggcaacattttcccatccgtctctggagttagatagtgtagtagagagatttcaattagtaacttaagaaagtgagtggaaatagattgagaatgcgtgttgaaagattactgtttattaggaaattcatcagttgtcacagtgggggaaaaatgtagaaaggctacacatgtagataatctactatttggtggtggggagtctatgattttcatttttaattaatgaactacaggcaaactaatcagctgagaatgtatgtgtagataacatgtttattttaaggaaagaattgtgtcaacatggaaattctgaccatgattacctaattacattaggtaatttgtctgagacaaagcacagagagaatggatctcatgttgtcctctgtgatccctgagatttggtttggtactcaacaatggaatgtagcaaagccactgttatttcctgattagtctgtttatcataaaggaatatggtaattggaatagctttgggtacttttttttttttttttttttttttttttttgtatttcccttctaagtgctgctcctcgggtactgaatattctatcctaaatccaggagactttttctttctctaatcttggttcagaattttcaattatggatagttctaaggggactgggaaagttttgacaggaacactcctattgggatacatttatctctgctaaggaagctgaataatataaaaagtttgtatcaaactctgcaggaatatagaaaatttggcttttgttaatcttttatttatttttctatgtgtctctctggaaagcttataatcttgatataaaaatttaaattaaaacatcaaaaaaattttggacgatttttgaataagatgaatacttcatttgctcacatgtccttggcaatcagtcattccatacaatccaatttcttcctaagcatacttaaaaaacaacttgaatttctgtctataaagagaattttttatcagataaaacagtgtgcagcattttatgaactctctcaatttgtcttgaaaccttgggagaattacttaatacgtggtaacaaataacaagatgaatttgctaaatatatatctaacttagtctttttcttgatttcctatatgattgcctgtcattgtaattcagaaataaatttctgaaagacataaacttttgataactggcattgtaactatgaacacatctttcttcatgaaagaaaggaatgtgaactttgagttgacttttgcagtggtggcaaagatatattcacttacgtttatctaactttttttaatattcagatttcttgagaaactacttgacactcaattctgctgctgctatgcctcttcttccatttaataatctctaattgggcatggggcctcaccatacaactcacagaattttctctaaactagtcaggttacttttaatcaaaggtgtcagcattgtctcagccttcattattctgaccgctctgtagtccatgtacaaagctgcaaatattttcttttcatctttcctggcagtttgttctcccaaactctttcatttgtacctttcactgtctcttctcaatctacccccaaatcagtcattccatgtacttatccatttatatgtctgtccacccagtgtgtcttatttgcacttggcctttgttccatgaagaatttaaggaggcttatcttcttaaatgtaggtgttctttcaaaactccactcctcacccccatgatatttttaaatatttttttctttagtgaatacttctatctctgttttgaatttagaatatcccacaaactaacttctgcagctgacatttgtgctattaattacattacctttctcctagtcatcaaacataaacatttctgggtcaattagactcctaatctcatgatcacttatgccataggttctgcaagcactgtggattctacatctgcaatgtcattcttagccattcctttcttcccacttctaattccaacactcctttacctgacacccatatcagtggctttgaactccttctttctgtagctcacttaagatgaatagtattcctatccaaaacacactgtcaaaaacattgccatattctagattgtagcaaagaagtgaggccataagtataatatcataaaactaattgtaacgccacttattgaatgcaaattcacaagagtgacatgattacacaaatttaaactacaatctatttgcctaatttggtttaaaatacattggtcacaaacttgagtttaatttattatctacttaatcttagacaaccgactttacctgtttatgtctcaataatgaacatggggataatattggtacttatctgatagggttcctgtgaggatgaaatacatgaatacatccaaagcacttagaaaagtgcctgttatttaacaaactttagtaaaggttagctattaacacagtacttatcctataattcccacagcattttacttgtgcatgtgttgcgggggaggtgcgggggtattgcagtcagaaactacttttctagatgattggtaatattgtagtttttgtcattgctgttgttgtttattgtaaaaacgtaaactcccctgtcaagaattgagattttaatagagataaaggggatggatgggcggtaacattgggaggagctttatagtccattacttgccttcaatagtttttcactccaagccttcctcacagttttctgactccataatttttctttctgttctgtcttcatgaagtaccctcttaactcctagctctgtctccaagaatgcaaatgatttgccaaagatcatgaaattagttacttacaataaactggaataaagcctaccatataataagcatagtttagattttattctaaaagcttttccttatgcttgtccatattgaaattcatctgccactttcataataccacccacacagccttatgatatctccatgcaaatcgtatttaccagcttgacatttcactcactacccagtagagctcagtattacctgagatgttgagaattttattcaccctttctcatgttaagatactttacaagaccgggcatggtggttcacgcctgtaatcccagcactttgggaggccagggcaggtggatcatgaggtcaggagatcgtgaccatcctggccaacacggtgaaaccccatctctactaaaaatacaaaaattagctgggcgtggtggtgcgcgcctgtagtcacaactactggggaggctgaggcaggaaaatcgcttgaacccgagaggcggaggttgcagtgagctgagatcgtgccactgcactccagcctggtgacagagtgacactccgtcacacacattaaaaacaaaaaacaaacaaacaaaaaactctacaaaataatcaacaaatgccagccctaactcgatctctaaagactatgtcattttgccaacacatagcttcccgtatctaaggtatttcgctacccatgagaaaacattattctcccacagattgaaattatataaatcgaaattatggtcaaagaataatgttttgttatggctaaagtttataactcactaaagactaagataatcattagcattatttagcaataaacatttttaaattataatatttaattttaaaaaaatttatcaaaagattttaaaagtctgcataaattatatctagcaggccagcactcaataatgtgatccccaaacatttgtatcaggataattgacaatgcttaagaaaaaaaaacaaaaaaaacgggtgggagcggtggctcacgcctgtaatcccagcactttgggaggctgaggcaggtggatcatgaggtcaggagattgagaccatcctggctaacacggtgaaaacttatctctattaaaaaaaaaaaaaaaaaaaaaaaaaattagccgggcgtggtggcgggtgcctgtagtcccagctactcaggaggctgaggcaggagaatggcgtgaacccgggaggcggagcttgccgtgagccgagattgcgccactgcactccagcctgggcgacagggcgagactctgtttcaaaaaataagtaaataaataaataaaaataaaaaaatgtaaaaatattgggtcatacttcagatctgcccagagtttctggggcagtcctagaaagcagccttttttcactccagaattgtgtaaggtgaataaatcagcaagaagcactttgtttggaaatacaaggcgtgtccctgcgcctcaaccttaccaggatacaagagcagccctctcccagctgaaagtactaggaatagttaaatccacatgctctctctttctaaagttgagaagcacttccatttccactgagttgtcaggtcttcccagaaccacacccagctagcagactatgcaatgtctcttagagtgttcagtgaccttgaaaagcagagtccttcagaaaatttccgaagagaatgaaatcttgaacctactctttccctgggaggcctgaggagaaccagggttttcaaatgcaccatctggacatacctagagagggccatcttgtttgtggtatttcctcagagagaggattggaagaggattggaagaacgagaccagttatgatctgtatacaaattatcctcaccccatatatcttaggaatctgcattttccacagtactcccagatatttcacatatattcagtatattttaattgtgtgtacagtaaaatgtactgagtgtttccgtacatttccatggtgagaactaatcattacttgcgacatgtttttttaaaaagatacatatttctttatattttgaaatctcacttttatactagatagggttgcctaaaaaaaggtgaatgaaaggcgataacaaaatcgtgttggagggaatctcactaaaaatacagattcctggttctcccttagatattctgatgcagtcagtctgaagtggagaatgcaggtaattctgacaagcatcactaggaatttttatattcagtcagattatgaaacgtctgacattttatctcaattagtaactgtggctctctggggattttcaggtggtcgcagtatttctgcagttggtcacttgtcatgtatttaattcctagtttttgtgggcctttaaggtaattatagaaatttagattaaaatgtttatttgggaggggtattctcataattgagctgccataggtgatagttgttctttccactttgcttcgacagtctttcttttgttaataagagagcctattttcctatggttttcagttttccttatcatgccttgcattgccattcttaatatgctctacctgatttttctctgaatatccagtaaggtatttaaaaataaccttaaggcttcctgtgaatcattttaaatgatttccttccatttttttctctctgcactaattctcacgttttgtctcagttaatttgtctaaaattgagtaatgtatggtggatattttatttccattatcctgcaaggattctggatttattattttgtgatcatttttattatccagtattaaaaatcacgtacaggatattgaggattctaaaactacttctggaaagtaatttgtaatatttagaagtgtttcttccagagttcactccaatgagatattttgcacatttaccataaaataacaagacatttatttcttaacaaatgtactgagcctcatatattcaaatgagtgttgtgtcttcaaagtagacatactgagaggtaattcagttataccaatataatcctgccattattcaaaatattttaaaactcagtgattcatcttgctattttataacgctcatctttggagctgtagaggagagatagcaagctgcctaagtggaaggcttgataatgattaacattcttcctttgcaccagccactatgctaaaagcatttcatacattctttcatttagtcatcacagcaaaacagcattttgagcttatcttttttttctaggtaaagaacctgtgatttagacaggcagcaagtcctattgctcatgcttgtctgactgcaaagagtacacgcctaatctttatactttattgctcagttaacatcagttaagggacaggcacaaggtcatagttggtgagaggtctcgagctacagatctaactcacggtgattgttttatctactgtatcatcctgcctcccttaggatatcagtgctacattgggatattggattaatttcatcaatattaccagaaatcaaatttaaagggtgtggttagagatgatccttacagaagtaatcagtattagttcctgcccagtttcattggaataaatgtcatgaaggatattcttctcacttctgcaagaaggaaagaatccatcaaatttatgaaactaggaagactatatggagcaacccacataagtaaaattggggttatggtgatctgtcggaatgacagaattcatctatagggaatgtaaggttgcctgctacatagtgtgttaattatctgtcaaattatctatcaagagaatgcagagactaattttcttaataattagtagagtctacttaatattatagcatgcttttttctttaaatgtaggttttccttcacagtgtcagagtgttaaaaatattggttataaaggaaaaaaaatatgctgaatccagaattttaaagaatatttacatcatccacttgtttaataaataaatgaaagccaacataaatattttactgtcatcctaacatcatggtgatcaaataacttgtagtacaaattttacagatgggcaacttgcaaatgattcatatgtataaatagctgcccttccacaagtcggccattgccgcaggcccttctgattttgcctttgtttaaataaaagacatagcctcaagaagcttttagagaattggaaatttagaggcaaaggaggaaaagttttttttttacaaaaaacataagaacagttttggcgctttaaggtttaatgggagtccaccccttgcagcagcatgctctggatgtgagacatggagtcattggagattattttggagcttacgttttaatgactgcctggctcgttttcggacttgcatgaggcctgtagccccttggttttgaccaatttctcccttttggaaagggagcatttacccagtgcctgtacccatattgtgagctctaagcttagaaatggattttaaggtagttttggcaaaatgcggcagacccattgtattagcccattctcacactgctataaagaagtacctgagacagggtaatttataaagaaaagaggtttaattgactcacagatccacgtggctggggatgcctcaaaaaacttacagttatggcagaaggtgaaggaaaagtaaggcatatcttacgtggcagcaggagagagagatcgcgagttgggaaaagccacacctttgaaatatcagatctcatgagaactctaccacccccctgatccaatcacctcccactaggccctaccttcaacatatggggattacaatttgagatgagatttggatggggacacagagccaaaccatatcattctaccgcggcccctcccaaatctcatgtccttccacatttcaaaaccaatcttgctttcttaacccatcatgcttttcccaaagtcttaacttattccagcattactcaaaagtccaatccaaagtctcatctgagacaaggcacgtcctttccacctaggagcccgtgaaataaaaaaacaagttagttacttacaagttacaatgtgggtataggcactgggtaaatgctcccataccaaaagggagaaactggtcataaccaaggggctacaggccccatacaagtccataaaccatccagagagtcattaaatcttaaagctccaaaataatctccattgactccacgtctcacatccagggagtgctgatgcaaggggtggaggcccaaggcctttggcaactctgtccctttgtctctgcaggatacagccctcttggctgctttcacaggctggcattaagtacttgcagcttttctaagcacatggtgcaaactgttggtggatctagcattctggggtctggaggatgatgggcctcatctcaaagctccactgggcagcatcccagtggggactcttgagtggggcctccaaccctacatttcccctttgcattgcccagtagagatgttctatgaggtctccacccctgcgtcagacatctgcttggacttccaggcatttctaagcctcctctgaaatctaggcagaggttcacaaacctcagctgttgtattctgcagacctacaggctcaatgccacgtggaaaccaccaaggcttggggctttcactctctgaagcaatggcttgagctgtatcttagcccgttttagccatggctggagctggaacagctgggatgcagagtgccatgtcccgaggctgcacagtgcaactggccaccaggcatggcctgtgaaactatttttccttcttagccctgttatgggacaggctgctgcaaagacctctaacatgccctggaaacactttccacattgtcttggctattaacatatagctcctacttaagcaaatttctgcagctggcttgaagttcttcccagaaaatgggtttttcttttttatctcatggtcaggctacaaattttccaagcgtttattttctgctttccttttaaacataagcttgaatttcagaccatttctttgtaaactcatatgactggccacttttaaaaacagccaggtcacatcttgaaagctttgctgcatagaaatttcttccaccaggtattctaaataattgctctcaagttcatagttccacagatatctaggtcagaggcaaaataccaccagtctccttgctaaaatatagcatgagttacctttgcaccagttctcaataagttcctcaactctatctgagaaacctcagctttgactttattgtccatatcactatcagcattttggccaaaaccattcatcaagtctccaggaagttttaaactttctcacatcttcctgtcttcttttgagccctccaaactgttccaacatctgcccattactcagttccaaagtcacttccacgttttcaggtgtctttacagcaatatcttactcctggtagcaatttttatattagttcattttcacaccgctatgaagagctacctgagacttggtaatttataaataaaagaggtttaattgactgatggttctgcatggctgagaaggcctcaggaaacttacaatcatggcagaatgcagacagacaagaagcaaggcatgtcttacatggtggcaggggagagagagagtgaaggtggaaatgccacacctttaaaccatcaaatcttgttagaactctcatgagacagcactagggggatggtgctaaaccatgagaaaccaccaccatgatctagttacctctcatgaggccccgccttcaacatatggggattataattcaacataagatttaggtgggggcacagagcaaaaccttatcacacattgtcaaagatctcttgctccccatgacataacaaatacactagtcaggctaaaattccactaaattgttgtttaggtgaataagaattatgttattaaaaataaggttcaacaatgagaatttcagtgcagtaatttcactttactgtattttggttgaattacagtcatgtgctgcatagcaatgtttcagtcagtgatggaccacatatatgacagtggtctcatgacattataatggaactgagaattccagtcgcctagtgactttcagtgtaacctgtgtaggctaggctaatttgtgtgttgtgtctttatttttaacaaaagaattgcaaaagataataaaaattttaaagatagaaaaaagcttatagaataaagatctaaagaaagaaaacatttttacagctgtacaatatgtttgtcttttaagctgtgtcataatgaaagagtcaaaaagttaaaaataagtttataaagtaaaaatgttacagtaaactaaggttcatttattattaaagaacaaaatatatttgtgattaacttaatatatcttaagtgtgccgtgtttataaagtcaacagtaatgtacagtagtgtcctaggcttcacatccgctcaccactcactcactggctcacccagagcaacgtctggtcctgcaagtgctatttgtagtaaatgccctgtacaggtgtaccattgttatttatatcatattttatcataccttttttatgtttaggcacaaaaatacttaccattgtattacaattgtctacagtattcagtagagtaacatgctgtgcaggtttgcagcctaggaacaatagggtataccatatagccgaggtatgaagcaagctatatcatctaggtttttgtaagtgccctctgatgttttaacagcaacgaaattgcctaatgtcgcattaatcctcatcactaagtgacgcatgactgcttattttatgacatttaacattgtactgagacagcttcccaaagaggaaaggaagttggtttatatgggaagagaggtaggatagaattgtgatgatcatcatcagagggctttggcatcatttaaagaaatctatttgtgtttttctataaggtcaggcagagagcttttgaggtaggcttaattaggttgctatcccagttctgccccgctttaactatgtgacccactctctctaaactttagattcttgattcacgtaacactgtttctctctccttttgaaattgatgtaaagattagaataattataagtgtaaagaatctggcatgcacagatttttgtttcatttcgttttcttttttcttttggtgctggggattcaagaatggcatgccctttgactctcgaagaactcatgatctagtagaggagatagacaagttaatgatcctgtcaaaagaagtcatgccacaatgtgtgaagagtaaagaggtatcatatttcagaggtacaaataggacaggaactgaactccacagggcccttagaagcatttgcacagaggagttgacatttgagtacagtgctgatgaaagaaaaagagtttgtgaattgccccaattctgggctggcattgcagacagagggaaaaacatacaaaggcactggggaagaaaagtaaatgaagaagaagtagaacatccccaaaccaaaaaacaaacccaccttcatcttttatgtttttgtgtgaggcaggcttctatgaaggatacatgtatatggaggggaggtagtttactttttcttctcttctttaccataagatccttgctcctatgtcctagtacccaaaataactatgttagtggtatgaactgagttcttcatagtacaagctcatagttcataacttagttgttatgaactaagttgtattttgtgtgttaaatagcaacccaaccactatttacaatattctgtagaaaaatgtctttggatccaaagcactgatatactgcagaatacatggaatacaattcattcattattcatcattgtggagaagagcatggactctgaagccggacttcctgaattcaagtcctggctctggcatttaagagccatgtgactttaggtaacttttcaacttccatgagtcaaaccaattcaaagggttatgaggagtagagttgttatagctaaaggagttacaagggtacctaacacatagtaaaccccatataagtattgggtattattcatcattagtcttgtaacaatgattagtgcataacctgaaaggtaatgctagacctctagctgtcattttaggtattaatttctctctggaacttaagaaagtttttgaaaagatgactttaatgtaagggagaagtggattccagccaacaaaaatcaaattaccagctatttaaaaatccaattaccagctatattttaaaaatcataatacaactagaagcaacaagacttcatagattatatgtgaatgtataatgaaattgcttgcttcctcaaaccttgatgttactaaacttatttaagcctgtgaaaccagcaaatttgttgagctgagataggacaatttgtacctcaagcaaatagatttccaaagacttttcagggttagattcaatatttgtgtaaccggtgtattagcaatgaatacttactgtgggtacagccctgcttctgagatgcttctgaaagcatttgatcgcgcacaaacagaactaggacgatttgcaaaggagggtcccttccactataaatattctgattacttcttttttgaagaagaaaaagtacgtattttgcagtccattaaatagcagttcccagttgctgctgccttttaatatgaatatagtcaataatttatttgatggtaagattctttttgttttttatttcagcttaatacctgataatatgttcagcctaaaaggataataaggaaactgattaatttagtcctcttattatatattgccaagacaaaattgattcttttatgaaagtgaaaacaagtactttgtgatttcttcatcctcattaacaggcttaagatagaatttcattttatcaatgtcaaagagctaaaatacctttaatgattgaagtataaacagaaaagcaatatattaaagggttaatctattttaaaagtaactttttttcatatacacatgaatacaaccatatataatcaaaaattgataattcaatctacctgtattagttagggttttatagagagaaagagccaataggatatatatatatatatatatatatatacacacacacacacatatatgaaagagaattgattagggaaattgattcatgtgatgatggaagctgagaagtcccatggcaaaccatctgcaagctaaagaccctggaatgctcatagtgtggctcgatccaagtccaaaggcctcagaacccaggaagctgatggtgtaactcctggtctgagaccacaggcctgataacccagggggaccactggtgtaagccatggagtccgaaggccaggaggcctggagctctggtgtccaaaggcagtagaggagaagtgtatctcatttccaggaaatagacacatgcctttcctctgttattgttctgtctgagtcccaagccaattgaatggtgcctgcctacactgagggtggatctttcccacctagtccactcagattcacatgctagtttcatctggaaacaccctcacaaacacaccccaaaataatgctttaccacgtttcttggtattgcttaacgtatccagtcaagttgacacaattaaaattaaccatcacactctccaaatgatactgaaatctgaaagttcttatgaggaattggtgaaaatcctagaagttttgtgatgtcttcctggtcctgagtaattataaattctttaatgtatttgaggattggtcatcattctatgccataagtataatcaatgtttaaaactagctcttatcactatgcttgtagcagagtagaattatctatatgcaaataacttaccataatcagagcccatatcagccaaaactaagtgtgagatgaggctctagttaacaataaattatctcattagagaaacaaaattgcagtcatacaactttactaagtagataggaaaagtgtaaatagtaaatgcctaggagtttgtaggatggatccatcgatgtaattatatacagctaaacataattactgtggttatagaaaatattcttgaggaaaaggaatgttatctagccttgttaatggagaatacttgagtgcatatataagctgataacttcagtgaatgactaatgaacttcaaacgaatgactaaagctatttagaagatagtctgaacagagccggggctatggtagtcaagtggaaactaaggttgaagaattagcattggggcaggttttcaaagatttgcatacaaaaataaagagcttgaatttcatcataaggcaacagggaaccactgatgttacaagaaagaaaaataaatgataaaaatgctattttagaaagataaatatgaagtcaaagtatagaatggattggggtaaaaagacagctggcaggaggctgaatacaccatgataaaggcaaaggtagtgaaggttttaattagaattatgtctgtggaaagaaaaaagaagcaacacagagaagaaatactgaaaagaatacaggtattatgaaatcacagtttgctcttgaaacagactcaaacttaaaactaaggaaaatctgttctgatcagaaaagatccaagacaggtcaaatttatttattttttatgtatttgtgtatttttttgagatggagtctggctctgtcacccaggctggagtgcagtggggcgatcttggctcactgcaagttcatcctcccgggttcacgccattctcctgcctctgcctcccgagtaggtgggactataggtgcctgccaccacgcccagttaatttttttgtatttttagtagatacggggtttcaccgtattagccaggatggtctcgatctcctgacctcatgatccgcccacctcggcctcccaaagtgctgggattgcaggcatgaaaattttaatagagaaatgaagtcacatagtcaatgagagaaacctgtggaccatggagggcccaaagagtaacaggtagccagatagaagttaataaatccatgatcagtcacatcaggtgcaaagaataaacttcatttcttcactgctggaaactacagtgcagtgaaagagatagacaagtaaacaacattaaaatgcaatgagacatgtactaagataatgatttgaactttgtactgtgaaaacaaagaatagagtgaatataattattctaaagatggagagatgaatttgagtatggttttaaaagctgaattatagtttattaaacagagataaggtttaaaaattacagggaaaggcaaaaatatgtggctgtaaagtgtcatggttagtttatggagtggagaaaagtgttgtgtagctaaggtgtgagatttgtgaggagaggtatcagtaagtataggactgacaagagaagtaaaatccaaatttggatgggctcgaatgcaatactaggggattcaaattttgccttaaaacattattgagtagacagagtcctttaattagtattgaaaaggtttgttatttttgttgtttgctgtccctttttgcttgcttacttgctttcagcacaaaaactctagtagtagtaggaggagaacagatgaacagattaaagggttgatctagagccctgaaaggacttttggagaaagacattgattgacaatatgctaccatttcattctgttgagtaatgaaagccaaatagatatgattttggaaaagcagttttattatgatgagtgggtagggttaagaagaatacagttgtacaataagatgtgtttgcatatattggcctgggggttcaaaggataaattaggaaggcatcagaaacaaagaaaaactaaagggaaatttgcagtagagtgggttagataggagcattcagatttgatgatgatggttttgaccagtaagataatttaaataactgtatcataaggcagaacatgattggtatcataagaaataaacaattatgggcagctgggcatagtggcgacacctgttaccccagcactttgggaggctgaggcaggcagatcacttgaggtcaggagtttgagaccagcccggccaacatgatgaaaccccatttctactaaaaatacacacaaaaaattttttagctgggcatggtggtacatgcctgtagtcccagctacttggaagtctgagtcgagagaatcgcttgaaccaaggaggtggaggctgcagtgagccaagattgtgccacagcactcccacctgggtgtcagctagactccatcacaaaaaaagagagaaagaaaagaatgggaaagagagaaagggaagggagaagaggaagggagaaaagaaaatgagaaaaggaaaaggaaaggaaaggaagaaaagaaagaaaagaaaaaagaaaagaaagagaaaccacgatggggaatctgcagtaaggcacaagatttcttgcgggaggaattagagaaggttgttttctgttgtggtgatggtgatgatttttttgtttttgtttttgttttcattttggtggggttttgaggggtgggggttggcttctggtttttaatgaaggccctatttttgtgttccttttaaatgtttttataagatacaatttgaagtgaaacataaactgaattttagtatgcatatgatcttattgagatatttttagacaaggaccaatagcatgtatacaggctcataatacatttagaatacagcatatttggaaaatagcaagcactcctattacatggaatgttgcatgcataaatgggaagaatttgaggcaaaatatggaaagataacttaggactagaacattggagctgatgcagaatatttcatgaccgctttgtcagacttgcaacaggggcgccccgtttactcggcccactgtgctcaaccccttacagaagggagcatgtgagtaagtgagtgtggaatccttccagccactgctccaggtgctggcaggagcgagctccatttactatcctgcggcagtgcccaggtgagggtgcctgcaacggtgaagctcaagaaggggtgttacaatgacttcttcgctccactacccatagagtgcagtgtattatcagcttacttagccccttgcctcatcacatgggatggcttccctctgctggcaagggcaaagggtcagtgtgatggccatttttgggtccctgtactcggtggttcctgagctcttgtccagcatccaagaagaataaggtcacacagacacttgaaggatggcaaaagtggataattttatttagcaatggaaatggttctcagcagacaggggagcaggagaggggacaggacaggcaggcagtctccccacaaagtccagctggatcttccctgaagtcaagttgtctctgctctgaagtccagctgtctctctgaagtcaagtcacctctctatcctctactgactgtgtctggggtctttataggcacaggatgatgggtagggtgggctataggtagttttggaaaaggcaacattcagttggtaagaaggcgtttttcagaaagaaccaattgggaaagagagggcagacaggaatagaagttttcactttgggccatgggtttcaggcttttcagcttgaaggtggagtttcaccagggacctatccctgtctgcctcctgcctctatcaaagccttcaagtggaagactaaaacatttagacattagtgagtaaagcattcatgacatccttttttagccattgtaatcatccgtcttttaataacccctcatcttcctggcacggtcttcctcatttattttattcagtcaatgtcttggtgataaccatatatacatcaatgatccatccaatattatgacttctcagtttctttacctccaagcttcccatgaacttgtactccatcccatcttagccaccctttcctgtggtaatagcctgaatcttgtgattatcaattattctaccttcatcacaatctcaatttcaagtaagccattttctgctgaaagcctcttttccattcaaataattatgtttactacttccacttaaacaatcatttggccccttcagacctctcattccttttatcagttcaccacttcactgtccatcataccctcacatcctcaagtgccttccctttctaggtgagattacatagtcacttattgtaaactttctcctctgtcagctctcaactctctatcccatcaatctcttgatcatgtaatactcacttggcaaacctcttacctcaacctcagcctatgccccattcatttcatgattatatccatatagctgagtatagatagaaaaaaatacataattttgaacaccgattttgccttaactttatattcttatttacctttcagtgacaaatataaggtcttccctatgtctttatctgtatgactgctacaccactaattacaaataataaactgttcttgacagttttgtgccctagactccatctcttcttacctacatcaagaagttgtcatctgcaattatttaccctctcttgcaaacatcacatttccctccatcctgaatcattctcatcagtaaacatgctagaatatttattatactgaaattaaccattttatgatttcatagctccctccaacttccatcctttttttctctgctctccttgatagcaagacttcgtccaagagttgtttaaacccatctcaaatttctattttatgttttcttatacctaatcctatgaagctttaataaccaccattattgcaaatgtcaccaaggatcttcacattgccaaagctaatgggatagatgaaagggaatccaaaataaagtaatggcaattagaataaaaataagggaatgaaaaagagagatgtaataggaatcaaattgacagaacttgataattgactgattgcggagaaatggagagaacatcagcttattcattcacaaaatgtgttttattttttaaaatatcccaataatttaaaacaaaatatagattttttcataattccagattagaaaattattttaagtatcccacaaaacaaaaaagaacacaaacattgaaatacaaaaaatgaaatattccctagctcctatgccacctgtcacccacatatatagttgataacaagtagattcactaattgtcatcaaatattcttgaccattaactttgtaccagggactgtgtgaggatccaaagggaacaaaatgatgtggttcctgtcctggtttagtttacagctaaaagtgaaaacagatatggaacaaatgggtagaaatgccattagattgaataattgattgagtctgattggttttaccaaaaaaagaaaagaaaaataatgaacaatgctatttctctttatatatatacacacacagtattcatatatacataatatatgcacatatatattttatatatatttctttctccatatgtgtatatatttacattatatatacttgcattatgtatttatgaatatatatatatatatatacacatacacacacacacatacatatatgcacagagagagaggaaagagattaacttggtgagagaagtggggtggtagagaggaaagactttactgaaaaagtaatatttaaagtagaacttaattgactacaaaattgggaatgggtaaataaattcttccttgcaaacaatatgaatgtttcctggggagcagaataaaatattgaggaaaagtggcttcagacttaataaagtcctagcatttgaactccttgccttttatttaatagctcactgatttggagggggttacataatttttaaaatagttttctattatttaaaatagggactatcgtatctaccttactgtgttttgtaagttttaaatgacagtttacttatatacatttcacaaagcaccaggcttgtagcagatgttcagttaatgtttattcccatccactttacatctagagtctttaatgcacaaaaatccctgtgatgaagctatgataatcagcattccccctctgaaaacatttctcctttgaaccatatcatacacagaggctttgaaatccacaagagtttgtaaaatgaaatatgttgtgaattgtctacagagcaaatcaggagctgccacatcttgtatctcaaatatgagtggtaacagcaggaatgctggcattctccacaagaagactacagtgagaaaacaatctgtgcagattaaagtgtgaaaataaactattaacaatggtttaaaacaactcatttgtcacgttttttgcccagagttatgcaaccaggcagctgatcaactgtgctggcagaactaattcctccaggatattttaggtccctttatttcttggtaattactgtgtagattggtagccagctatgagtaagaaactctttggagggaacattccttctgaagaatgataaaactttacaaataaaaagtaatgtgagtgagtgttcttgatagttgcaaggaagaggagctcactcaagtgaacctaagtaaggaactttctattttcaggagaaacatgacatgataagagaaatggtatagagaaatccaagattaaggtctgtaatacagcttgattttgtggggactaagacaggaagggaccgagtccaaatcgttctaagaatgttagcagcaggagttcatgactattctctttatgaattccccaccagtgtggctgagctattacatgtagcttttccactcttcaattgtcttagccttatcctccactttgaaaatattctccctaccttccagatggggtgtgtgtgtgtttgtgtgtgtgtgtgtgtgtgtgtgtgtaaaaacaacttcctcataacttaggtttgccttaagtcaccttaatattatttgtgcctcactgcctcctttcagttttttgtttgtttgtttgtttttgcagaaaggactgtggataaggtgatttatgattaatttgtctaatacattgagtaaagtccaccatatctgtgagacatatttctttgttttatcatggaaaacttaatctgctagacttaaatgttagagtgaactgtatagaaatcacaatttctagttaaatcacaattgaaaagagccaactctgattggggtgcaagagtcccatagaagtattcagagatcttcaaataatttaattgctgaatatttaattgttgaattgtgtcatttggaattgctatatttttattttgatttaatttcctttttagtcagtagagccattcttccatcattactgggcccactttgctttcaaagaagtgttattggctgttggaagcagaatcctaatttgttgaatatttgatttgtcattctaaaccatattcacacacgtcttggtggcaggtcataaaaatcaaagtaccaactttttttttctttttctaattattcaaaaggctccaattcttacacaaatagatagacacatacacacacacttcaccaagtcaaattaaccttaaattgtaaaaaaccacccaaaagcattttaaattatgaacttattgtaaaatatttgtttctgattacatgcatgtaattacagagaattttctatcattttatgcgtggaaatttatgaaaataataaacatctacttttctttaaaaaaaacttcatctcacttaaagtaaatatttaaccctttgttataaaattttaaaagtttgctctatctttttttgtgtgtgagagaactgagtctcattccactgccaaggctggagtacagtggcacgatctgggctcactgcaacctccgcctcctgggttcaagcaattctcctgcctcagcctcccgagtagctgggactacaggtgcatgccaccatgcacagctacttttttgtatttttagtagagacggggtttcaccgtgttagccaagatggtctcagtctcctgacctcatgatatgcccgcctcagcctcccaaagtcctggggttacaggcgtgagccactgcacctggtctctaacatatttcttaatgccagagaaaactttcatgtttggtaaatatatatagttgctttcttcaggccttacatttctaagatctatttctaagttattgatgcacatggaaggagccctcaaatgatggtggaaagacatgaatatatttctctaaatcatagtggcaagaacaggataagaaaataagtcttaaaatttagtaatcagaagaaagtgattatagtgtaagccagccccttgatcaatttattcctgatgcttggaaagggaaaataaatttattggcttcccttatttttagaatgtatttattggctattttccaaaaaaaaatatttttagaataaatttattggcttcccttatttttagaatatatatatatacacacacacacacacacacacacacacatacatactagtgatgaaaaacattttctcctaatgataaaactctctaggttttttcaatcatcctacataaataatactcataatggtgcatttatttgttggtaacataagccatttatgtcagaacattcttcagtcctttatttacatagcaatcactcaccttaagaaactatgattcaggatgatatacactttttgaggtgagaaaaaactttgtacttctcagtggttctttaaggaattgaaaataaggcatctggacatgtttctaaatgattagaatttccaaatactataacatatttatttgaatacagttacctacaaagatatatgttgataaataatatataatctaacgtactactagatttctaaaccctcaagaacatcagctctctcattatgtatgagacaactggaacccagagaaattctgattgcttcagtgttgcaacagagctagggctggaggagggaattgtgtcacttaactatgcatcacaggtagatatttaatatgccctgaaaggataagtacaatgacatatctcacacatagcacaatatcttttgccctgtctagtgttatgaatgtgacagaatccagataggttatgagctagaacctgatattgtgtcaccattggttatgcttggcacaatgacgtaacagtcaaaactcttctggttacaggccaggcgtggtggctcacgcctgtaatcccagcactttgggaggccaaggcaggtggatcacaaggccaggagatcgagaccatcctgactaacacggtgaaaccccgtctctactaaaagtacaaaaaattagccaggcgtggtggtgggtccctgtagttccagctactcgggaggctgaggcaggagaatggcctgaacccgggaggcagagcttgcagtgagccgagattgcaccactgcactccagcctgggcaacagagtgagactctgtctcaaaacaaacaaacaaacaaacaaacaaaagacaaaaaaataactcttctggttgcaactgagaaacccaacttgaaataaccaaaatagggaattcatttaatttcatgagagaatggcaagatgctaaatcccagatagagctgacatgcaaccaacactgttttttcatctctcctctatctgtattgacttaattctgtcttaattggctgcctttcaatagcaaactacttccctccatgtagtggaagctccagtgactgtcagacatgcaggtttgtttgtttgtttgtttgtttccactcaaatactcaagcaagtattgagactcagacttcctggtctctgattgaaaagtttcaacctcagctgcccattcatgaatcactgtgaacaggacaaaggggtaatcaaactggccaaggttgggtcaggtgtccataccaagttaataaccacagccaggaagataaaacctattcaggaatacagtggctcctattcaactcacatcgtcattgaatatagaagaaacatgtctcaaacgaagcaatgaaaaaatagttgctattttttagaagacaagaaacagatatgaagtatggttggcaaagatgttgaaggcaaaaatgacaatacccattatttagacatacgaaaatgatcagctaaacctttccaactcattagtccagccaaattctcaaggtttactggacaggagttcttaactccagcaatgattattactaaaagtgtcagacagaatggccatttgaaatatgcaacaacaggtatttcatagacattggcctatcagaacaagaccttcagccaatgaggaaaaacactcagctctgctgggagtaccagcacatacaggttgaatataatttgccttaatgttagggcaagttgccactgaatactgtatgtttgacagcatgactctctgcatgccgtttttcagacattttagtcagttatactctaatcctcagaaggacaagtcacatgagaaaaatcagagtaaagaaaggtccattcttgaatttttttaatgttcataaaatctgctaaggaaactatcaaaatatgaagttcatagccctaccttcaaaaaatattcatcatcaggcttagagttgaactctgttgcctgaaattttaataagttgtccaggtttttctggtgttttggctctctgttctgtaaggtgcttggagaaacactgctctaaattacgtgccacttagggaaaagtatcctagctcttcaaaagtaattggaataaataagaaaatcaacaaccataaagacaaagaaggagagtaatgtgctttcagctggaaggcttctgtttatgagaaattagggtaatttaaggtcatcttctaatggcacgtaattctaaactagggcagccacataagccaggatagacaggtctggggaaagaaacggagacacacattgagtgtttcttgagctatatattcagctccatactaggggcaatcaaaagatcaaagagctaccttgactgaagagacaagcctgatattttgatctttgactgtgtgtcttatgggactgtctcccttccctttcagcatcaaactctgcctaacaaaaggaatttgaagctaaactgcacaagatttgagatactaaaacttgcaactgaaataaaccatgtagccaagtcagacagtcagtgattaatgtagtacatatagtatgcctggactattatactctgtgattgaagtttctcaacacagtgatctcaagaaaatagctctgcacataaggtccgaaaatccctaattttgcaacacttttatcagcaactttcagtaggaccttgggccagttacttgacctctttgactctcagttacctcatttctaaaagaagaagggtaaattatatcagctaaggcagtgggtggttcccaaccattttggcaccagggatcaacttcatggaggacaattttttcacagacacagagggatggtttcaggatgaaacttttccacctcagaccatcaggctttagattctcataaggattatgcagcctagctcccttgcatgcacagttcacaacagggtgcaaactcctgtgagaatctaatgctgccactgatctgacaagaggtggaagtcaggcagtaatgctcacttaccggcctctcacttcctgctgtgcagcctggttcctaacaggccacagaccactgcaggtctgtggcctggaggggtggggaaccctgagctaggctcaactttagctgtaacacaataatcccatgaaatgtaaagcaaaacgtaaccactgaatattatcatttgttaaatggcaagatgtctaaaaagctttctaatatgtccttatatcatcactcttagtgtgatgagaaaattttaaaaaccagttataatttcttgcagtatagcccaaattaggtaaaataatttgaagcctcttattcaactctttttgttttatttttaatatatagttcagatattagcaacctcttggggccagaagtgaggcttaagaatgcctttggccataatggaaattatttgaggaactccagaaggctgtatctgggcaaaattaccccccaaatactatcagaagtacccatcctttgggtcatttttaacgacaatggcaacaaaagaatgtcttctttgcaatttataaatgtaatctggaagagaagagagactatatggatctgatctgactcatatcagtcaatagtgtcattaactctttggtattattcacaggcagatgtagattctgaagagcctaaaatgtcgtacaaccttggtaccttacttaataaaaagaatactaaagaattaatataaaagtgggttctacaaatagtattatacttagaaagagaaaaaaatcaaaatgaattaccgtagctttggaggttgaagtccctttctcctaagatctctttagacaatttactagaaataattatatagaaatattttccaaatttgaccttccactccaacaccctatgacactgagtaaatgccagcactcacagggactcatgcatataagaggcttaggtttaataagcatcatgataaatcaggtgttattgtgtcatcagattaacaggtagaaaagtaacaacaataccaaatcaattttaagaataggcagggaaatcggaaattaagtttgaggactgcttcacaagagcattcataggtagcttctaaacaggatgcctggagtcttcctatggggcttacaagtaagagagcattaaagataaacttcacatcattagaaacattcggctgagtttataggtatcaccagcagaccacatcctgctattcaagtagctagtagagacaccatggggaaaaatgctgacatgaagaggaagtaaaagaaaggaacctggcaggtatagtatggaggggcatggggaaatatttaagaagaagcagatgaagcaaacattattgataaagagagaagaagtcgttaaacatttgtttttggtgacataatagtgctaaccactcagttcacttgctatttatcaggctcttgatgtgcagcaaattttagactggaaagtaattgagggagttagccttttagagtaggacattatattggtgataattcccttctatgtcctcagtaaactgattagaaaaatgaaacccagagttttctgatctgtcagagatggtacagactagacattcagtgaagccaggtctagaagccaaatctttgtgataaaaactttagtgacatttttttctcctttgccaaaaaattaaaaaaaaaaacaataaataccacaaagagcaaagataacctttctgtcttatgtgagattaaacattttccatctaaacttatccatatgctttcttcaaaacttatttcaaaacctacataacaaataaatagataaatattaaacacataaaatggttttctcgccaaaggtagccctttttttccctttgcatgtccagtgtatatgaccttcatatcttaaagaatttatcttactctatttggatttcttcttctttcctctcattccacatacatatgcaaaataattgtacagagaactacatatgcacaaagatgcatccatgctcatatggccacaaacatagacacccccaaacacatgcacagtctcctcagagaagcatctgtgccaaatcatggctgttttctatgtggtattttacacatagggggcttctaaaaattaattttaggagaaaatttgctccaaggctatctgatggcactagcaccaaaatccaccaggcctcagctattgcattgttttctaataggtgaaagacctatccagtctcactgcttcatctaccacctctaaatgactgtaggtgttctcccctgtctagaactcatcctgagcgtcattctctcatttttactgtgtggtcagatactttcttctgaatatcttgtaggtacttcaaactcattacctccaaattgaagctcatcagcatttctactttaaccgtgtccttttttcttttactgacattgccaaattccccaagctgcaaattatagtgttattattgacactgcccatgcccttattcctgtacctcattgtctgccgagttttgccaattcagttattaattggtttttcccatctagtgccttttgtctgtttttattactattattacagctcaggtctttatcttgtattactgaagtaatgtcattgatttatttgtctctgctccagtttcactatatacatctcagcataatgcagcttccctattcaaaaccactgtagctccaaaacagattaaagtctaaatgttttactctgataatcaatgctctctatttttcagattccatctgttttttcattccatccatatatttccagatttatctaatatcacttcccttcacatatccagatgtcagaaaaattgatattcctatttctggtcacttcccatctctttatcatttttttatagctccatttactctctcctatcttttttccacttatccaaaccctcattattcttatgatctcctcaaatatgcatgtattagtctgttttcacactgataaagaatacttgagactgggtaacttataaagaaaacagacttaattgactcacagtttcacatggctgggaaggcctcaggaaacttacaatcatggcagaaggtgaaagggaggcaaggtacatcttacatggcagcaggagagagagagggagcatggaaaactgccactttaaaagtctcagatttcatgagaactccctcactatcatgaggacagcatgggggaaactgcccccatgattcagtcatcttccaccaggtccctcctttggcatgtggggattaccatttcagatgagattttggtggggacacagagccaaaccatatcattctaccccgacccctcccaaatctcacattctttgcacatttcaaaactaatcataccttgactcattttagcattaatccaaaactccaagtccagtttatcatttttgattgcgtctatttgattcttctctctttttttctttattagtcttgctagcggtctatcaattttgttgatcctttcaaaaaaccagctcctggattcattaactttttgaagggtttttttggtctctatttccttcagtcctgctctgattttagttatatcttgccttctgctagcttttgaatgtgtttgctcttgcttttctagttattttaattgtgatgttagggtgtcaattttggatcaactaccatcagagaatactacaaacacctctatgcaaataaactagaaaatctagaagaaatggataaattcctcgacacatacactctcccaagactaaaccaggaagaagttgaatctctgaatagaccaacaacaggagctgcaattgtggcaataatcaatagcttgccaaccaaaaagagcccaggacgagatggattcacagccgaattctaccagaggtacaaggaggaactggtaccatttcttctgaaattattccaatcaatagaaaaagagggaatcctccctaactcactttatgaggccagcatcatcctgagaccaaagccgggcagagacacaaccaacaaagacaattttagaccaatatccttgatgaacattgatgcaaaaatcctcaataaaatactggcaaaccgaatccagcagcacatcaaaaagcttatccaccatgatcaagtgggcttcatccctgggatgcaaggctgattcaatatacgcatatcaataaatgtaatccagcatataaacagaaccaaagacaaaaaccacatgattatctcaatagatacagaaaaggcctttgacaaaattcaacaatcttcatgctaaaaactctcaataaattagggattgatgggacgtatctcaaaatgataagagctatctatgacaaacccacagccaatatcatactgaatgggcaaaaactggaagcattcccattgaaaacgggcacaagacagggatgccctctctcaccactcctattcaacagagtgttggaagttctgggcagggcaatcaggcaggagaagggaataaagggtcttcaattaggaaaagaggaagtcaaattgtccctgtttgcagacgacatgattgcacatccagaaaaccccatcatctcagcccaaaacctcctcaagctgataagcaacttcagcaaagtctcaggatacaaaatcaatgtacaaaaatcacaagcattcttctacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccttgctcatgggtaggaagaatcaatatcgtgaaaatggccatactgcccaaggtaatttacagattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcacgctacctgacttcaaaatatactacaaggctacagtaaccaaaatagcctggtactggtaccaaaacagagatatagaccaatggaacagaacagagccctcagaaataatgccgcatatctacagctatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggaataaatacttaaacgttagacctaaaaccataaaaaccctagaagaaaacctaggcaataccattcaggacacaggcatgggcaaggacttcatgtctaaaacaccaaaagcaatggcaacaaaagccaaaattgacaaatgggatctaattaaactaaagagcttctgcacagcaaaagaaactaccatcagagtgaacaggcaaccaataaaatgggagaaaattttcacaacctactcatctgacaaagggctaatatccagaatctacaatgaactccaacaaatttacaagaaaaaaacaaagaaccccatcaaaaagtgggcgaaggacatgaacagacacttctcaaaagaagacatttatgcagccaaaggacacatgcaaaaatgctcatcatcactggccatcagagaaatgcaaatcaaaaccacaatgagataccatctcacaccagttagaatggcgatcattaaaaagtcaggaaacaacaggtgctggagaggatgtggagaaacaggaacacttttacactcttagtgggactgtaaactagttcaaccattgtggaagtcagtgtggcgattcctcagggatccagaactagaaataccatttgacccagccatcccattactgggtatatacccaaaggactataaatcatgctgctgtaaagacacatgcacacgtatgtttattgcagcactattcacaatagcaaagacttggaaccaacccaaatgtccaacaatgatagactggattaagaaaatgtggcacatatacaccatggaatactacgcagccataaaaaatgatgagttcatgtcctttgtagggacatggatgaaattggaaatcatcattctcagtaaactgtcgcaaggccaaaaaaccaaacactgcatgttctcactcatagataggaactgaacaatgagaacacatggacacaggaaggggaacatcacactctggggactgttgtggggtgtggggagcggggagggataacattaggagatatacctaatgctaaatgatgagttaatgggtgcagcacaccagcatggcacatgtgtacatatgtaactaacctgcacattgtgcacatgtatcctaaaacttaaagtataataataataaaaataaataaataaataaataaaaagtccaagtccaaagtctcatttgagacaagaatagtcctttccacctatgagcctgtaaaataaaaaacaagttagttacttccaagatacaggcattgggtaaatgttcccattccaaatgggagaaattggccaaaacaaagaggccacaggccacatgcacatacaaaacccagcaaggcagttattaaatcttaaagcaccaaaatagtctccttgactccatgtctcacatgtagggcatgatgatagaaggcatacgctcccaaggacttgggcagctctgcccctgtggttctgcagggcacagcacctctggctctttcatgggctgccgttgagtgcctatggcttttctgggtgctcagtgcaagctgtggatccaccattctggggtctggaggatggtggccatattcttacagctccagtaaacaataccccagtggggacactgtgtggaggctccaaccccgccattcccctctgcattgccctagtagaggttctccattagggatctttccctgcagcaaacttctgcctggacatctaggtgtttccatacacccttgaaatctaggaagaggttgccaaacctgaactcttgccttctgcacatatgtaggcccaacaccacatggaatttgccaaggcttggggcttgcacctctgaagcaatggcctgagctgtatgttgaccccttttagccatggctggagttggagcagctagaacacgagacaccatgtctcgaggctgcacggagaagtggggccccaggctggccatggaaccatttttccctcctaggcgtccaggcctgtgatgagaggggctgctatgaagatctctgaaattccatggagacatttttcccattgtcttcactattaacactcagctcctcgttacttatgcaaatttctgcagccgggtttaatttctcaacagaaaatggggtttttcttttctaccacatgaaaaggactcagaaaacttacaattatgatggaaggagaaggagaagcaaggcatgtcttacgtggtggcagaagagacgagagagaacagggaaactgccacttttaaaaccatgaaattttgtgagaactctcttactatcacgagaacagcatgggggaatctacctccatgatccagtcacctcctaccacgtgcctctcgacatacgcagattacaatttgagatgtgattttagtggggacacagagccaaaccatattggtgcataatacttaatacctcattcatggcaatgatcacttcttatctttcattacagtaatttgatagatagcttttctcccatacttgagtgtacagtatgttgtttctctctttaagaatatagttgctgagtgcttgagagcacaactgattaatcttttgttactcccacaatatttggcaaaatgccgtgcatattatagatattcaataaatatttgactttataaatgaatatttatttggcaataagaaaattttgataacttttcttatttaaaatgggaaatagtcatagtttttttagaacaattagtaactgtactactaatgttgattaacaatttcaataattattagtttaaatgataatgaacatgcatgtaatctagtcctcaggggaagactaggatttcatcaaaatgatagagcctaagtgtactacttatttcaatacatcgaaaaatttaacagtcatcaaacagacattaacaaccaaaccacagtgattttcaatgtaacatctccaggattaagaaacaaattgtaacattcatttgatgcttaaagactattctttctttctaaggtgtgatgggagaatatgagccgaaaattgaggtccattttcctttcacggttacagctgctaaaggaacaactgttaagatggaatgctttgcacttggcaagtaagtacatgttcttccataattaaacacaattttttattaaaatgtgacatatcttatttttggatcacttattttgctaggtgtcatttccccagttgttccatggtggctatttattttctaaaagaaggtcaaatggcaattgatgaagtaatcagttacagttatcttctagtcatttctatggacaacagtttctataattttgctattttaacataaaaaaacttctttaatgaataaaaagctttacatctttacctatgtatcttaaaatttaagtgtcatctttaaatttcattcagtccttatgtaaataaagaagatagaaaggcaaagtactatctgctcctcatgtataggatgtagattcttataagacataataagacagcagataaaaatcatgaggataatagttacatagtgatcctgtgtattaccttagtatctcctgaaatcataacttaatagcaccagctgtcaatatgtacaacatgtaatcatttcccaaatgagagaaagaatttatgtcacatgctaatgcctgccatatttaatgattatatttctgagggtttacagcccaggatatatagtcacttgtcaatgatgtttacagtataggtattgagatcagaggcagaagtggaattttgattatatttgattattgtattatgatttattttaaacagagtgttgttttctttttttttaggatgctaagacttcagggttctttctagacactataatttgcataaatgtatctctgtcagagttactaattacttaacttcagttgcagagagcaaactcccacaatataactataaagtactcggagataaagccagatacacaagtgtgattattaaagtaggtttagcctttgggtaaggaaaatattagtaaatatgacaaaaaatcagctagctaaggtagatttaaggaacgaacatagtaaacaccgtgttttaatatcaagaatgattaaaataagacatatatgcaattctactttaagtagaaacaacatcataatagactataagcaaaatgaattgttatgtgacccatcttttaagcaaaagatagccagaagtagaaataaatttcaaaatgtaaaatgtatctaggaggtatttgggcagatatctgaggaagcctcctaaacctaaagatgttagttaagcgcataagattgaataatagttaaaagtctggtttgtcaccatttgctgttctgtgtcaaataggtctgaaaatgtcccaagtaagaagctcaatactgacaaatgcaaaaataatatattctggcttgaagacaagggttttagtgtatcctgtagttaaataattcttcagtgccagaatttatactaaggccacaaacaaagggaggtcatattgtaaaacaaattagaaaactagacttataggaaaaaaccaatataaatatttccccaggcaagcttatttaataagttagatgtggttgcctttggaagccttgaaatatgtttagtaaattgaggcttacagtctctttcattctaggtaagacccaacagtcaaatcactaaatcacttatgttcttttaatatgttattttcttcaacctttctactccttctttgctacccaactctcaaaagtaaatacataaaagggagtgtaaagaagactgcttcactcaagaaggtctctgtttatcacttggtgtcctttctaagaaatgtcacaattatggaaaaaagaaacatcttatgaagatgtctaccctctacctaaagaccaatctgccacccttatgaaaataaacaagatcaaagaaataacatcttgacatgtgttcatccttttacagcacattgtcttgtggtgtggatcaccatttcatcccaacataatcacagcaattgcaaattaattcctgagcatccgcgtggctcccacagctcacttgagctgcttcttacttcagcaagcacatggtgctcttgtgggcctttgtctgttgcaaaaacttcagtatctgtcactggatatcgtcaggatcttaccactcaggctgttttccccctcactgtgtcctaaccaaacattccttgtagagtgttataaccaaattctggaatggagcatgtcaaactttttttttgtcttgtggcctttgcacttgctgtttcttacactgggatctctctccccctgttctttccatgggggctctcattcatcctctggcctcaatttcaatatcactcctgaaataggctatctatgaatgtacatgttatctaactcacacccattattctctgtctgtatactttttaatcccttttttacagtccttaacacaattttaaatttcccacatacgtgtttctccacttaaaacatttatctgtgtcaggatcccagatgtaatcaggatccaactcagacatttcaatagaatttagtaaagtgatgagctgaagatctgtgagcaggctaagaagaacaagaaaaaccaagacatgtataaactcctgatagcaatgactcattgtcatgtgtaatcctgaaggagcaagtgggaggagatggtgtttccagaaccagggaaaactggagatatgaagtgggccagggatcaaccaatgggagctgtaatgactgttgctgtgaagagacacagcctttatataagaacacagctgaagaaaggattaggaaatttatatcctgacttctttttcctcttgccttctcatctcctctggtggctctcatggctgaagtcaaacagaagccactctacaagcctgcggatgcaattgtcagttcacaaggcaaggcagagggtctgcagggaacaagaaggtgacaggcaagggaggaaaacagaatagccagcactttccccactcttaggctttaatccccaagaaggcaggaatcattactgtattcttcatttacttattcctagtgcctaccacagcacctggcacatagcattcaggaaataggaatgaatgaacttaaaaatattccatctacttaatccaatcaactctttattattaacagttaatcaaaaataaataagttatttatgccttatcctgtcccccccacaaatacatcatgtatactctgcacctgtatctcctgctctcccgtattctcttatttatatccaaaattacatgctatacttgcctctaccttttcctacctattcttgcctcactctatcatttatctttgttaacttagacctaccattctccaactctcttttttatttttgtggtaagaacacttatcatgacatctaccttcttaatgagcttttaagtgcacaatacaatattgctgactataggtactaggttggcaacagcaaatctctagaacttatttaatttgtataactgaaactttatttttattttattctcaaagcatattttcatgtccaagttgtacttactgtttaacatgacaaccccaaaaaactttcttgatctactgcctcttaagaaggatttgtttgttgccttttttgaggctaaggataagagagatttatcatatctatagaagctagggcaaaggatggagtgaaaaatatttatatatcacaaagtgtaatattttatataataatggtttgagggacaaacaaagaagatcataagtacaaaatcttgctattttcaactttacctgttcccagccttagcggagtaattcacatttcctaccataaatcactattttttatcatgttattcattgaaccaaatatgttcctagatatacagtcattccttggagatatttgaggttcagttccagatgccacaataaagcaaatttcacaatgaagaaagtcacatgaattttttggttttccagagcacacagaagttatgtttacattatattgtatgttattaagtaggcagtagcatttacatgcctggcttacatacatacaacaatttacacacgttgatttaaaaatattttactgctaaaaattgctcatgctgatataagtcttcagcaaattatcatctttttgctgatgactgatgctattgactgataagggtggtggctgctaaaggttggggtggctgtggcaatttattaaaagaagacaacaataaggtttgtcacattgattgactctgtagcttatgatgctgttagatagcattttacccacagtagaacttctttcaaaattggagtcaatcctctctaactctgccaccactttgtcaaccaagtagatgtaatggtccagatcctttgttgtcatttcaacaatgtccacagcatcttttccaggactacactaactcaagaaacccctttctttgctcatccataagaagcaactcttcattcaacttttatcgtgagattgcagcaattcagtcacatcttcctgttccacttctagttcttgttatcttgctgttttcatcacatctgcatttactttccccactaaagttttgaacccctccaagttatccatgagggttagaaccacttcttccaaattcctattaatattttgaccttccatgaatcacagctgttcttaatggtatatagaatggcgaatcctctctagaaggtttacaatttactttgctcagatctatcagtggaataattacctatggaatctctacccttataaaatgtattttgtaattcattcttaagtcattggatttgaaatttgaaaattactccttgatccatgggctacaaaattgattttgtgttagcaggcatgaaaataacattaatattgctcatctacatcagaactcttgggtaatgagatgcattgtcaatggacagtagtatttctcttcgctaatgagatgcattgtcaatggacagtattattttgaaaggagtctttttttctgagctgtaggtctcaacagtgggcttaaaatatttagtaaaccatgctgtaaacatgcagtgtcaccaggctttgttgttccatttcaagaacacagagtagatttaacataattcttaagggccctatgattttcaaattggtaaatgagcattggcttcagattcaacgtcaccagctgcattagcccctaacaagaaagttagcctgtcctttgaagttttgaaaccagacactgacttgtttttagctatgaaagtcctaggttgcatcttctttcaaaataaggctgttttgtctacattgaaaatctgttgtttagtgtagccatttccatcaattatcttagatagattttctgaataactagctgaagttttcacatcagcacttgctacttcaccttccactttaatgttataaagatagcttctttccttaaaccttataaaccagcctctgctaggttcaaacttttctcttgcagcttcctcacctctgtcagccttcatagaattgaagacatttagggcctttctgtgagttaggttttggcttcagggaatgttgtggctggtttgatctacccagaccattaaaactttctttctatcagcaataagcctgttttgctttcttatcatttgtgttttcactggggtagcaattttaatttccttcaaaaactttttttttttcattcacaagtcggctaactgagcacaggcctagctttcagtctgtcttggtttttgacttgccttcctcactaagcttaatttctagcctttgatttaaactgacagatgtgctgctcttcctttcacttgaacacttagaaaccattgtagggttattaattggcttaattttaatattattgtgtctcagggaataagaaatcctgaagagagggagagagatgagggagtggccagttgatggaacagtcagaacacatacatttattattttagtttgctgtcttctatgggcatagttcatggagcttcaaaacagttacaataataacattgaaagatgactaatcacagatcattataacagacataataaaaaattgagatgctccaagaatttccaaaatgggacacagtgataataagtgaaagcaggctattagaaaaattgtgccagtagatttgcttgacatagcattgccacagaccttcaatttgtgaaaaacacagtgtctgcaaaacacaataaagtgaagtgcaataaaataatgtgtgccagtaccttctgtcttaagaaaaaataattcacttattaattcagaggtgtcaaaatataagagttgggctttgtgtagctcatttcataaatatagtagactaaagtacctcaaagaacctagaaccaaatgcaggtctgcaagctctgaaagccaactatgttctagggactgtcatatcttccaggatttccatagtctctgttctcaaagaaattgcattatatcttcaaatattttgctgaatgtaatattacaccttgagtccattcttaatcattatgtaaacatacactatggaccttgaccaagctgtcctctaatagccaacctttatctccacagaaattcactattcgcctttttggttccaagtttaaactaagacttaacaacctaacagcaaattttcttcttttgaactctctttggcccttgacatgatctaatgaatcttcgataagccaaattaggaaatttctttgatttttaaagaatcatacattcaaaccgtgttagaatactggttcattgtgatttctcttggaaagtacagttacctttttatgatctgtccttaatggtgttcagtttttgttacttagagcgtgcatattagtgcagctataatgcacagataatttttccatatataagcttatatctttcccatattctttaagaaaaaagaaaacaaataattgtaggttatcaaattttactatattttgatatcacccaaatttaccaacctgcctcatttgaagttaggtaaaaagtctactaaaaagccataagctgcaagctttctcctaaagaaacctctacttaaatctgaatttagcgaaaattcagatgttttctctacaggctgctggagcagaactcaacaagagtgtactagtttactcctagaaatagctcttaaaatagaattgcacaaggttgagtacagaacttttaaagtgaccgtgacatgctatatcatgctatactgtctgtaaaggtatttccccagaaaaatgggaagtgtttcaagagaacccatagggaaacaaaggtatgtaaaggcttgggtaacacagcaaagtgtaaaaaaaaaaatggagggggattaattagttggaaagaaaagactggtttagacatatggaaggttattatcaagagattgctcacaagctgttctccagtttcaacaagggagggagtgaaattccaacagtatgggattaaactagaagaattagattgggtgtaatgtagaagttcatgaaaaaatgagttgttacagggaaactgggttatcaggagaggcagtggaagctctttgcctgaactgctgtaagaatataataatgcccatttgtcttctaatggtttagatgtaatgttccctgaaaggagagaaatgatctgggtcaggattggaaacgaaaatttaaatattttcttttgctggctgcccatccacacattctcaggctgaatattaagagtagaaggatagaatcaggcagacttaattaactgccttttggcagtgacattattacataacatttcaaaccggttggtggcatatccaggaagtagaaatgatgagtgttgacttttcttgctcagcattcaatctagggaccttaatggaaatggggttattgtggatatttccaaggtcggcttttaaacatcaggtacaatactcttgaaagggattgagagataaaggggtcaagggacaatgcaagcaaggaatcccttaggaccctaataaatatttcatttcagtggttctttctaaatgcagtatataattaaacattggtgatgttttcaactgggtgtgctcagtgtttaagtccagcccatacaagttgttaactaagtaacacagggtaaaaatgagaactttatggaaagtcagtaactacagaaagcagctaccatctctagaggtaaggggggaaaaaaagaattagaattaataaaaattagaacctcagatgtacccctaggaccaagaattctgaggaatggacgaagtgggacacaatgaagcctctcctgaaagtgttgggaaaaaacttgaactgtattttattgctgctaagggaaggattccctgctgaggtgccattcaggggctatcgagctgacaggaagcccctgggaagcccacaggaaataaacaacgatggtgttccttctggcttcttcagccttgcaatctccctacagtgccccctcctggcagtgtagaaatgtggttttcagaacccttgccccagtaccacaaagcctagtagaggatggagctgagaggtggtcatttaaacagtagcaccaattccacttgacattttcaaacccatctcttaatcaactgcaccccttactatacctcagccatcctggctttgccacatctgtggctctgtgacacagtttcctctgtctaaaatatctatcctgccccacaatcctattcagtaaggcttacgtcaaatgcccctcctccattaatcctccctgcttttcttgagctccagtctcttacctttcagtgtgaccacctacatttcactatttagcctgccccactggaacagctatagatatctgtcttctttagtgtgctgaattttgggatccctagagcattattagatgcagcaggtgctgaatatgtacactgaatgaattcaggtatgagaaatgtgattgatctttcataacaggaggtgtgttactgcctttggtttggccagacagatgtctccagatgctttcacatgttttggccttgaaaattcttaccacatttacattagctatagttttctggcaagtttcatttcaccgtgtgaccttttacagaccctagaaagagcactagatatgtcaactagcctccaacagaaacagaagtaaaatctggtcactgatgcttaaatgacccaatacacaagggcaaacagggttactctgtaataaaaaagccaaacgctacaaaacaacatcagtttatccataatgacaggcctgccagctaatagtgttacaggcagattttctctttttttctctctttttaaaaaattttacatgtttcttatcttgctcttgcagccattaacacacaatcagatctgctctgctcaaaaggccttgaacctgttactgtaataattatgtgaatgacctttgcaaactcatctgaaatcttgtggtgaggtgggagggaagaacacattcaatttcctgccctttttagttcctgcttatctctctttcagataccatttacaaatagtcttttgttacactccatcaaatgcctattagggaaccagggtattaagtatttttttctctttttatatgtttactgtaaataaaaagccactagttatcaattcataaaattatttttgctgtagtttatgttttcctttcctcaccccttagctaagctgtctcaaatggctgctcttgtgtcccattgtaactgtgagaatgacaaatattcctctgagacttcctacagtgtgcaactggcaaacgttcctggaagaacctgctctttagttacagattgatgatttattaatactgtttatttggagctgccagtcactaagggctgtaggaattaaaaatgaattggagttatgtggtatttgtctatcaaactaaaatcaaattacttaatcattaggttgacagaagatctggggataggagtcagtctctgggtgttggaatcaataaacatttaggcctcacaggaaagtggtgcattacagaatcaagaaaattgccatcatgaactattgcttgctttagtatggttgagatgaaggacacatcctcatttcagatggtacccagaggtgatggatcctaaaagaaccttaaggattgcatgacctaacaaacgtgaatttgtaaatggaaaactgagacttctcaaggaatggctagacgtgtggatgtaccgctcaggctaatgttttgatgcaacttcctgtgatgttcttgacgtgttcaacattctttcatagggcaaactttgaaggaaatatttaatttacttataggcttttacactgagaggtgttatgtgttttcagggaaacaggaccaatttattattcacatttagagtcaaagttaactggcatcatatttccagcttttccacggctgccctagaactagttaacctgcctcaggagagaaactgtatacatgtgcaaggccaaacagctaatgtgtgtggcctatagaggcagaactagataccctgatgctaattaatagtattctcagtttacagtttttcagttgctaagagtaatttttactttgtcacagcaaacattatattctgaatgccctgaagcatctcagtgagtgagaattaggaatcttaataggcaagacaagttaacaagaacatgaagcaaaagataatccccaaattgtaagatttttacttggattagtttagacttatccaacagctttcttttaagttaatctcccaggaatttccatggaaaagtttcttcctctgggatgatcgtaagatcagcaactatctggatgctgagattcaaaaacaggatgtaaagaattactttattaaaagaatgaagttatgccttttgcagcaacatgtacataactgaaagccattatcctgagtgaaacaactcagaaacaaagagaaataccacatgttctcacttacaaatgggagccaaataatgtgtacacatgggcatatgctgtggagtaatagtcaatggagactcagaagtgtgggagggtgggaaacgggtgacagatgagaaattacttaatgggtataaggtacattagtcagttaatgattacactaaaagcccagacttcaccactacacaatatagccatgtaaccaaactgcacttgtaccccataaacttatacaaataataaaaaagacttagtatatccatcagaagtttctaactttattgtatcccatacccctacaagaatcaccaggtacataatcttgacacttgaataggacatcagtggaacaaaaaaggacaattttaaccaaaaagttgtcaacaatctgagtatatgtaaaactaaacttctaccttgtcctggatggtttccatatcacactcagattccaacaacatctctgacatgttatctcactggattacaaacaggaatgaatttaggcaaattatgtatcccatttgacctgtttccttattttgaactctcacagtcttggatttctaaaagtgttatatcatcatcatccacaaattcccactgagtattctactagaaattgaaatgtttccctaacagttatctcttctaatggtgatttaacaactatattgctacttttaaagccgatttatctaacaataaacttgcttgaatatctttgtttgagatctcattctatctcatatgttttatgacaatactcaatttttaaatctatcatagtacatgtattcttaaaagtagtatgtgtcttactgaatcactgtactttgaactaagcatgctcgtcatgtgtctaatatagtcatatttgtattagttaagctaagagaacaacaaacttctccactagagaaagatcaatttagaacttcaagaaggttttcatatgcagttcttagaatgatttcatggtaacttggaaattaggtaccaagtgtcagtaatgtgcatgccattagaatttcatgcattcaaaaattttgtatttattatttcaataactttgaaaatttgaatatgtgatgatctagtgtgaattactaatgttatatataccacatttgatgcagccctctgcataacagcagtatctctaactcacctcaaaccattggcatcattatcgacctctgccaaatcttccatcccaatctgccagacatttaaaacctctcaagtcccccctctccattttattctatttttcacaaacatagttcaaatctattattattggacaaatttggctctcttacctctgctgcaaataagactagagatgttgttgtcccagctactcaggaggctgaggcaagagaatcgcttgaacctgggaggcggaggttgcagtaagccgagattgcgccactgcactccagcctgtctaaagagtgagactccgtctcaaaaaaaaataataataaattaaaaattaaaaatacatagatttttattgatgcttcattagctttgggaatttctccaagtgctgctttcataggccctgctccattcactttatctgtttggttgtctattgttccccggaccttattcctggtttccaaatcactcctatctcatatactctgatgttattttggactttttatttgattgttgactccaactgcacctcttaatttagcctatttgatgttcttcaataccttggtccacagcatgtgggatcaggctgggtttctagaactccaaaccaagcacaactctccacactcacccatcatcagcctacataaggagtttttattatcactacgggtgaccatttaggcgttttccaaaggtataaaattttaaatatctttgactctttcttcctttttatcatcatctgtttgattaccataaatgtctcttaaattgattaccactgacttggtgcataatgaacatttgttaactgaattaagtcatttatcaatgtaataggtatatatatgtactcaaggggaagcacgaataaaccaatatattaaaaaacgtataagcctgagactaaacatgtctaggcatttagattgtaaaaataaaagctcagtccgtcttagtctctatctcaaattatggcatcatcctagtagggtgttatgcagtaatatctgtgctggtatgcccaaatttcagaaacaatttttctacttgggttctagcatgttgagttgccttaccaaagtcactctaatgaaaaacaaactgtgataacttgctaataaccatcactggtggcccattcatgtaagaaatgccctcagtggaaacaggactaattaaaaatctggtggcctataagcacagagtaagagcaaagtgcacacacttccctgtggtctgtaactaacaaggtactgcaaattcatggattgcagttcttttctcaaaatattcttgtatatttagcacacatcagcaagattacaagcatctcttctctgggtggtggtacggaaaaactaattttattgttgtgattgttattattctgtactttttcaagacacttaattttaaaaaacaatacaaatattttacatgataaaattttttagtattagtttcatgaccctatattaaaatttccaaaagcataggctttttttaaaattaattacataaggtgttgatgatttcctttagattattcaataggaatcctatccttgttaggcacatacttatagtttctaatctagaattataattatatgatgtcagaaatatttctacaaatacttaattccattcattctagttcattcttgttcttcccaattcagaatttattctgacatgtacgtgatacatcatatttatttgtttttagtatcccttgccagagagttgtaatatgagaaaactttctcttatgtctctgatgcttttaacaggcagaacacagaagaccatatatacaatttatttatgttctcaccaaataagtaatcagagacaaaagtctatgtttacctttggaatatccctctcagtgcatcatacaacttgaaaacaaatgccatagatacgggagaagggagggtgaaattacagggaaaggctgttatctgaattacatttttcaaaaacatctcctatgcccatatcatacaagtaacataagttttatctatctctgtaataattttattgtaaagcaatttgctgtaaagttaaaatattgcaacttcatattctttacttttattttgtaaatatactatttaaatatgcaattaaataaatgattatacatgtgcaatgtataatcagtgtggttctgaattgtcttatagctcattcttcgttgccttagattattcatgaatcttcattatatctaggcattttctactttatatgacagtgaaataaaggttttcattattttttgatttggtgctttttacatccattgtcccaggctgtttgcttgatttttgatggtagagccgtatgtacatggtggcatttgctacaattagatttaatatatttcttgcataagtgaaacatgtaagcatgtttatgtatgcacatgtgtgtgtgtgagtggttaaatccacagaaagactattgagaatgaatatgccgagacataaactcaacatctaccaccctgttttttctttgttttttaatttacaatgtaatgtagcagcacctaccttgtgtgaccggtcactggttttgttggtagttaaatggtgcagaacaggttccatgtcaaagctttataaggatgatttttggtctgaaaaacataattctcattaatagccaatagattttaaaaagatagtcgatgagaacatatgtctgctgctgctttatggtaccaaagctaaatgataagtacttttgatcatttttattcccacttttcttttctttgggaggttgaatcaatctacattacaactttgagaatgttttatttatggcctttttctcaaagaaaggtacattatgaaatcaggtcacttgttttatatatccctacagagaaatgcagccttcacaacatttccaaaagaagaacacacatcagtatttcccgtacagacacacagaggaagaatatcttcaagcctccacttcatgtcattccattacatttagccacattctgttgagagaaagcatagatttagtagacccaatgcatactttttttgcattttaatatctctgaaatccagatgtatattgcactcaatgttgtgttgtagtttaattggcagtgttttctttcttagagatagtggtgtgtcttaaagtagtggtgtgtcttacagtcaaagactgtatcttgaatgtgataaactagagtaagatagactaaaattggcatatataaacactaacttagggatcaattaaattagaacctgagtgatgacatgtacttcctccatctatgtgcagtttaatatttaaaatctgagttaataaacaaaagatctctcatagtactggaaagattttagaataaatgattgttgactacatattttcattttataaaatcatcaagagttattgtagcgtcaacagtgtttgttactccaaccatgccatctatgggatttcacacacaaacactttttggaaagaagggttgaaatacaaaggaagctagtccaggagaatccctctgcctgcactgcctgcattatctttagtctgtgggttttattgactatgtgttacaaataaaagaaaatagaatagacaaagactgaaagagattgtgcatcaggtggttagaccatttggttattgtttgacttttgtttgggggggtaaaatgggtataatagaaataacaaatattctaatacattttccgtgacttaaatgtgtagagaaaacacaatatattaagtcaaaagtacaattaagtaaattaactgtactgctaaagtatttcttcaggcatctttttaaaagctttattgccatataattggaacacaataaaatgtttaaactgtagaatttaacacattttaacatacgtatttttaccatgaaaccatcgcacaatccacataataagcatatccagtacctacctattaacatttctacatgtacacttataatctcttcctccttcccatccacgcatcctcaaccccaggaaactgatcctgtatgttttgtcactatagactacgttaccttttctagtcatgcataactgaaatcatacaatatctactcttttgaccgagagtgggagagtttgccttttttcatttagaattattatcttaagattcatacaagttgttgaatgtgtcaatagatcattcctttatattgcacagtagtgttccattttatggctctaccaccatgcgtgcatctgtgcacctgttgatagacatttggattccatgtttcagctattaccataaatcttccatgaacatttgtttagaagtctttatatgcacataagcattgaaagtttttcttagataaatacttatgagtggaatggctaaacgatatggtaggagtatgtgtagctattgaaaatattgctaaacaatttttcaaagtagttgtactattttgcattattattagcagcagtgttggagagtccaagtacctccacgtctttgccaaaacttggttaatctgtaattatgccatttaatatgcatgtagtggtgtcacattttatgttggattccccagtgactaatgatattgactgtgttatgtgcttatttgataactgcatatttctttagttaatagcttgccaatatttttgcctgagatgttgatatttttattattaaattttgcgtgagagttgtttaaaattctggaaacaagtcctttatcatatatgtgattcgcaaatattttctcccactctgggactgtctttttattgccttactagtgtgtctcaaaaggtacaagttttaaattttgatgaagtccaaattttcaattttttgtggggattgagattttagtgccatagctaagatatatttgcctaaaccaagggcaaaaggttttctcctacattttctcctaaaagttttatagttttatgttttccatttaagtctctgctgtattttgaattaatttttgtatgatacaggtatggatcaaagttcattattttcaatgaatatcaaacttggtcatcaccattctactctccacttatatgagtttgacatttttaaattccacatataaatgagatcatgcaatattcgcgtttctatgtctggcttatttcgcttagcagaatgtcctccaggttcatccatgttgttacaaatgacaggatttccttctttttcaagggtgaataatattccattatgtatatatatcacctacttttatctgtttatttgttgatggactcttaagctgattgcgtatcttggctgttataaatatatgctgccaaaacaggaatgcagatatctttaaaatgctgatttcaattcttttggatatatactcagaagtagaattgttggatcatatagtggttttatttttagtttttgagaaatctttataatcttttccatgaaggctataccaatttacatgtccaccaccaatttataagggttccgttttctccacgtcctcgccaatacttgttatcttttgtctttttgtaaaagtcattctaagacatgtgaggtgataccacattgtggtttcatatacctgttgaccatttgtacctctttttttgagaactgtctattcaatccttggctcattttctcatgaagttatttgttttattgctactaagtttcttatatgttttggatattaaatctttatcatatatatgatttgcaaatattttctcccatctcataggttgtccttttcactctgttgattgtttgttttatcaggcagaagctttttggtttgatttgatctcatttgttcatatttgctttgttccctgtgattttagagtcatattcaaaaatctttacaaggaacaatcaagaagctttttcctctgttttctttcagcagttttacagttttaggtcttacatttaagtctttaatccattgaaaggtgatatttgtatatggggtgagacaaaggccctattttattcacctgcaagtgaatatctagtatttcctacaccatttattaaagactgtcctttcctcatggtgtgttgttagcacctttgtcaaataacagttaactgtagatgtgtcaactcgttttttgattctcaattctcttccatatgcctatatgtctgtttctgtgccagtaccatgctgttttgattgttataactttgtggtagattctgagatcaggaagtataatgcacccagtttgttctttttgctcaagcttgcattggctattgaagatcttttatggtttcatatgaattatctctgtttgcagatgacataatcttatatgcagaaaacattaaagagtccaacaaaaagctattagaaccaataaacaaattcagtaaatcgcagaatacaaaatcaacagacaaaaatgaatggtgtttctgtacactaacaacaaagtatctgaagaaattaaaaataaatccatttacaatagcatcaaaaagataaaatacttagcaataaatataaccatggaggttaaaggtttgtacactgaaaactataaaatattgatgagagaaattgaagaagaaaaaaataaatagaaagataccctctgttcatggattgaaagaattaatattgttaaaatgtccgtactgcccaaagcaatttacgaattcaatgcagtccctatcaaaattccagttctatgatttctaatttattttatgaatttttttaaaatttagttatttatgagtatgttatttagcttccaaatattttagcatttctctgtctttctgttattaatttccattttaattacattatggtcaaataacacactttttgtgatttaaactctttaaatgtattgagacttgtcttatgacaaagaatttgttgtattttggtaaatgacttatgtgcacatgggaatttacatactgctgttagtgagtggactagtctacaaatgtcaaatagcttaagttggttgaatgtgttgctcaaatcttctatatctttattgatttctgtctagttcttctgtaagttatacagaaaagagttgaaattttctaatatatttgtagatctgtctgattctccttgcatttctatcacttttgccccatatattttgaatctctattatatagtgtacatactttaggatgtttatgcttctcgataaattgtctcctttaccactataaaatattcctgtttatacatgataatattttttgctctaaaatcaactttgtctgatattaatacagatacttcagctttctctttgagggacagaactaataggatgtatgtatatatgaaagagtgtttattaagcagaaatcactcacatgatcacaaggtgaagtcccacagtaggccatctgcaagttgaggaacaaggaaaccagtccaagtcccaaagcagcaaatgtagggaagctgacagtgcagcctttagtgtgtggccaaaggcccaagagcccctggcaaaccactcgtgtaggaacaagagttaaaaagccaaagaacttggagtctgatgtttgagggcaggaagcaaccagcacaggagaaagatgaaggttggaggactcagcaagacagctttttcttctaccttcttctccctgctttttccagcctcactggcagctgattggatggtgcccaccacattgtgggtaggtcttcctgagggtgggtcttcctctcccagtccactgactcaaatgttaatctcttctggcaacacccagaaacacccagatacacccagaaacaatactttgcattcttccatttaatcaagttgacacttaatattaaccatcacagcattatttgcaaggtgtattatttaacctgctattacttttaaaccgttttgagttttcatatttaaaatagatttcttttaggcagtatgtagttgggtcttactttttaaaccaacataacagtatcttcctcttaaagtagttattgacatggtgtgtttaaatctagcatcctgctatttgctttctatctgtcccctatgttctttgtacattctattctttattctaccttcttttgtgttaatggtgtattttattctattttatctctttagttagatagtattacttctccacatattataaagcccatagtacaatgatactatttgtttgactttaaacagctggttaatctttcaaagagatataaataatgagaacattaatttatatttgtccatgtagttaccattttcaatgctttcaaattctttgtttagataactggtttaatctggcgttattttctttcggcctgttcctccaacataattgtaggtaggcctaataattatgaattatttcaacttttgtatgcctaaggaatgtctttatttcacttttgtttttaaaacatattatcactgattaaagaattacagaccaatatcttcttccttcagtacttcagatatgtttctctactattttctaacttgtataatttttgacaagaattcagctgttactcttatatctgttcctgagtatataatgtggttttttttctctgactgctttcaagattatctctttataataagttttatggaattttattatagtgtacctaatttagttttcttcatgtttcttgtgcttgtggtacattgagcttctgggagccaaaatttttgaccattgttttttcaaggaagtttttctattctcctgctccttttaatttggaagctacaattacacatataatagtctgtttgaaattacccactgttcaacgatgctgtgatcatttttcatcgcttttcttttgtctttgtatgtttcaccttttgatagattctattgctgtatcctcaaatttactaattttctttcgcaatatttgatcttctgttaatcacctccagtgtgttttatcagacagtgaaattttgattttttcaggatttttttaaaaagaactttattgtttagagcagttttaggctgaccgcaaaagtgagcaaaagtgcagacatttcctatatcctgtctgcccctacacattctcagtctcctctgttatcatcatctaccaggatggtacattttttacaactgagacacctacagtgacatattattatcacacacagaccataatttgcattagagttttcttttagtgttctaaattctatggatttgaataaatgtataacaacatatatctaccattacagtatcatacagagtagtttcaaaatccctacaaatcttctgggttccatctacccatctctctgttatccctaacctctggcaaccactgatttttacactgtctccagttttacctcttccagaatatcatatgactgaaaccataaaatatgttgccttttcaggttggcctttttaaatttagtaatgcacacttaagttttctccatgtcttttcatggcttgatagctaattttttttttaatacttcatgttgttccactgtctggatataccacagttcatttatctattcagctactaaaggactcttagctgcttccaaattttggtacttatgaataaagctgctgtaaatatccatgtgcatggttttgtgtcgatataagttttcaactccttttgttatataccaaggagggtgatacagctaggctttttatccccacccaaatctcatcttgaattgtaatccctgtaattcctataaactccacatgtcaagggagagaccaggtggaggtaactgaatcatgaaggcagtttccttcatgctgttctcatgatagtgagtgagttctcatgagatctgatggttttgtaagggtcgctttcccctttgctaggcacttctctttcctgccaccttgtgaaaaaggtgccttgcttccctttcaccttcccccatgattgtaagtttcctgaggcctccccagccatgtggaactatgagtcaattaaacctctttcctttataaattacccagtctcaggcagttcttcatagctgtatgagaactaatacaacaaattggtactgggagtggggcactgctataatgatacccaaaaatgtggaagcaactttggaactgggtaacaggcagaggttggaacagtttggagggctcaggagaagacagggagatgtgggaaagttttgaacttcccagagacttattgaatggctttgacgaaaatgctgatagtgatatggacgatgaagtccaggctgaggtggtctcagatggagatgaggaacttgttggtgactggaataaaggtgatgcttgcaaatgctttagcaaagagactagtggcattttgtccctgccctagagatctgtggaactttgaacctgagagagatgttttagagtgtctggcagaagaaatttctaagcagcacaatgttcaagaggtgacttgggtgctctgaaaaacattcagttttatgccttcacaaatagatggtttggaattggaacttatgtttaaaagggaaacagaacctaaaagtttggaaaatttgcagcctgacaatgcgatagaaaagaaagacccattttctgaggggaaattcaagcaggctgcaaaaacttttatagctaatgggaagccaaatgttaatcaccaagacaatggggaaaatgtctccagggcatgtcagaggtcttcactgcaacccttcccatctaaggcctggaggccttggaggaggaaaatggttttgtgggctgggcccagagccatgctgctttgtgctgtcttaggacttggtgccctgcatcccagctgtggctgaaagaggccaaaatacagctcagatcattgtttcagagggtgcaaaccccaagccttggtggcttacacatggttttgggcctgcaggtacacagaagtgaagaattgaggtttgggaatctctgcctagatttcagaggatttatgaaaatgcctagatgtccaggcagaggtgtgctgcagggcttgagctttcatggagaacctatgctggtgcagtgcagaagggaactgttgggttggagacaccccctgcagagtccccactggggcactgcctactgtagctgtgagaagcggttcactgtcctctagaccccagaatgatagatccactgacagcttccaccatgagcctggaaaagctgcagacactcaatgccagcccatgaaaacaactgggagggggactgtaccctgccaagccacaggggtgaagctgcccaacaccatgggaacccaccttttgcttcagcatgacctggaagtgagatacagagtcaaaggagatcatttcagagctttaagatttgactgcctcactggattttggacttgtatggtgcctgtagccccattgtttcagccaatttctcccatttgaaatggatttgtttacccaatgcctgtatccccattatatttaggaagtaactaacttgcttttgattttacaggctcatttgtagaagggacttgtcgtgtctcagatgagactttggacttggacttttgggttaatggtagaattaattaagaatttgggggactgttgtgaaggcatgactgcttttgaaatgtgaaagggatatgagatttgtttggggctaggggaagaatgatatgtttagggtttgtgtccccacccaaatctcctctttaattgtaatccccttaatccccatgtgtcaagggagagacctggtgaaggtaactgaatcattgaggaccatttccttcatgccgttctcatgatagtgagtaagttcttatgagatctgagggttttataaggggctcttcccactttgctccacacttcttcttcctgacgcctggtgaagaagatgccttgcttcttcttcactttccaccaagatagtaagtttcctgaaacctccccagctttgagtcaattaaaccactttcctttataaattgcctagtctcaggaagttctttatagcactgtgagaatggactaatacagacagcaattactagattgtatggttatagtatgtttacttttgtaagaaactggcaaactgatttccaaaatgactgtactattttgcattttcaccagcaatgaatgagagttcttcttgttctattccttgccagcatttggtgttgtccatgttctgaattttgacataaaggctgtgtagtagtgtttcattgttattttaatttgcatgtcactcataatctgtcatttggggcatgttttcatatgcctatctgccatttgtgtatattctttactgaggtctctttaaggtttttggcccatttttttagtcagattgttttcttattgtttagttttaagagtcccttttatattttggatagtagtcttttatcagatgtctttgcaaatattttcacttagtttgtggcttgtctttttattctcttgacagtgtcttttacgaagcataaaattttaattttaatgaagtccaacatatcaatttgttttttcatggattatgcctttgatagtgtatctaaaatgtcattatcaaaaccaagatcatcttgattttgttcccagacattgaagtttttatctctaaaattctgatttggatttaaaaaaaaaatctcttccatagttgtacttaacatgttaagtattttctctaggttttgaacacatgaaatgtagttataataactgttttaatgttcttgtttactaactccatcatatgtgtcatttttatgttttggtcaattgtttgttttcttcctcattatgagttacattttcctgattctttgcatacctgaaaatttgtattagatgtcagaaatttgaattttaccttgttggaaattgagcatttttgtattcttgatctttgttctgagatatggttaaattactcagaaacattttattctttcagttcctatatttatgctttttcagataggaactgagcagcatttagtattggcttaatttttccccactgttaaggttaagacctttcttagtactcgaacaaatgcctccctaattatgatattttccacatggatgttaggttaggaactattcctggcctgtataaattctgagcactggtccttctaatcctttcagtgtgtcctttcctattttaaaatagtttttccatatggatgcactagtcattactgaattgaatactcatgagggatgtcctgtagatctctaacactctttctctgcacagctgtcctctctcgtttactgtgaattctagttgctttagtttctccagactcccagatctgtcttttcaactcagaaagacagctgagctttgcctaagtctcccttgctatgctgtagagtgaaaactttgtccagggagcaagcttgggcagttgtatgatttggcatgttaatttaacatacttcaaggattactgtcctttatatgctgatgcctaatattttgcgactattctttcatgtattttgtgtagtatttagctaatttttctcatttttatttactcagtaaaaagtgaatgaaagatagaagttgacccaaacctgctctaaatgtctttatctaaccaagagaatagaaataaagttacctgcatttggaatattgcatattttacctgtccttatttgaataaattatgggaaaaaaaacagcaactgaaaggtaatagagtgattctttgacagaatcctttctcagaaagagtttaaaacagaaacagtaaaaagctacagtaaagtactaatttaacctaccattccttaaaaaaaaaatctgctggataaaattcacaaggactataactcttctgtagttgaataggttacatttttcagtgccaagtgacaagagaaaaataaaggtttaaagtacctaatttcaaatatcagttcaattatctgccacctctatgacaccaaataaattatcctctctgaactgcattttcaaaattaggaaagtaggaataacaattcctacatcatagagttactattagatttctccaagagactcaatacatgaagacctgtcattcatatgttaatttattatttcaccctagttttctagagtatttggggagcattgtttactttatgaagcatttgcctatcctctaacattctccttctttctgaaacgccatccaagacacagtccatttctcaagctttccttaatccaagtatgcttgcattctataaacctctctctgctgcccttcagcttttcatggtgtcaactgaaaatagatggtagaaaattcactctttggctttctgcttacaatatatattgtcatgtgccctagtaatccaaagaaactctgaacccacaaaaatgtttctatagatatgaaatattgggaataatttgttagttctatctttcccaaacattgtttcaggtcaaacctttctttttttcctgtgagtttaaagagtattttctaaagctgattttacttactaggtctagggtgacattttactctggctgctgttaatacttaaaatattttgtactatttctttagcatcagatttggcattcctaactaagaaaatgcccggaggccacaaaatttaaaaacttaaagaccaagagccaaatacgttagaagatagagagagagagagagaataaatattgctctaccattagtttttctgccttaacggctgttggaaaaacatacatgtgattcagatatagaaaaaaaaaaatgacaaaacaaaacaacttgaatcatgtctaagaaagtctggttttagttataatatcaactgaaatattctctgcctaaaacaggccatagtgactttaaatcactaaataagacgatttaaaaacatgctaattggccgggcgcggtggctcacgcctgtaatcccagcactttgggaggctgaggcgggtggatcatgaggtcaggagatcgagaccatcctggctaagacggtgaaaccccatctctactaaaaatacaaaaaaattagccgggcgaggtggcaggcgcctgtagtcccagctactcgggaggctgaggcaggagaatggcgtgaacccaggaggtggagcttgcagtgagccgagatggcgccactgaactccagcctgggcaacagcgagactccatctcaaaaaaaaagaaaaaacatgctaatagaatgcagatattaatataattcaagataaattatactgaaaggtaaatttgagtctgctattccttcataattgagactgactgtggagtattctaccccttacatgaaatgattaatggactattcgtacccctagcttttgtaatgattttttaagttaaaaaatcttttaataattaagtttaattttaaacagttaaagattgggaatgaatctttacagccctctcattctatctttacaccaaaataatgaccaatactgtctgttaaattttttaacctatgcttctgtcatctatttaaaaatgtagagtattaaggctagttcttgtgctttacttgaatggaaattcattaaaaacactgtgctccacaaatataaactgaataaatgtcagcattcataaactgttctgtgctctactttgaactgtagtgtggtttctttttaaccatttaccaaatagtaaagaacatggctgtaggtcaggcatggcttacacctgtaatcccagcactttgggtgactgcagtaggagaatcacttgaggcctggcgttcaagaccatcctgggcaatatagaaagaccccatctctaaaaagaaaaaaaaaaattaaagactagctatagtggaatgcatctgtagttccagctacccaggaggctgaggcatggaggattgtctgagcccagcagtttgaggctgcagtgagctattattcagtcactgcagcctgggcagcagagcaagaccttgtctatattaaataaataaatgcagtgactgtagtagacagcagaagtctctgtcttaaaaataggtgaaagccatgtcccctaattagaatagtatatcattaacatggcatttttaccacctgaccccgttaagctgtgccatagatatgcacaatccattgtgaaccaatgtcacaagtgtgccatgtattgtgtatgcctcattgtccgcttgtctctatttgactttggtgtataccctgtagaacaaaagggctgatgtacatgaatgtgtacattgaatatgtacaagaataatgacttcatagagaaatattttctctctttctagctagaagtttacttaatgtctttttcagtttacttacttataaaacacaaaagataaagcatacttcttaggcttctgtgaaaattaaatgatatatcagataaaatcctgtaaccatgttaaagctcaatgttaaagctcaattaatcatacctatatagtgatagaatctaagaatcagggatggatctagagctggaagaccacatttcccaaatacaattttttcgtgaattaaggtctaaatagatattaaataactgccataagtctcccataatgtcatagggctgggtctagaatgtccatcttagtaccattgctcccctacactttccactgcacagtctataggtgctagctttacttaaaactctagcagctgctagcatcaaatattatgtgtgtctaacttcttaacagaagaatggagattttactttctcctggtacttgatagaattcatagggtcaaccatgagcacatgaacttctatatcacacgaaactattgctacggaataaaagatgaaatgctcctgattattgtaaatacaaagttgcatgtgggattgtgtaaagacaatgccaggttggactgccagaatgagccaacagcgcatgatgtgcttccccctgcagagagcctatgagtggacgtgcagtcagggaggtttcacatcaccaagattcctgtcccagaaaagcagatgttcatacatctgggaatggaatgcgacccttgtggagagcctataaacggatgcatgaggggcgcctgtccatacagataagatagggctataaatgccctcatcttgccacagctcttctaggcctctttagggttaaggtatactcccttctgagaatttctggtctaaccagttgtctagcttcacgtcctgtttctatggattttttgtaaccagcttttgctgcaactgttactgctgattaatatcttgctaatcataggttatggaaagactgtttctgttttaaggctctgttagaaattactgatgcacatgttatattgtaaattcttatctctgtatactgtacttctacatacaggtgttatgtgaaagaattacttcatccccatatgaccatctcacctcatgatcaaatgatcctaaatccctcactaacctacccctgccctcactaaacttaataacaaatgctggtatatccagtgcattggtggcaccacgggaccagaaggtggtgacccccctggacccagctttcactgtcttgtgtgtgtctattatttctcaacctgccgatccacataggaacaaggagagagccctgttgcattgtgggctgctggccagatcccacaataaaagttctaatgcacctaaccatatactctattcaacttgaaacaatgtttcaggaacccaggggctgcaggtgagagatataactttacttttatatatttggcccatgaagattctgagaaggcagtcattctgagagtatcactatgacagtatcattagatgcagcaaattaggttatctgagtgttctagtgctttttttgctgtagtatttagttatattaatgtggattttgttctattacattaaagaattatagtttatttcactatggaatatttaaatattattatcaatttcaatcctattcttcaatcctagccaaaacaggaggtgattcaaaaaagacagttataaatttaaaaagccttgaaatgttctagagacaaaaagtggtatcttcttacatatatttgtgaatgtaattagcaaaaaataatgatatatatatatataaaataaaagtttgaggagtattaagaaagtactaactgtcaatgttttctggccagaattttataccagtgcaccaaaacataattcttgtatgactttgttatgactttgttatgcaatcgttgatgatatttatttgcctcataatgtcgtttttaaacactcaatctgttttcttattgctgcccacatttgggggaaagaaattcacaagtaactttgccaaaaaggaattttgtaatgttattcctacatagtctttgagtataaaaataggtataatcagtataaaagaatgtcatttttccagtctaatctacaaataagaatttttaatgaatgaagattttggtagatttccagcttcagttccattattttaatagaagaatacaattcttaaaattttacctagttttttgttttaataaaatgtctattaatttgcaacattataaaagactatatacttttataaaactctgtgctgatgaaaacaagttgaaaattaaatagggaggtaatatggtcacaaactttgtggtatttctgtaagaaagactctttttctatgtaatttttaatttaacatctccacttttgacagaatatagacagtttttaaagtaataaaatgtaatgagcccagacgtgcagactacagtgttccaaactataaacgtcaaattagggagaagcacgggaaactaatcagcttttctggcagaacctggaaaactacaataagaggtgagagtgaggcaggaaataaaacagagtaaaataagggagattgtttaaaaacattttattgttcagaggtacatccatatgtagaattacattgcgtctgaactaataaactcaattataaaggtttctggccttgacttttcatctttacaagtatctcactgttatttgtgacccctttcagtctgcacccatgtctatgtattcttaatccatgatgtctaatttctcccttttcactaggacccctgtcttcacctcttacccttcatgaactacagtacatggtccatcgcttattctctccaacatctttaactctcttgctacaatgctcttttattacattcactctttaaatcctcactaaatatttcattgtctatatgcctctactcaaggtgcttagcactactgaagaaagcacacaatgctacagaatggtctcactataattgtattttccctagccttacttaggccctcagtgctgcacaccagtcttctctgtcttcattgtggctaattgcgacactcaccttcacctcctgctcccacaggcaaggtcagatgctactttccagagataattgaaagtctcggacaaaagattgtttcacttgctaacttcagatctataaacttcccaccctccatacacatccttctttcctcaactcatttttagaagaaaaaaaaagacatttctatctctaatgcaaatccaccttcattctgtatcttacttcctgctttttagagactgtactctcttactgttaaccattcaagtaattccagccactcctctctactggctctttctcatttgcatctgtacatcacatttctcaaatctcagcagagctcactctcaagtttttaacttctgtatacctcatgtgtaagctggatgaaatggtaattcctgcttcatagacttgttataaaaattaattccatggattataaataccaaacactttaaaagggggtctggcccatggtagaagtccaattaatactctccattgttattatctaactgtgtaagccacaaaccaagaaactaaagttgctatctcctttttcatcattgatattctatccagtatcaagtcttgttagttctatatcttaaatatcttaaacatctacttagtacaaccccattaatttaactagaccagagtaatcatttacatgatttcttcctcagccttttacttcgtattcctacctctaaccttgcttattttcagtgcattattcttgctgcatacagagtgtcctaaaccaaagtcttacaaactgtgcaccatggactggtcacctgttttcacgaaacaggtttaactggagcacagccatgtccatttacttgtgtattattggtggttgctttcactctacaatggcagccttaggtacttgcaatagagactatctggtccacaagcttatatgtttagtgtgtctttctttaagaaaaagtttgatgacccctgtcataaactcaaatatgaacatcattcacctgcttaaaacacttcaacgttttcagtaactttcaggatatgtccaggttgatttttgtagtacttcatacttacccttgtcttcctcttcagcctcatcactaaatagtgctagtgaagcaacaaccatacaaaacttctttctgtatctttttttttaaattttattattatactttaagttttagggtacatgtgcgcaacgtgcaggtttgttacatatggatccatgtgccatgttggtgtgctgcacccattaactcgtcatttagcatgaggtatacctcctaatgctatccctccccactcctcccaccccacaacagtccccgatgtgtgatgttccccttcctgtgtccatgtgttccattgttcaattcccacctatgagtgagaacatgtgtgtttgggtttttgtccttgtgatagtttactgagaatgatgatttccaatttcatccatgtccctacaaaggacatgaactcatcatttttttatggctgcatagtattccatgatgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctggatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttttttcttgtaaatttgtttgagttcattgtagattctggatattagccctttgtcaggtgagtaggttgcaaaaattttctcccattctgtagtttgcctgttcactctgatggtagtttcttttgctgtgcagaagctctttagtttaattagatcccatatgtcaattttggcttttggtgccgttgcttttggtgtttgagacgtgaagtccttgcccatgcctatgtcatgaatggtattgcctaggttttcttctagggtttttatggtttcagctctaacatttaagtctttaatccatcttgaattattttttgtataaggtgtaaggaagggatccagtttcagctttctacatatggctagccagtttttccagcaccatttattaaatagggaatcctttccccattgcttgtttttgtcaggtttgtcaaagatcagatagctgtagatatgcggcattatttctgagggctctgttctgttccattggtctatatctctgttttggtaccagtaccaggctattttggttactgtagctttgtagtatattttgaagtcaggtagcgtgatgcctccagctttgttcttttggcttaggattgacttggcgatgcgggctcttttttggttccatatgaacttcaaagtagttttttccaattctgtgaagaaagtcattggtagcttgatggggatggcattgaatctgtaaattaccttgggcagtatggccattttcatgatattgattcttcctacccatgagcaaggaatgttcttccatttgtttgtatcctcttttatttcattgagcagtggtttgtcattctccttgaagaggtccttcacatcccttgtaagttggattcctaggtattttattctctttgaagcaattgtgaatgggagttcactcatgatttggctctctgtttgtctgttattggtgtagaagaatgcttgtgatttttgtacattgattttgtatcctgagactttgctgaagttgcttatcagcttgaggaggttttgggctgagatgatggggttttctggatgtgcattcatgtcgtctgcaaacagggacaatttgacttcctcttttcctaattgaagaccctttattcccttctcctgcctgattgccctgcccagaacttccaacactatgttgaataggagtggtgagagagggcatccctgtcttgtgcccgttttcaaagggaatgcttccagtttttgcccattcactatgatattggctgtgggtttgtcatggatagcttttattattttgagatacgttccatcaatacctaatttattaagagtttttagcatgaaggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcttggtggataagctttttgatgtgctgctggatttggtttgccagtattttattgaggatttttgcatcaatgttcatcaaggatattggtctaaaattctcttttttggttgtgtctctgcccgggtttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttgcttggtaaactattgattattgccacaatttcagctcctgttgttggtctattcagagattcaacttcttcctggtttagtcttgggaggatgtatgtgttgaggaatttatccatttcttctagattttctagtttatttgtgtagaggtgtttatagtattctctgatggtagtttgtatatctgtgggatcggtggtgatatcccctttatcattttttattgcatcaatttgattcttctctctttttttctttattagtcttgctggcggtctatcaattttgttgatcttttcaaaaaaccagctcctggattcattgattttttgaagggtttttgtgtctctatttccttcagttctgctctgatcttagttatatcttgccttctgctagcttttgaatgtgtttgctcttgcttttctagttcttttaattgtgatgttagggtgtcaattttagatctttcctgctttcttttgtgggcatttagtgctataaatttccctctacacactactttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactatggtctgagagacagtttgttatgatttctgttcttttacatttgctgaggagtgctttacttccaactatgtggtcaattttggaataggtgtggtgtggtgttgaaaagaatgtatattctgttgatttggggtggagagttctgtaaatgtctgttaggtctgcttggtgcagagctgagttcaattgctgggtatccttgttaactttctgtcttgttgatctgtctaatgttgacagtgaggtgttaaaatctcccattattattgtgtgggagtctaagtctctttgtaggtcactaaggacttgctttatgaatctgggtgctcctgtattgggtgcatatatatttaggatagttagctcttcttgtttaattgatccctttaccattatgtaatggccttctttgtctcttttgatctttgttggtttaaagtctgttttatcagagactaggattgcaacccctgcctttttttgttttccatttgcttgatacatcttcctctatccctttattttgagcctgtgtatgtgtctgcacgtgaggtgggtttcctgaatacagcacactgatgggtcttgactctttatccaatttgccagtctgtgtcttttaattggagcatttagcccatttacatttaaggttaatattgttatgtgtgaatttgatcctgtcattatggtgttagctggttattttgctcattagttgatgcagtttcttcctagccttgatggtctttacaacttggcatgtttttgcagtggctggttccggttgttcctttccatgtttagtgcttccttcagtagctcttttagggcaggcctggtagtgacaaaatctctccacatttgcttgtctgtaaagtattttatttctcctttacttatgaagcttaatttggctggatatgaaattctaggttgaaaattcttttctttaagaatgttgaatattggcccccactctcttctggcttgtagagtttctgcccagagatcagctgtttgtctgatgggcttccctttgagggtaacccgacctttctctctggttgcccttaacattttttccttcatttcaactttggtgaatctgacaaatatgtgtcttggagttgctcttctcgaggagtatctttatggcattctctgtatttcctgaatttgaatgttggcctgccttgctagattggggaagttctcctgggtagtatcctgcagagtgttttccaccttggttccattctccccgtcactttcaggtacactaatcagacatagatttggtcttttcacatagtcccatatttcttggaggctttgtttgtttctttttgttcttttttctctaaacttgtcttcttgcttcatttcattcattttgtcttccatcactgataccctttcttccagttgatggcattggctactgaggcttctgcattcgtcacgtagctctcatgccttggttttcagctccatcaggtcctttaaggacttctctgcattggttatcctggttatccattcatctaactttttttcaaagctttcaacttctttgccattggttcgaatttcctcctgtagctcggagtagtttgattgtctgaagccgtcttctctcaactcgtcaaagtcattctccatccagctttgttctgttgctggtgaggagctgcattcctttggaggaggagaggcactctgatttttagagtttctggtttttctgctctttttttttcccatctttgtggttttatctacctttggtctttgatgatggtgacgtacagatgggtttttggtgtggatgtcctttctgtttgttagttttccttctaacagacaggaccttcagctgcaggtctgttggagtttgctagaggtccactccagaccctgtttgcctgggtatcagcagtgatggctgcagaacagcagatattggagaactgcagatgctgctgcctgatcgttcctctggaagttttgtctcagaagagtacctggccgtatgaggtgtcagtccgcccctacttgggggtgcctcccagttaggctactcgggggtcatggacccacttgaggaggcattcttcccattctcagatctcaagctgcgtgctgggagaagcactgctctcttcaaagctgtcagagaagtacatttaagtctgcagaggttactgctgtctttttgtttgtctgtgccctgcccccagaggtggagcctacagaggcaggcaggcctccttgagctgtggtgggctccacccagttggagcttcctggccgctttgtttacctaatcaaacaactaactcatcaatggtgggcgcccctcccccagcctcactgccgccttgcagtttgatcttggactgctgtgctagcaatgagcgagactctgtgggcgtaggaccctcctagccaagtgcgggatataatctcctggtgtgccatttttttaagcccattggaaaagcgcagttttagggtgggagtgatccaattttccaggtgccgtctgtcacccctttctttgactaggaaagggaattccctgaccccttgtgcttcccgagtgaggtgattcctcgccctgctttggctcatgcacggtgcactgcacccactgtcctgcacctactctctggcactccccagtgagatgaacccggtacctcagttggaaatgcagaaatcacccatcttctgcgtcactcacactaggagctgtagactggagctgttcctattcggccatcttggctcctcccttttcagtatcttaaatacactctttttctctcacagctccaggagttagcatagactactgactcttcctagaatattttttatctctcttccttgtctaaataactcctaccaattatgcaagtctgaacaaaaacatttcctgactcttgccacactagattggctgtgcctatgtccatacttcctctaaatcatgtccaatattctttaagtcattacttaagtcattctatgaattccacctctatcactctccccattgtcaactccaggtctacgacaaagtctagaacatagtaagtaccttatatataattgctgagtgaacaaatgaatatacatggcgttatttcagaaatttctcttggctactttcaaacttactcttgttccttggcaaggctgctttggcatgtgattctcctgggtcctccccattttgctggatacaaggattttctctggtttggaagataagaaacacctaggcaaaaatgatatgtgagaaaggaaggcagccaattgcctatagttgggacataggctgacctcagcatttattgctttcagtgctaaataacttatttttaatgaaagaaaagattataattgttttaaaaaacaatggtaaaaacataaaggccatatcagatcataatgtcacagagactgtcaagcttctttacctaaattagattctttgcctaagataattaaaagtgatgctatatattctgaaccacatgaagtcctaagcagaactaataccaggggaaggccctgagttaatacataatcacacgttctgagtcaagaatcagaaaggagagagatctaaagcttatattcaagttagatgcagttaatttattatccctgaaggccaattattctaatcatttggagactgcgacaatgtggtcccctgcctcaagggagagattcatatactctcctctcaagaagggcccaagctttgcactcactgcccctgaaggtttccagactttttcaaagaaaaattttgccttcaaaagtttttgtgtattatgtagatagtagcaatcacccacattagtggtttagttttgttctctctcttttttttttttgagatacagaatcataaaaggaaaaaaaaagcctttgtctcaatagcttttcttatgatagctttttatgtgctttcttagagaaaagttataaaacttggttctttcagcttctatcaaagatatacaatgtttccttttttttgtgcaagtcacaaaggagccataactgtatatattttcacatcagatgtaaaattcatatctcacttgtgacttatgcaaggaaaataggaagctccattagacagacctacaatttgtctgtgaatagtgatttgcagttggggagtactttcttttgaaatcattaaatcttcacagctaagtattccttctgccttgacagattctacacattacctcatcatatgtataaaaatgatctttaaaaaatacctttaatgacttcaacaatggccaaagttcatccaacactttccatactttcaagaactacatttggaggcactttttatcctgtcactttgatggtgcataacaaaaagcttgtgtcagaatttcagtgtggcttcacatagtcttctcctgttattaagagatatttttgagccaaatgaatagcatcatcctcggtatgatattagctttaaaaaacctcctatatcttcaagttgcattgcttattgtagatgaaaatcaaatgtgtagttgaacagatataatttcaacagaactaaaataggagaaaaacagaactgtgctcttcctttccatcaaaactgacatctccattcattcttctagtgtagctaaaatcagtcctttgtttgtgcttgtgagcaataactctactctcaggttattattatagagaaatttgttttggataataccataattttaagcaaattaaaatcttactatgctctcaaatattttttaaatcttaaacacttacaaaaagaaaatgaatgaatcattcttgatttcaaatcagccatttgaaaacagcaaaattatttcattttccctaagttgttatgtactatataaatgcatatggcatattcataatgtcagtaaaaccttggcactgccagcaggctcaagaacactatttcatttaacaatagcttatgtttggaagtctttccaaacaagtttatagccactctatcaatttttacaaataattttatattccaaagctccaaataacttggaggcaaaaaatttaggagacttaaggacataggaaaggaaaatttaaataaacagcattaaactttcataatttgaagatatttttgtttttgaagggaaaacctgcactttccataaacttgcagttgctttcttatgcccatcctgcatgctttagcataccaaactatgtaaagttccactcatttgccttgctatctcatactgttctgtgtgttcatgtacatggattttcctgccaggaacattttttgcctcctgcaaaaattgccttcatccttcaagctcacctcacatgtcatcttttctgggctacattccctcaccttcctgtctaacataaatagtcttcttgactatgttctcttaatactgtctccttctgtatttggatcatttgattcagtttgttgtatttctaattaggtcataaattccttgagttattacagcattcactttgttttttatttttatataaattcaaggggtacaagtgcagttttgttacatgtatatattgtgtagtggtgaagtgtgtttagtgtaaccatcacctgaataatgtacattgtgcccgttaagtaatttcttatccctcacctttctcaccccctcccaccctcccactcttcccagtctctggtgtctattattccacagtgtatatatacacacacacacacacacgtatagacttacatgtacatgtgtatgtacacacatatatattacatatcatgtatatatatatatacgtgatatgtatatataacattttctttaatttccagtcagtcattaatggatactcaggttgattccatatctttgttattgtcaacagtcccgtgataaacatatgagtgcaggtatatttttaatatagtaatttattttcctgtaggtagatacccagcaatgaaattgctgaattgaatggtagttctttctatgtttagttatttgagaaaactccaaactgttttcgatagagaatgtgctaatttacatttctaccaactgtgtataagcattcccttttctctgcaactttgctaacatcttttttttttctttttaatagccattttgactatagtaagataatatacaattgtggttttaatttgcattgatctgatgcctagtgatgctgactaatctttcatatgcttttggccatttttgtgtctttttttttgaaaaatgtctatgcatattcttcactcactttttgttattttggaattttttgttgtttttgacttacttaagttcattgtatattctggatatcagccctctgtcagatgcatagtttgcaaatattttatcccatttttcaggttgtctgttcacgctgttgattatttcatttcgttgatcttcatttttaatacaggtccagagacctgtattatactatactgagaactcagaaaagttatactgaggagttaataaacatagtgagactgctcaccctgacaattgactacataatctctcgcattactgaaatcctcagggtttttgtttttgttttcttactattaggtctccttttttctcaggccatcaaaatgcagttttctctcctactgcaagaagtcttttaacatgccacctgtaatctcacatcgtgtatctacttacccctaacccaaagccttgtcttccatattacttttttttttctattcattctcgattcctttctctaggtgattgtacaagaagatgtaaagaaattaagactttattccagccaagtaaataaagtagcttaaaatggttaggcagaagccaggaagtcaatggatataccacagaaaattaagacattaagaatttaggtaaatggacaatagtaattttaactttagtcaccatggtttaaggttgtgtgtttctaggtaaataattaggggccaactataattacgcattgtgggctccaaaacacaaactaaggtagaaatgatccaaagattagagatagaagaaaaaaagggccaagtcagtaattttgtcttttaccatggagaaaatataaaaatctagatttaagaaagtaataacaagaagtagttatcctcatatgaaagaattaagttttcttttcagtgggacttgtctaatgctttaactatttttgcataaacaactggcaaaaatataaggctgacaaaaagaagtcattttctctccaaaatgagactggaaaccagtggtcggtgggaaaacacatactgactacctaaattcttttagatgtacatttattattaaaaaaaaaaaaaagagttctgctagaaatctactagagatgccatcacacaaacaaatggtaattataaagtctgatgatgacaaaatgaattttaaaagaaatttaaatgttaaaataagatttattcgcccaccaaaattgataattgaaaaaggatgacagttatctctgagaacacctgagcaatgaagaaagacatcaaacactttttttcctgttattaacatcttttattttattttattattattatactttaagttagggtacatgtgcacaatgtgcaggttagttacatatgtatacatgggccatgctggtgtgctgcacccattaactcactcataggtgggaattgaacaatgagaacacatggacacaggaaggggaacatcacactctggggactgttgtggagttgggggaggggggagggatagctttaggagatatacctaatgctaaatgatgagttaatgggtgcatcaaacacttttggtctatactgttttgatgtaatatctgattaatagaaaaaacaattatgaatccagcaaccaactggagaactaaaacagtaccaagagtaacaataattttgaagctcactgcatgatattctccaatcccatctgcctgtattctctcaagaggaaaccaacagcctgaaatatgtgttcataatctttgtgatttaagacaattatgttatgatgcatagatatatattttaacatacattctttatttttcttctttttttaacattgctaagattgcattatgacatatgtagttatttgtgatttgctttttttcttcaatctttgtttttaagatttctccatagtgttcaaggtaattgtaatttatttattttatctaataaataatcatctaatgtgtatacatataaaacatatgtattcattattctattatcagactttggattgttaccagattaatttttcccctattaaaacaattttggactgccactaataagcatggcagggtagtttgtaccatattaggcctcaattgtagactatgaaaaaaaatgaataaaatatatggaacagttgttgtcatatattggataacaggcattgcaggaatgtgatccctcagagaataaaaaacagtgaagttaaccattatcctagtgtttttccaggaatttttttttatcagaaactgacccagataggagaaatccaagatgatcacaagtttcatagagctgaaaggacagagagggagatcagtgaagctgaggtgactgaaatttatagggcaagtaacaggaatagaggagttacacaaagaacaacttccagacatctgcattaggatctcattgaatatatgaacaaataccaagctatgagtgtacagggcggaaaaactaagaaaaactagtagagaaggaacaaaaaaaacagaaaacctgaaaaccaacaaagagccagatattgaactgggttgggaaatcttcaaactccagttaaccacataaaacctctttgaacaccatggttcactcagtagagagtgaaaaaaagaccaggtcacaggggtagggttaatctagttctaaaataaagactatttttaactcaccctaaaaaagattacaaacaagttttacaaggattaaactaaaccacaaataaattagctgcatgccagaaaaaaatttgccaatgattaaaggacaaaaacaaaattcagagacctgataatgtgaagcctctaataaaaattggtagaaatgtgaagaaactacaacaaaaagaatatatggactataaacaggagataaatcagtcaataaaacattcccagaaatatcagaaatgttggaataaacaaagtattttgtggcagctcttaatatgtttagtcattgtgatggttaattttagatgtcaacttgattgaaatcagggatacccagatagcttataaagcataatttttgggtttctctgtgacagtgtttctagaagagattgtcacttgaatcagtagattgagtaaggaagatttaccctcatcagtgtgagaggacattatctaatccattgaggacacagatagaatttttataaagaaaaaagaggcctgaggcggtggttcacgctgtaatcccagcaatttgggaggccgaggcgggcagatcaccaagtcaggagatggagaccatcctggctaacacgatgaaactctgtctctactaaaaatacaaaaaattagcccagcgtggtggcgggcacctgtagtcccagctactgggggtgctgaggcaggagaatggcatgaatcccgagggcggagcttgcagtgagtcgagatcgcgccactgtactccagcctgggtgacagagcgagactccatctctcaaaaaaaataaaaagaaggttgaatttgcactcttttctggagctgggacatccgtcttctcctaccatcagacattagaactaaagtttcttgggcctttagacttgagggcttacatcagtggcccccaatttctcaaactttcaacttcaaataaagttacatcctcagatcccccaggttcttctttggactcagactggattacatcaaaagctttcctggttcttcagtttgaagacagcatgttgtgggacttctcaacctctataattgtgtgagccaattcccataataaatacatatatgtataaatctatctcttgttgattctgtttccctggagaactctaatacagtcatttaaaggaaaacatcaatataatcaagagagaaatagaagttatctttatgaaagttttagaataaaaaaagtgaaaaaatgtactagattggatttacagtggattagacactgcagaagaaaagatcaatgaatttgaacatagagcattacaaactgtaaaatatactagataaagagaagtaaaatggaattataggtattgctttatggaacaattagctacataacgtatatcaaggtttagtctcagaagatagggatagaacaaaaatattttgaagagtataaaaatatattatctgtattgttgtaaaacttaaccctacagatctccaacgctcaatgaaatataaacagggtaaaaacaaagaaaaatgtgggaagatacaacataaactaattgatgaaaaacaaaaataaaaggagaatcttaaatagttcacttggagttatgtatccagtgaaaatattcttcaaaaaattaaatacatttattcttttaaaaataaagacatttttagctaaaataatttgctgcaggagaaaacaccacaagaaatgttaaggaaaattatttagattgcaggaaatgtaatactgttttaaaactccacaaaaaaagagcaagaaatgtttttttaaaatatatgtgtacatataaagtatatttgctgtttttaatttctaaaattttctatttccacttgttttgtaaagaaaaaatataataatgtgttagagggtttgtaaagtatgtagaaataatgtgtatgaaaagaatggcacaaagggtaggaaggagaaccggtaagcataatattgtcagattcatatcgcaaactttaaaataatcaaacacatagcacaaaaaacaaaaggctgtattaaataaactagtataagactaaaatgaaatactaaaaactaataaaaataagacaagaggaaaaaagatatgaaaactgatgggatagacagaaaatgtatattataatgctagacttaaacccaaccacaggtaattatattaaatgtaaattcacaaactaaaccaaagaaaaacattgtcagactaggttgaaaacaccaaaagcaacggcaacaaaagccagaattgacaaatgggatctaattaaactaaagagcttctgcacagcaaaagaaactaccatcagattgaacaggcaacctacaaaatgggagaaaattttcacaacctactcacctgacaaagggctaatatccagaatctacaatgaactccaacaaatttacaagaaaaatacaaacaaccccatcaaaaagtgggcaaaggacatgaacagacacttctcaaaagaagacatttatgcagccaaaaaacacatgaaaaaatgctcaccatcactggccgtcagagaaatgcaaatcaaaaccacaatgagataccatctcacaccagttagaatggcaatcattaaaaagtcaggaaacaacaggtgctggagaggatgtggagaaacaggaacacttttacactcttagtgggactgtaaactagttcaaccattgtggaagtcagtgtggcgattcctcagggatctagaactagaaataccatttgacccagccatcccattactggctatatacccaaaggactataaatcatgctgctataaagacacatgcacacgtatgtttattgtggcactattcacaatagcaaagaattggaaccaacccaaatgtccaacagtgatagactggattaagaaaatgtggcacatatacaccatggaatacagtgcagccataaaaaatgatgagttcatgtcctttgtagggacatggatgaaattggaaatcatcattctcaataaactatcacaagaacaaaaaaccaaacaccgcatattctcactcataggtgggaattgaacaatgagaacacatggacacaggaaggggaacatcacactctggggactgttgtggggtggggagaggggggagggatagctttaggagatatacctaatgctaaatgacgagttaatgggtgcagcacaccagcatggcacatgtgtacatatgtaactaacctgcacattgtgcacttgtaccctaaaacttaaagtataataataataaaataaaaaaaagaaatgagaaaaaaaagaccttataatatactatctgcaagaaagcaactttaaaaatgattttttatatatgaagatatatatgttaaaagcagaaagattaaaaacgtgtaccatgcaaatactcatcataggaatgttgaagagagtatcttaatatcaaagtataatgtagcacagagtgttgcctaagataaggatgaacattttatgataataaaaagattaacttttcaagaagacattcaaatccaaaatgtatatgcacctagtaacagagctttacaatgtatgaagcaaaagttgacagtacttaacaggaaattgatattttactataatagttggagattttaacactcttctctagtaatttatcaattacaagaacagcaggacagaaaatcagtaaataaccttattctccagtaatttatcaattataagaagaacaagaagacagaaaatcagtaaagtacagaagacatgaacacagctattaaccaacttgacctaattgatatttaaagaactctaccaaccaacagcagaatacacttatctgcacatggaatattcaccaagataaattatgtgttgggccgtaaaacaagtcttacccctaaaaaagactaaaaacgaagagcgtatgctctctaattgcaacaaaattaaattatgtatcaataacaaaagaatactttaaaaatcaccaaatatttagaaattcaaaacacacatctaaataacaaaatgatcaagaggaaatcacaaaagaaagtagaaaatatttttaactgaataataatgaaaacacaacatgtgtgtgatatagttaaagcaatacttaatggtaaatttttgtcatttaaaagggaaaattcaaaatttaatgatctaaacttctaccttaaacaaatggaaaatgaaattaatttaagatgaaagatagtagaagaaaagaaagattaagtagtagatatcagttaaattaaaaatggacagataataaggaaaaagtaaaactcaaatctcatttttagaaaatattaataaaactgatacacatcaaaaacaagagataaaatttaaccaatatcaatcatgaaagaggaaacatcactacgtctctatcctaaaacatttaaagtacaggaaggcaatgttaactgacaacatttaattttacaactaggtcaaataaaaaagctccttaaaataaataattcttataactggcacaagtagaaacagaaaatatgaatttttccatatctatcagtgaaattaaatttgtaattaaaaacccttatactataaaaaattgagtcccagttagtttcgttgatgaattctatcaaacatgtaaagaagaaattatataacgtggccaaccaacttggatttatctcaggaatgtacagtgttttaactattaaaaagcaatttatataattagtcacatgaatgggataaaagaaaataatcttacatcatcttagtaaatacagaaaatgcatataacaaaatccattatacacgatgaaactgtcaaatatgtaggattagagggaaactttctcatctaggaaaaatacacctacaaaaagtcaatattcagcatcgtaatggtaagagactaaaatatttcccctttccttttatcaccacctctgttccacacttaacgggagacctggacagtatagtcaggcattaaaaataataattatggctttgagatggaaaaggaaggaataaacctgcctctgattggaggtggcataaatgtgtatgtgtattttcaagaatctacaacaaaaaccctaaaattaatatttagggataaactaaacaaaatacgcagaagacctgtacactgagaatttgcataacatttatgagagaaataaaagaataccaaaataaggagatataccgtgttcatggaatacaagactcaatagtgttcagaagtcaattctctcacagttgatatatgtattaaatattatccagtcaaaatcctagcctgcttctacttttgtgaaatttagcaagctacttctgaaacttacatgaaattcaaagcatatgaaatagccaaaggtagaaaaagaaacaaacttagaagacttgcactacttaatttaaagatttactcaatatttattctaaaagtaatgataatcaagaaaatgagacattggcataaagataggcttatagattaatgcaacagaagaaagctcagaaatttacctgccttctaaagtccatcaaaaaaatgccactttattcaatagggaaagggtaatattttgaataagtagtgctgaaacaaatggatatcactgttaaataagttgatcctttaaccatatcctgtaccataaacagcaaataaacttaaattggatcatagccctaaatgtaaatctctgtattctgtatagatttctacatacctaaatgtaaatctatgtattttctatgtattctacaaatacatagaacaatatctcactttttactttctggagtcagaaaatacttcttaagacagaaaacgaaaaaccactaagaaaacaataagattaaaagaacttcatcaaaattaaaacctgcttttgtcaaaagacaatggtaagaaaataaaaaggcaagctcagattggaagaaaatatgtgcaatatatatttgataaagaacttgtatccagtatgaactaataattcttacatttaatgctgggaaggaaaaaatgcaacataaaaaatgaaccaaagatttgagtatgcgaatggctaataaaaacatccaaagtagctccaagttgttagtcatcaggcaatataaattgaaaccacactttagtatcactacagtactacaaaaatgactaaaattaaatgattgacaataccaagtattttcaaagatgtagaacaactggaaatttcctacactgttggtagacatgttaaattatacaggtacaatggaaaaatagtctggtaagtacttatacagttgaacatttacttaccgtacattctagaatttctatgctttttacttaccccaaagaattaaaaatgtgtgttcacaaatacttgtataaagttttattcataatagcctaaaactgaaaaccaaatgtccaacagtcagcaggcgtctggataaacaaactgtagcatatccatatatcgatatactcctcggcgattaaaaggaattaactaccgatgtgcacaacaacttaaatgaatcttataaatcttacacagagagacagaagacatactcaaaatactacgtagtgtattattcaatttacataaaagtataaaactggtgaaagtgttcctaaattatggacatcagctcattgattgcctgggacatgggtgaaataattgggaagagatatgaggaagaacttggggtttataaaaaatgttctatatcctaattttcctgattgttctcatggtaaaggcaagggtccaagagtgagagcagcacaaaagaattaaagctacaatatagtggccaaagcaaatcataaggcaagccatactcaaagcatgggttaagagactccattttctaatggtaagatgtgcaaagttacccagtgaaggatgtgaatacaggcagtgatggagaattaagaacagtttttcaattaatctgctatactgaccaaggtcccacattttgcattctttctattttcatttattctcccaacaacctaaccagtattttcctgagctcatgtctttcttctaataattcgatgaatgtagctagtaataatcacacatttttaacgttctgtcttgtaactccttttctaggtttagaagcgtttcagattacctttctaagctctcaaggatgacagttttaccaaatgttttccgctgcatagcatgacacttcatctcctcattctccagtatgcattcgtttccatcttcatcctcactgtcatggaaattccaaatatttactgtgttgttctgtcagttacccgttttcatttttatgtattaagttctatattagtaagataatgctagaaggcataaaaaagaaaccctagaaagtctggagcttagcaaggtatacatttatatctcattcatgtaacatctgacagaatgttattagttagcattggtgaggtaacaattttgtacttttctctacacagtcgtttagaaactcagtcctgctattttcaacttgttacttacaaatttattctgggtattgatatcaaactgcccaacaaaagagtagagagtcatagatttttaaaaacaattcttctatacttgattgccagaaatcatcatagccgtagcctaaaaaaaaaaaaaaaaaaaaaaaggcaaatgtatgtccaggagaccaaaaaaacaaaaaggattttggaaagagatgaggtttccagcctttgctatatacctcatttgtttgtaaaattatactcgtcttttctactattttatgattttgtcattaatttcagtatttatttctaaagtcagaagctcatcgatatcttaaccatcttcctccccaaaatgaaagaacttcaggacacattagcttatgacttcttttttttcattacatgctctttttgatcagtattttagtactgtccctttttatacacacacattatttttattgctgttgctattactattatttgtgttttttcttaccacttcttgcatcttaaactttctttctggagtcattattctccttcttgaagtgtatatcctttagtaatggtttattggtgaaaaacttgttcaatatttgtagatttgatatctttatctcctttttcactcctaaagaaaaatttacaggatacaaaattattagtttataggtgcttttactctcttttccgctatattgaacataattgttccaacatcttttcctgcttccattgctgctgttgaaaagccagtagacatgctaatcattgttattttgtaaattatctgtctccctctctggctacttttaatatatgtcataggtgttctgtggctttagtcatgctttgtatatattgtatttcctgtgcttatggattcatgtccttcattttaggaaaattgtatgctgaatacttttcagatattacatagtcttctctctctctctcttgctctcactctctcttaactctatctctatatctattatcttagattggacttacaccctctagctttatactacatgtctactaactgatgcccatatttatgtattttctgtctcccttcctctcagtgcctcattctgtatatgaagctgtaatctatctatcacttttggaaatattctcttcaactatgtctaatttgatgtataacccagccattgagctttacgtttatgtgattatatttttgtctttaaatgtctattttatttttaatctgaatatttacttttattgtcatatcttccttgatcatttttaacccatgactatttttactccaagttttattgctgtgaacgttcaatatgaagttatgtgctgttctgtattttgtgattctgggataactgaataagaacaatttaataaattggagcaacaaaatcaaaaagtaaaattccactatcaaaatacgcagattaccaaatatagcttttaagtcaaaaattaaatctaaccatttgccatttagaggaaattagattaaaacaaagtgacataccatgaaaaaaaaaagctaaaaataataggataaatagacaatgagcgtgaggttaatggagtgtttcttaaaaggataacttaaagcaaaaattagaaagagggccattgtatttggtaaaggataattacaactctaaaaataataataacttttatgaacaggtattttcagagagaaaattcatcaaaacacaaaataaaacttatataagaagatactggtagtaatgatagtagtgggaaattaacacacctatctcagtctgacagatcagtgaagatgaaaataaagaggacatagagtagtagttttctggggagtgaggggaggagtgagcagactccaggaccctttttcctgcttcaagcagaatactttgcatctattgatatgggttattttagtgtacaaggattccataggaggtaaactgttctgaaattattaaaaacatgaaagcaatatctgaatgacaactaacaaaagctatataaaaactaatttttaaacttttatcataaataaaatatacttttttcccaataacatggaacttgtaccaaaaattaattctgtatgcaaagattctcagcaggttcctgaaagtagaaagtgtatatcactctgtgtatcaatacgtatcatatgtggccatacgtttgatgtcagcataaaagatagtcatatgattttattattaatcatgaataataattatactgatcattcagctcaaaaagttaaagtataataggaattatatataaagtataaatatatacattatatataaagtataagtatatacattataaagtataaatatataaatatatataaagtataagaggaattagtaaatttaaaaacagaaactcatgaattacaacaaaaaagtaataaaaacttaaaatgcttattttagagaccaataaaatagacaaacttctgtcatagtcaatcatttaaaacttattatatctatcatttattgggtgcttacaatatgccatgtattttactaagtaatttataataatttatctcacttaatcttcaaaatagtattttgacaatcattcattcacttatttcataagcatttattaacaatataccaaacatatgaggcactggggacatactgctttaacaaaattccactgccctaaagatatttgcattttggaggaataaacaaatatcttcattttacagatgagaaacaaaatttagagaacttaggcaaatttcccgaggtcaccatagcatctttgtgcccaaatcatattagaacccaggtttctctgaaggtccgtgctcctaaccaatatgtagtgttatttctgtgggggaaaatacagaaaacatatattcataccatataaattataaagaatatgcaaggagcatcattatattattgtaaactagggttttttgcctgctactttgtgccaggctgtttaaatctttcaagattcacaactactctctgacataagtcgtaatatttccaccatacgttacaattgagaaacctaaagaaatgaaatgttaagttacttgtagttgcagagctacctctatacccagtcagtctggctgcagaacctacacttaactactagaatatgtaaccagctgtgattaagactgttttaaactaaacaattacaatttatataacttgctgctaaaacattgaaattatagataaaatagttggttttctagtgaaatgtgaattgccaaagttggcataagcagaaatttaaacaatacaatcaaggaaaacacagtcaaaaaactaactccactgacggtggcagacccaggtaactttgtgagaatcctatcagtatatgaaggcaaatataatttccctacaatttaagttgatacagaatacagaaaataggaatattctggcttgtttaccaagcagtcactcaccattatgctactgcatctgtcaaagttatccataaacaaaccatgaactcaccaacgaataagctcacaaacaaccttaataagctacagacaatctcacctctgaatatatgcaaaaattctaggatctattaaaagaataatatgtcagactcatataaaggatattccaaaatgcaaggttcatcctttctggacattgaatacatgcacctacaccaacaagcaaaaattgccaactccttcatccagcaacttcaattttatgttttattcctaaggaataaagcagaaaggtattcgaagatacgtaaggatgtttatcataatgtcacttataatggagaacattgctatcactccttaggaaaaaataataggaaaacatcttacacttaacggttataatctatggtagactgttacaagagacataagtaagatacacaaagcattttgttatttaaaagaaaaaattctagctggctacacaaattaggactttgctgaagaggaggcatttaggacaggtctcagaggatgagtagcattttagcagatatgattggaaacacagacggatgtgtttctgggtcaggagatccagaaagaagtagtgagaaatcaaactgaaaaagtcgactgggtccaaagcatgaagtgtattaaatataaatagtactaaataaatcagtggaacagaattgagaagcctgaagcagattcacatatgtgggaacaaattatatgacaaaagcaacattttaaatattgtgggacacggagttttacttatttaatgatgctgaaataatcacttacattccctatgtcacatcaataaacaaatatagtccagttgggtgagagatccaaacattttaaaatgatacaaaatgctaccaaatacttcagaaaatacggacaaacttaggtttatagataattttctaaacacacaaaaaatcggaagtcaggaaggaaactatagacgtgttttcttctcgccaaaaatgattataaaattgtattacaggcaccatcataaactaacaatacactggggaagaatagttctatggccctaaaacacaaagaactctaagaaattaacacaaataagcgaataaagcaagcaaaataataaaaaaaacataagcaaacatttcacagaaatgcaaatgcaaatggccaataaaatcatgaaaagatgttcaacctccttagggttcaggaaaatattaagcaataaaataccattttttgccctataaatactaacaaagcttcaagcagattgatcaaatgcgatgctggcaaagatatagggaaacagtatcacatattaccaataggtagggaaactgcttgtatattattgaaaaacaatttggcagtacttattaaaatggaaaatgtgcatgtcctttgatccatcagtcctgcttttgtgaatgactgctacagaaaatagaatagtacgtgaaatatgtgcaaggttatttatagcagcattgatttttaatgattaaaaaaagaaaaatgccgggcatgctggctcatgcctgtaatcccagcactttgggaggcctaggcgggcagatcacttgaagtcaggagttcgaaaacagccttgccgacatgatgaaacaccatctctactaaaaacgcaaaaatgagccgggcatggtggcagcacacctgtaatcccagctacttgggaaactgaggcaggagaattgcttccgagaggtgcaggttgcagtgagctgagatcgtgccactgcactcgagccttggcgaaagagcaagactctgtcccaaaaaatattaaaaaaaaaaaaaaaagaaaaacctccgctgctttcaatgtttacctaaaagggggcagttgattaagctggtacatctatacaatgaaataatttgcaactattaagcagaataagtcaggctaattattgaatatgatcattaaataataaaatagcaaatatacaaaatttatatttaaaaaataacaaaacagaaatattacatgtgtgaacatatgcttcacggagatgaagtgggagattatgtgtaaactgtatttgctatttggccagaaaataagatttgcagtgttggaggcaggacaagttttaatttacttaattcctaaccctttggtttgactcattgcaataagcacatatatgttagtaattttgccaagttactgttgtcatttacaaaaacataacaattttttttcttttttttttttttttaagatggagtttggcttttgttgcccaggctggagtgcagtggcgcgatctcggctcactgcaacctccgctttccggtttcaagcgattctcctgcctcagcctccagaatagctgggattataggcgcccaccaccatgcctggctaatttttgtattttttagtagagatggggtttcaccatgttgcccaggctggtctcgaactcctgacttaaggtgatctgcccgccttggcctcccaaagtgctgggattacaggtgtgagccactgcacctggctaacaatgtttttaaaaataaatcataattggttacaacttatattgtcttttaattgctttcctgaaatatgaaagaaaaggaaattctttttataatctacttcccagacaacccacgtggaaagtgaaatatatcaaccagcacatggtccttaattgtgattacattttattgcactcagcctattaagtgcttaaattaccagataacagaatctatgttcctaacagtggagagtgtattaacagtatttttgttccctatcgtagccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacagtaagtgttttcagcaaagcatgattgctctagtcccaaaagtcaaactgaaagtggaaattaactttaactaaatattgtttgttaggtacataaaaaccaagtaataatttataatcatacttcattcgtatggtaaggcatcatgtcaaattaccctatacatagaaatgatttaaattataaatgaatggggaattatcggtgtctttgtacagcatacagaacttacgtccttaaaaatgagctatttccctggcaccagcactatactctgacaagttaaaaatcttggaaaacttattaacttattctacaacttggccagaatcagaggttccaatctagtgtccatcaacgagatcctgcccaggtgccattttttgtaaatgatgttggaacaaagtcacacccacttgtttacatatcacctgtcagtttttgcctggcaatggcagaattaaatagagacagagaccagctgacttgcaaagactgaaatatttgcttttgagcatttttcagaataagtttgctgacctgtggcctaaattaatacatctgtatgataaatagcccctacagcctgcaagtgtttatattgtccaaaaatgccagtcaaccaggttgtgtctaagaattaggaaaatctcgttcaaaagtttttacaatctcatctttacttctaaagttcaaagttgtttgtacttttcatatttgatttacagtatatatataatgggtaagttagggtattctcattttctaggtgaggacactaaaaagagaagcaataggctagagcattgaaataagcaaatatagatgctttgaatatatagttatccaaatttcatattggctgtttcctccaggaaaccatgactgtccctgtatctcaagatcagttccaaaagcttaatgccctttacaggaactcctaaagagtattttgaaatattaataactgaattcaaccagtctttcttcatctttaacaactcctttaggaatttagcattctaaccaaattgattatgcattgcacattttatccattcattcattgatacagttaatgtttgttaagtgcctcgtactgctctacatgccagcaatagagccttgaagtaactcatgatccactggactagaggaaaagcaaactccacattagagtggagcattctgtgtgcagtgataaaggcatgtgaagaggactgtgggaatgcagagtctactgcattctactcagaggagtcaggaaaagctttagagaggattggtaacttaagagctaaacaggggagagcatctggaagaaaaggacatagacatttaaatgtttctaagattgaaatattagtagtggtttgattgtttttaggccatgaatatttggatgaaatccacaaagtttataactgttcataattcataaaacaaatcattaagacaacgctctctagccatagggaaaagtttttttctgtaccccagtggagcaaagattaatgttaaaatacacgttcattttattctcacaccaacagtttgaagtattaccatccctctgtacagataaaaatctgatactgaaagacaagtgttgaaccggaactttactactgaaaatcacaaataatgtaaagcatgcctgttactctgaaggctatcagaggaaagtacgaattctctgtgttcgaagaatggcccacacctaaatagaattagattgtatgttctagggactgaggctcctacatagcatgactctacttactcctcccttaaccccagctacttaattcataggtaatgatgactgtttccagaaatgtaaaaaaaaaaattgctttcactccttattactggtgtacattctagtgagaaagtgctacttaaacaatctggggtgtcgttgtcatgcactgtaggccatctgggtaaagacaaacctacccaaagcgtgcatcactttgaatagaaaaaaaaaaaaatctagattgttccttagaaagagaaactgggctggctggctacttggcatatatttgtgacaggtgtggaatatatcttgaaagcatgtgaactctttcttcagcccatgtttagggtagctttctaccaggctccatcaggaggccatacaccttgctttgccctagaaaatcccactttacatctgctgccctatgacaattatgaagagtgtcctatttcacttctaaaagtatcttggtaactaggtgtagtggctcagacctgaaaattccaacactttgggaggccatagcagctgaacctgtctctaaaaaaaaaaaaaaaaaaaaaatacaaaaaattatctgagcatggcgttgcactcctgtggtcccaaatactcagaagcctgaggtgggagaatcacctgaacccagaaagtcaacgctgcggtgaaccattatagtgcctctgtattccagcctgggttagaccctgtcttaaaaaatattacaaataaaaaataaaagtatgtcggttatcatgtattcatccaacttttgtacttttaaaactgtcatgttagacatgagggctttcctccccatcaaactctgtaaagtgtagataggattcagtcatttccacctgactggcagtagatatggatagcatgatgaatggatgtttcactgtctcatggtttatatttagaatattctctcaatagaatgaattactgtaggaagctctgtaattgggattctatctgttagaagtacagactacccattttatccaaacagtcagtattcatgtagtactgaaaacaatggtagcacattgtttttgaaagtacaattgcaagaatacttatgcttagctattagtttcaaaaaatgaaccagggatctaaggcagcatttctagtcccttttcttggtcaaagcattataaaagtgctatatagatagtacacataagtttaagctgcagattttactgtttttaattcagtatctacattgtaaacataaaacaacaaatgatacaacatcaagaagtccatggtagttaaattaaagttaagatacacttacatgtctaatataacataaataggtcttaaaagtaatactcataaaaaagaaataaaacttggaaaaattaaaatactaagttttggaaataatttgaaccttagcataaactgcataaatattctatttggtatgcctttcttgataataggattttcatgggttaagtcatttctttggctatttctgtcccctctagtttctgacgattgatgaaaaagacctggttttaactcatcatataaaattttgtttctatagttctaatgcaagttgaactcttgcttggtaaagttctcaattaaaaggaaaagaaataaatgacaaaatgacaaaagaaatgcagaacaaagtaaggagaaaaggggtaactgaagggggaaagatggaggcaggaaggacaaacatcatttaagcagttttataaggagttctcaaaatgggaaatattttatgtacacaaaaatctcattatataaagatgtgtgatctgtgagtttaaatgtgtatcatgtgcgtcaccaactagtaacttgtcactctataaagacggtcactatgacctctagacagtttatatttactatttcaactagaattgtatcagtattaaaatattcctttatccagaacgcttaaaagttagttgtactgtactaaatatccagtaaaggaatacagtttcattttcagtgtagagtggtattatagatttccttatcttcataaaacctctggacagtatcctcacaaatgttaatcgcttctatcgtctgcaatttgattgtaagctctttcaaaatagtctactttttttttcatccagccctgtgaattctgttcagcacacagtggataatttttattatgattctatactgttataaagatgaatgcttaggtatgcacatcattttataatgtccactatgaaaaatagatgagagtcaggaaagactaaggaactaatgaagggaactaataatcaccaagagcttaccttctagacattactacgaggtgctttacatacattaactcacaataacccttaggtcttaagattcccatttgacagacaagaaactagacctcaaaatattaaggaacttattaccccaggacccattaataacaaatagtagaaccagaatccaactgaaactggcagtgacaccaggattcaaatcctacctccacccccaaggatagcatgctacttctcagtgagacactgagaacctgaactaaggcatgagatgagaatggcatcgagagcagataatttctactttctatatactatagttaacattttattaatgttacagaaaactgtatgatatattaaaatccttgccattagtttttgttcttttttcttttcttcaaaatactgtttatgtacgttaggtctgatctttaaagatgttttagctgttaaagtatattaaatatttactctaggaaatgatataaaattgttgattcctggttaataatttcatacctaaagacagttttcaatcctgttttatggagaaaaaattcttgccttgaattctactgttattatgaaagtgatgccatatgtatattcacagttgctagaaaacacatgggcaatggattggggggaaagtaaccaatatatattatcttctatcatcatggtagctcattgaaataggaattactatctacagcttacagctgagactcattacagttaaataactcattctcagcgacataatagagcaagggcatggtagcactagaatttgaacccatattcatccccaactgtataatctctccaatataacacattacctctcattggcctacagctgagagtcataatactgaaagtgatctatgcggataaaatatgttgactcctcaatacataagagtacagaagcaacaaaagaggccaataacacttagcatttatcagtagagagttacagaatttctaatgacaagagataataagcaagagttttctttatgcacatctgcttagcattttataaaatgtaacccagagactgatctgaagctgaaatgtattacataagtacggtgcatctggtgaggctttaacagctcctgggtttaaagtgccatatgtctcttcagttttccacatcctaaaataggtggcttgacaaaagctagattttaaaaagttattaggtttgttttaaatgtggcccaacctgtgatttttctttcccagacagatgaaagactttccataatgcagaccacgtcttggcatctgctcaccccatgttattattcagaagccaaagccaatgccctttagttacttgcagtcctctgccaaaaaaaaaaaaaaaaagtttaaatgtaaccttttatgtttctgattttatgttaccagtaattttgttgtttttgtaagaatcttgcaagtactgtactgtctttttcagattacagcctaagacaaattatttcaggccttaattcagtttttaatgttttattttaaaaattttaccactgccctttcacataatgttttttgcctcggaccatatagtatagacctagtggtttataaaatatcttgcaatgtaaacaagaaatctgttgtagaagtcaagctgatctagtattgaacataacctacattttccatgtattttgtgaaggatagccattcataaattcccatagccttaatgttaattaatgtttattcaattatgacattaaatttatttttctaatgtagagcttaacttcattgtaacacaatctacaacccaaattccacttgtgtgtgtgtctgtgtgcatgtttgtgtgtgtatgtttatgcgtttgtgtgcttgtgtatgtatttgtttggacttgcttgaaagcttttatatcaagtcaattaacaagcaggctatatatactaactgcatatggcatcttaagcagccaagtgacatcaccaagttatgccatttcaggattttttttttttttgctattatgcaacatagagataaagctacagaagtatagctcttacacataacaacatagtttggtacaaaagattcacacacaaggtacagtgttcaaagcaacaaaatatgaaatgacatctgtcttttatctgccaataattgacatactgatagcattttttcaattttgagggcagtgtaacaggccacttttacttgtagaattcttggtagaatgaatttgaataacattttaatggcctttcacccactagagtttgagcttacagcaaacagatatgatagcacatttatgttcgtatcttcagagtaagcattttacctataatggtatccaaaaaaaaaatctaaagaaaggaaggaaaaaattaattcatatttgtattaatgtcattaatcatatgtttgattcctatgaaaaatttgttttggaatcaggactctaaattttttcttccaatttctaatggattgttttctcagatgtcaaatctgtttttatttaaatattttaactgttctttctttcctagctcttcatttctgtaacttttaaaaatctcttttgaagttattttaaaggctacagtcatggtacatttagagatagatcaataagtctaacaaatacaatcagttattataggtaggacactgtttcgcctaacattaagtttagaatcatctctactcttaatgatctcactgtctagctgagtgtcaaattctaaccaactaaaatattaaataacaatttaagtcagcaacagaagagaggtaacaagctacgacatgaatattttccaaacgaataagaactacaggtgtccagaggaggtgcacatgactcttctttgaggctgtgattaatacctcttacttaatttagaataaacactgaatcgtgagtagaattaaaagagacagaatagaagtagaacactctatgtagagtgaacagtttaaataaaatacagtgtgtgcttgggagataacacaccagtttatctggcttacaggagtcatgcatagtgtaaagtatcctggcagattagtaaagtttacagaaaagccagatgtaaaagtagagtttaatattgtttgtgtatctcatcactcctatcagcattttagcatatatgacacataactacaaagagatgatttccgaaggcaggtacaaaaatcatgatgaatatttgaaactcactatggtaaagatttttgaatgatagcttgcaggcttagaagctgaatcacagaatgtattccaaggtctacaaatcctgactatgctatgccaaagtggggcttctaaagtctagactatattggccagaagaccagtaagctaataaaagcaaaattccctcttagaaacaagtaactaactttgtgaccttgggtaaatttctttaacctctttgagtcaaaatctgattcataaaataggacatgtttgtttgaaggatgaatgttacagggattaattgagaatttggctcagtgtctaggacatggtaatgactagcactagcatttaataaatgtgagttctttcttgctctttctcctccctgctaaactggctttggtttcggacatctgctactccgttatacccactattctgacatgcatgtgtagttttctttattttttatttttcttttttgagacaggttctcactctgtcacccaaagtggaatgcaatagcatgatcacggctcagtgcagcttcaacctcccatgatcaaacagtcctcctgcctcaaccttccaagtggctggaccgataggcatgtgccaccacacctgaataatttttttttttttatttttagtagagacaaggtctcaccatgttgcccgagctgggaactcccaggctaaagtaatccctctgccttggcctctcaaattcctgatatgacaagcatgagcaccgtcccaggtccaacgtgcagttgtttaatacatcttttttcacatgctctcctcttccttggcagtgacattagaccacctctaccgcagcaaaaactcttttagagccgctctgtttctgtattcttaatagcctctaagatcgaacaagaactatgtagcatatatgaaacaacatataaatgaatgaatgatcaaagccctcagtagcacatataaatattttacagtttttgccaaaaatgttgttagaaataataaattcagtgcaatatttttatacgtatttctttgactgttttaaacagaatatttgtaaagaaagagtcagctttattcaacatttttccttaaaaattggccaatagtggaaatgaactttaacttgtatcttaagatttcatataattacaacagtatctcattcttaataaaataaattttcctctgtaacaattttgcacaaataaaaaaattatattgcaagaatgtaaattaagaaaaattttacagtgaaatctggattcacaaatcatttttccaaagtcattcaggtgttatatatatacacagagagatagaaacaagttgagtagatacactgtatatttctacccgtgctaatgctgccccactacattgaaagagcaattgactctagtacctgacttcctattaaactggttcaggtgccttggggataactaaaccacttaaagtccaaaaaaaaaaaaaaaagaagaagaagattttgcatagttaaaatagcattttatattatcaaaatatcttcactgctattttttgggggtacaggaaatagaattttgtgtgtaacgcaatgctgtgcttcttcaaaatacctatggttgaatgaattgcttttaaaaaaatacgttgaatttttccatgtaaattttaaacttggtaaagcgtttgagaaatgaaatcatccttgtttactgcttacatacttacagcctacccacactgggtagaaaaactgaatgatactcagttagacagtgggagccctctccgatgggaatgtaaggctactggaaaacccagacccacgtatcgttggctgaagaatggagtacccctctcacctcaggtactgttgggagttattaacctgttctgctgtaattttagcgagatttcacacaggacaaactaggcttctttagtcttattgaaagccttttcctgtttctgattcgtataataggacatgtttgtgttaaggatgaatgttacggggattaactgagaatttaactcaatgtctgggatatagtagtcatatattttaatatattttgagtgagaaacataacaaatatgtaagcattttaaaattttaattacctcattacattttttggtaatacagtgtttctttaaactgttttcaatcctataaatttttatgaaactatcaatattatcatagatttatttccatttgtagctaacctttagatatcacctaaaattgctcggtatcttcgttgatagacaaagcactgccaactaagagttttttttttaatgatttgcttggcattaagtagacaagacatttggaggtttaacaacatttaaaatttaaatttgtttttgaaatatgctcttgacttgaggttaccttaatttgcacatgctcaattttttgttttttatactatcttatgatactgaagtatattgtctgaccaataattttatctagaatcgagtcacaaggcagttttctatctgtgttagttttttgggaagtgagtgaaaatggcaaactcctgattggatccatatagtaaagggattgttcttatgacctgggctatttttaaccttgatctcatgtgtctacaacctcagtcttttctactatatgaatccttctttccctttgtaaacggaatgcaaataaaagcatcacctgctgattatatttcacaagctcaactagtgtaccaaaaaagacacctcactttaaaaaccaaactgaaagtaaaacttgtcagaataactacaaaaaaattgtaatttctttttcaaccaataaataactataatttacaagtggcatgttataataaaataatgaacagtacatttacattgctaagtggccaaataatgtttaactgtattaattgcaaacttgttttttcttagtctaggagagaatacccataaaatccatgttatttgtttactttctagatctaatttttttaattccattacagagtagggttgagatggttaatggagtattgatgatccacaatgtgaatcaatcagatgctggaatgtatcagtgtttggctgaaaataagtatggagccatttacgctagtgctgagctgaagattctaggtatgcagtttctaagtgaataaattgaaaaaaaaaaccttgcttcttttcatgctctaatttttactatactgaaggtttatgatgtggttgtaaaaatctattttatggcttgaaaagaaatactatgtcttgctgattttttttaactttagtagacaggtttatgttgtgtatagttcgtcccataactttttgttcatatagtttttctaactttagttttaatcttaaaaggtttacacaatacgtctttgctatagcacttaaaaaaatcatataaagaaatacatgttaacttccaaggaagaatgccttgagggtaggagatcagaatatagaattccagcagcctgtccatgctcccatagcaatgcttaataatttcccaggcagttcctatcagtagctgtgtggctcctgcaaagcaagactccaggctaaatcactctctcctcatggggcatcaactaataccttccttacttaacagggaaaggcttcctgatgccaggcactacaatctcatagggttacacccttgataagaatgtaacccaggcactgcatttcttcactatttaaatactacaggaaacaatccatccagtgaaatagactacccagaaaaagcatatatgagccattggaatgaattttacttttcccactttgattttttcctaaactggttcagggatgtttgtaatgtaaagaaagatactcactcattgtctttccaaagcgggcagaagcccaagtgtgttttctattccccatttaaatttaaattctcaaagcataacttaagagaaacaccaaagatctcaggaatcttggagcccaccatttacatatcagctaaatgtaatacatcctaaagtgatttgttgaattatgaatatttgcagttgaaatttctccacattacaacaaatccatccaaaatagttacaggattcttcctttcaatctccttcattctaaacaatcaaatgttaatgaactttcttgtcaactcacagtataatagcactgaattaaaaggctgattcacccttcacctagttagtagccctgaaacatttctcaaacccttatcattcacaagaaatattttcaaaattactttttgtaaattctattcccaggaggcaaaaaaaaaaaaaaaaaaaaagttacttgcaactatctcctcataaatttctttagctttttaactttttttctttgagacaaaatctcactgtcgctcaggctggagtgcagtgatgccatctctgctcactgcaacctccgcctccagggttcaagcgattctcttgcctcagcgtcccaagtagctgagactacaggcacccacagccacacccagctgatttttgcattttcagtagagatggggtttcaccgtgttggccaggcttgtcttgtactcctaacctcaagtgatctgcccacctcagcctcccaaagtgctaggattacagatataagccaccaggcctggctaatttctttggttttaaaaaatctcttaacctatctcaattctatacatatctttttcaatgttgtgacatgcattatgttgctatatgatatattttatatatataatatgaaatacatataatatcagattggtaaaagtaaatgtcacagatactgtggacttgtagacatctttcaggttctcttttagattcaaaagtgttttgatctaaattatagtatacacagtatttatgaatgaatgatcaaacctaagtgaaaaattacaagtaaaattgctaattgaaattcaaataattcaattttaaaaattaatttttaaacaatgtattatataaaacatttaatgttttataatattaaagtaatatacagaataaattaagattcgtagatgggaaatggaagacacaggattgtctttttcgcaggtcacctccatcttaccaaaggaaggtcaaatggactctgtcagttagccttttgctcttttgccaaggtcattcactagtctttcataattgaagttggtaatcataattagaacatgtcattttttgaaatagcctttacctgtagatcccatattgtatgaaatcacctgctaatgtactaaggtacatattaattaataataagtaaaattttgagctactgcctttttcatgtgtagatatactatgattttatgagaaatgcctcccagaagaaaaagttacaagatcttcatgaatcacccattagagattattgtcattgcttctggtagaaactaacatttgcttttttaatagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaaggttagaatctattttataattcaagttcaacattagacttttttgaggttacaggtgacacacacaaactatgcaagaaagagtcttgcagtaccgtgagacgtattttatgaactgattgaaacatggttttgcctatatagtgattttaaaagaacccaaagtttgacttcaaaatggtcagtcttctttgactccatggggttttagcataagttggatatttcactaggttttgaagaaagtactctttaattaaactaattatttttgtttgtttttcatcttgcttctgcatttaggaggtctacaaatcatctgtgataatttttaagcattgtgttttaatttgattttaatacaaatgataaaaacatatgtgaatcttctggataatcatgacagaatactttcatgtgatatttatgccaatgcttgtctttttatccaggtcatatttaggcaaaatagtataggattatttttagtgccataggcaaatgagaagtgagcagaggaatatttaatatgtaaacatttgtctttggcaactaaagccaaaggatatcacaggagtacaaatggagaaaaaatcatgagggaatcaaatcatcacatggcaatctatttgtaccaaattcaaatgttccatgtcctactattattgatatattggtattacaaatggtgattcaactttgacaaaatagtatcctctattatgtcaaaataatattgtactgtattagattttgtttaattgatctagaagtataaggagtttatgacttgttttatgtttgtcccaatctacataaaatataattaaaataatttaagtctgcattagcggttcacttgaataatttcttaagtaacagtgaaacattttgaaaaatttttaaaaatagagtatttttgttttccatcaaatctgagggacactgatttaaatagtctatttcagattaaacaatttttggaattactggcttcagcttagacccaaagatctatgcttcttggaaagggtgatcacctgggattgggatgggtcgtcgttggcactcttacaccaaaagacctatcataagggtcaaggctgtcattcaaaacaaaagacaggctaacaagagaaaaacataacacatttatttaatcaaagttttgtgtgacacaggggccttcagaaatgaagacccaaagacttagagaaaactctttttatgcttaggttcagtgaagaatagagagccgtgtagaaatatgattggacaaaaagtatgtgatctaatggttatagactgagaggggaaatccaccaaggcctatgtgttcagattcttcttggccattttgtgtggtattcctttcctccaggtgtaggacaaatcacctgtcacatgagacaattcaagggagaagggagaaggtcaatctttctaggttttatagtttgctttgacgaagggaagttatagtttctatgatctgccttgggggagagaattctggtttctatcattctcttcagtagagaaagaggagtttgaaacggacagatgggagaagatcaaaaatatcctgcttccaaggtcctttcagtcttcttcaggtcaaggtactctgtgccatattctggggtatcatgttctgagccccaacatcgtacaacttgttttaaaaagaatttctcattcttaggttggggggcgggtagcaaatgacaaattgtgagatcattgttgcctatgacagaattgatcagatagtgattgaatattagtggatttttgctcacaacactatgatttttaaaaaactgcacaaacctaattaaagtagaagaaaattgttttgttgcatagtaagaacaaataatttacactgctaggttattttttctggacgtattaaaaagcttacagtgtcattaaaatatatatgccttatctacgcaaaacattctatctgaaatgcatgactttgttttatgtttctgggtggcatgtgagttttgtcctatttatttcagttcacaataagaatgttcttcatcaactgttgaaaaatgacacatggtgagtttaaaaaattagggtggaacctcttttaccaaagcaaaagtattgagagaagtaacaggattatgagtattctattacaacaacataagcttactaaattttttatttttcagatgttgaaaaatacagtttgtgaatttttcaactttcttgtttctcttcctttctttactgctaacccttggggttagtgagaaagatacattgacctgaaactcagatcactcaattttttctagatgtcaatacttccagtcaaagtgttgtttaggaagaaggctaaaatgtaatttttttttttaatttattcaagtaaaagcaaggctcagccacatttccttagcattctgcctaccttgatctacatgttttaggtcaataaactggctttattgaataacaaagcccagacatatattgcatttttattcttaatattgacaggcacacttacaaaataccatttttattattgaatgacttgttaccatatctggcagccctaggttttaagaagaaaaatgtagttcactacaaaaaataataacacttaatattaaataagaggctaagatttcaacagcaataggcagaattccataatataagaagacacatagttgaaaaattgtacattctaaaattatgactagaaacttaacaatgtcaaatgcctatattttacattctttaaaagaagtctcagttacaatgacaacttattttcttgaggaaattttagattgcttttctgttataatgcacaccaaccatttgattacagctctaaatataaatttaaatggaaacagaggtgttagaaaactgttaagacttcaaaaagtttgtgtcattttttaatttataacttacattgggtgtggagattcaaatcatggcttattttattggaatataaatataaatatcactcatatgatctacatcaaatatgtgccccactcatccaacctacaacaattgagacaaaaatgttgaatgagttagtgttgtccttcaataaaaattttgttgttttgggttcattccaaagaactattgaaacagcaaatggcagtttctgtataagaaataaataataatattatattggggaaaaggaattaacataatagtatattatgaaagagacattcaggccaggtacagttctcatgcctataatcccagcactttggggggccaagatgcgaggatcacttgagcccaggagtttgagaccagcctgtgcaacacagcaagactcctatctctacaaaaaataaaaaagaagaaaaaacaacttaaataaatagtcaggcatggtggtgtacgcctatagtcccagctactcaagaggctgaggtgggaggatgggttgagcctgggtggtttagctgagccataatcataccactgagctccagcctggatgacagagcaaaaccctgtctcaaaaatataataaaataagatcaaaaagaaatatttaaaaaaacaaaatacgtcaattgctttcatagcataaaattatgtccagagcaatggcataaaaatgtaatatatagtcttaattgcaggaaaatataatctaatcatctgaaaatatgtcagaaaatctcaaaggtaaatttaatttagcattacttaaatttaactctaaattgtaaataaaatgattgaaaatgatagaacaactgaaggttatagttcgtcatttgtcaacagagtgccaaataaccatttggctcatttttttctaccacgttttgagtaaatctgccaggtttagttttctttgttttcttgaaggtcagtgtcttcaaaacacagtattttttatgtgtatatattttgctaaggaaatttagaaatcattattctaaagttgaaaatttgataactagaaaataatatgacttttagaaaaaaatatgattaacaaattagctgcctgcttatatattaccaaacatttcattcatttggccctaaatgatacaactaaaatatacaagaaaatggattacatcagagctaagatttgtttacatttgtttgttatttatatcacagaatgatcaatatgaactcccttcagatagtaaatcacattattactaataatgatgatgactgcttatgagttcgtagcgtttatgatttgcaaagcactttaacgttgttggtaaaagtataaaccagtgtatgaaaagaggacttacttgctctgcttatcctgcagattatgaggtttcagtaagttacctaatttattatcttactaaattaaaagagtaagctgattgggttgtgagaattaaatgaaattttacatgtaaaatatattgcctagtgtatgacatctactcagtactcagtgaatgttatgtataatgataatgatactgatgacgatgatgatggtggtggtggtggtaatggtgatagtgataatgatggtatctgtatcaagccattttcctactcctataaagtactgcccaagactgggtaatttataaaggaaagaggtttgattgactcacagttcagcatggctggggaggcctcaggaaacgtacaatcatggcgtaaggcaaagcaggtgcaaggaaccttcttcacaaggaggcaggaaggagaagtgccaaggaaagggggaagagtgccttataaaaccatcagatctatgagaactcattccctatcacgagaacagcgtgcggaataccactcccgtgattcagttacctctacctgatctctcccttgacatatagggattatggggattataattcaagatgagatttgggtggggacacaaagcctaaccgtattaatataatttgtacctttgaatcttagaatactggcatccatttctgttatcagtagtctggaaatgcttaccattctcctttctttctccagtcattaaggaaaagaatacctaagatttgtttccaaggactaaaggagtcttttacatcttttatgtcataaatttgttattcatcaatctatgtccgcaaatcactattctttgttcatcagagccccaaacctgtcgtcatttattcctggcattgaaaatctcatctcccttacctatttctagctcaatgtctttggaataggttcctgtcctagccgaccaaatatttacttgttccattaacattttataggccatgtgcaaatagacaaatagacatggggagttaatggaaatagaaatgaagtattttaaagactttttttttcactgtttttctttaagggctctccaggttttccccccatcactttcacttttgaagattactggcacacagtcacttaggttcctgtatcaatcatttcccttttcatactgaaactaataaactccagaagtactagtaagtaaaatattccacagggattttctcctctagcagaccttcattcagaatgttctgctcatcaaactcatattggattttcactccagctcattatttccattacttggccattaacttttgttaaaatataatcatccagaagcactccagcagtgcacaaatattaagtcttcattattacatgttcaatttcctgtactttttgtggacaaagacaatcttagctaaaatgaagaatacatagtttttgataaaggtatagtttattttgtttcctttccataagtgcatatataaactgttgttgaacctcatagaatgtcatatatgtttaaaattattcacaattattgaaatttcaacatattttaagcactagtttttatgcccaggcagagtaaggtaacagttatgaagataatggactataattcaaactggtgcttaagaaatcctgcatacaaaaaaaataaaattatcctatggaggtgcagtattatagaataatttttcttttatgggactgtaatctaagcaaagacttgtccaaaatctgacataatggccccctgctcactaaaggagcttcagaaaggcaaaattttcaacttatttaacacgcatagaaaattgcactagaaatacccattatttgacttctagtgggaattcatgttgtgtttattaggcaacaatgatgaagctcacatactgactcagagacatatgggaaaatctgttcttaacaaaagccctaaaggacactgttgctgagaagaaagcaaggtcttcttattttatctatggaagaagaattcatgggtataattagggccctgtttttgtccctttgtttccacctacatgctgggtttgctaatgaacaagctgttttgttgtttcctctgtgacagtgtcttttacatattaagaacgtaaaacaatataaactttaagtatctgggttttccttagtgtgtaagaaattgtataatgaaagaaaattagcattcataaatcaagaatgtacaatttgaatttatatgtgaattaatatctatgttttcaaaagaaataaaatgattaaatggcattgtttacctaaaggaagaaaggtttatatctgaatttataagatttagtaactataaactgcttactatataagatgccttagtactcagggatggtttcttgctgtttcctatccatgaacttaaggggatgagaaggaaatggccttacattcattatgatgagattaagatactgacttcctgatttcagtgaaagctaactgcacaagactctgcctgagtcaccttcttcatcttttccttagaatgctaattttttattagaaaaaattttaaaatataaagcattagcattttattatattttattagaaaaatataaaaggaaagaaaacacagtcatagcagcattggaaattaagaatatatagcattggaaattaagaattgttgacttctgggaggaatcaccgtttcatatagaaatgagctaaattaagaatttatcaatgagttgttgaaagctagacctctgaaactttaatgaagtcaattaagaaaccagcagaggaaaaattttactcacttctactttatgtccatatctactaaattcagaaattgcatcttactacagaagctggcttgaacctccctcccacctgcaaggtggtaagatgctatgtccgtattccaccccatctgaactaatccaacactttttggacattatgaatccagcaatggggtgagagaggacataaatcttaggatttcaagtgattagcaaataaagcataatgtcaacaaatggtgatactgaggaaaaattgaaattcatggattctggaaattatgtaattccgtgtactacttctagcaaaagaaggactatataccgtttctaatttttcaggagtaaatttacctctagatacgactaaggactagaaaatggaaattgacaaacatctcacctcagtccagttgagcttcattatagccttagtagaccttgagcgtttgactacagctgtgtacctaactgaccttgagattaatatttggggaacagattctggagcactgagagaaaaaagagacaaataaaactgaaaatattgccaattggcaaaaataggcctatagacataggagtacaagagagtttaaagcacaaacacacattaagcatgacagttaactgatagtcataaatttggtaacaagatgtcaagcaaatataaaaagaatcatcatcatgcttaagtacaatacaaaaaaattgtgtgtgtatgggtgtgtgtacaaataagttaataaatatcaggagttgcaaagcaaaaagctgaaagcattctaaatcatggtggcaacgcaagtaaatatagtcatagtccatataggaaaaattaaagatttacaaaaaacagatatattgtagaagcattgtaggtttgcttttattgagatagggtctcacaatgtcacccaagctggagtgcagtggcacatacacagctcactgcaacctcgaccttccagggtcaagcatttgtcccacctcagcctctcgagtagctgggaccacaagagcacactgtcaccaccatgcctggaaaatttttttaatttgttttggtagagatggggtctcaccatgttgcccaagcttgtcttgaattcatgggcttaagcactcctcccagcttgacctcccaaattgctaagattatacgtgtgagccactctgcccagcccactgtgggcttttttaattacatttttgatgagtacttaaggacaatgataaaataatggtatattatcagtggaagaaatcattgaacacggtagaaatttcatttgaagagaaaatgtctgcatggacacaaatacattaaaaatactggaaataaatgcagctaattgttcacaggttatctctgagaagaggattatagataattttcaacgccactttatgcatttctcttttgcatcactgtgaggaaatacctgaggcatggtaatttataaagaaaaagaggtttaattggctcacagttctacaggccatacaggaagtgggatgccagcatctccttcaagtgaggacctcaggaaactaacaagcaaagtagaaggtgaagcagaagcaggcacctcacatggccagagtgggagcaaaagagataagaaggctgggtgcagtggttcacaccggtaatcccagcattttgggaggctgaggcaggcggatcacctgaggtcaggagttcgagaccagcctggataacatggtgaaacactgtttctactaaaaatacaaaaaattagctgggcgtggtggtgcattcctgtaatcccagctactcgggaggatgaggcaggagaatcacttgaacccaggaggcagaggttgcagtaagctgatattgtaccactgtactccagcttgggcaatgagagcaaaactctgtctcaaaaaaaaaaaaaaagagagatgggaagaggtcccagagtattttaaacaaccacatatttagtgaactgagcaagaactcacttatcatcaggggatgatgctataccattcacaagggatctgcatctgtgatctaatcacttcctaccaggccccatctccaacactgggaatctgatttcaacatagggtttggaggggacaaacatgtaaaccgtactatccatatttctaagcttggtctctttaagagaattaataacccaaaataatgcaaatttattgaataacagtgtactcacactctgccaaatagttgaatgagaatgggaaaaaaattctcacattttcaaataattccattttcaacagtatgtttacatagtataacgatgatcacaaatatctaaattaatggcatccacttaaacacagaagatcagaagataaacacttcaggaactctcaaaatatcagttcctaatattttccaaatttagggtgatggaaaacctaaacactcctctttaaagtccttcaaatattttctttttcttgaccactccaccagtttgtttctagatttcacttttttcttaattgttgaatataataaaataagtctcaactcccaacgagagataacactgagaaactcagttaatttaagctgtaaatgacaacagaacaagtctggtttgttgtactatgagcacctccagtttttgactttacatgttacatctctagctaattaccagtttaggaaacagtttatgaattctacttctaaccatggttcatttaccccagttactataaattgcttcacaagttgcctggttgtgctctccacataagcacaacttgaacaagccattaattgctcacaggtttttcttttccaaaagccccccagactacaactttcagcttaatttgtccttaatacaaacagcatctaaaatacttgggaattcaagcatctaagtatatgctcctaactgattcgactacctccccaagtgactcttcagtgaatataaaatggtgaggagagaagattctgaggctgcttagaaaaaaagcattgtacggtcgagatttttagcatcctctgagaattacatagtcacttcttttcagattttgcataaatcacgatgtaatttaactttggttaatttataatgagaattagaggtttggttacaaattaaagcatagtacaatgataaccttgactacaaatggaaagaaactgtacatcatttccatgaaatataacatatacagatgttatcatttgcatgcttacatctctgtgttccaatgacagtgtggtttctgaaaaaaaaagaggtaggtaggtaggtaagtagggagatagattgatagttaataaaatacctatacattttaagatgattactatgttattagttaatagctggagttttcaagataccaatatgattttgttcctctttctttccagttgcaaatggtagctctacttctccttttccttaatggagagagaaaacctttctttctctaccctctgaaggttcagtaactgagtctatgaaatataaaccgacagtagacagattaataagacaaaatgcatacaaattgattgtgtgcacaggggcatcacagaaagaaaagtgagtacccagtaacccaatgaagtttagaagcttatatatccttttcatagaagagaggggtggtgggatataggccacttaagggggagtaaataattttggggagagaatgaataggcccaaagagcacgtggtaaccagtgagaaattctgtctgggtgtggcgctaacttccggtctttttttctgggatatgtgtcaatttctcacaatgatgagtttcctggggaggagatccaggatgaattgaattttttctggagtatctggtatcaaaacaataagaaaaattcagagaaaacctctgcctgctgctgctggtccccaggtgccttcaatttaaagtaatcagcacaacaaaacttcatattttgggataacattcccaaaactccttcaccctcatgcagcagacacatggtctatgaacagttatattcaattcaatttatttccataaaaactaaactttcttcaacatatactgtatataagacactatgccagttcataccaagataagtaagagagaatcccatctcccaaggaggcacctgtctggtggaaaataaaactaatatagacacctataaaataggataaactaaggtaataataaaaataggactgactgagcattgggtatttttatattgcattactttattaaagtcctcaaaataagatacgattttaaataatataatcctgattataaataattaaatcatagagagactgcctaagcacacacactcgtaacaagtaacagagccaaaatgagagcgtcctaattctgtttgaatctaaaacctgttctcagtctactgtaccatacaaaaaactttgagagttaagaaagaagaaaataaaatctagataaaagataagcttcctgggggaactgccattgaagtggtcttggaataggattttaacacagagggacagagtatattttaggaagagacttcagaatttgcaaaaatagttatgaattcaggacacttttgggaaagtaaatactaatatttgtccagggtatagactatgtatcaaaatgaaaaatctgctgaaacaattgaatagctgaagacaaataaagaagaacttgaatgcacagattgagttcaagcttaacttagtagccaagaggtagtctttgaaagactcagttcacatctttttgaattaatatcttttatttaattttttaaattatatttattttatagaaaaatgcccactaattactctgtctaccaaagagaaaagaattaaagttacgacttaaatataaaatatataaataaatattacttaaatatccttgtttcaacaacgagctagcaagaagctagaaggaaacttctggtatcaaaacaataaaaaaaaagaaaaatttttagtgcaaccagtaaaagcattgaaataaggtatgctatttccaaactagttaaaaaaataaatataatgaaaagttaaccaatcaaaaaacagagggatatatgtacatataccaataaaaaaacagagggatatatatatccatatatatgtatgtgtgtgtgtatatatatatgagataatagaaagcataaaataattcagaaaaaccaaatatatcagaaattactgtaaataccgaactagaaataaaaattcagcaattatatgtaagagctttgttttaagcaaaaataaatagcaaagttgaaagttaataatgggaaaaaatgaatcatataatattaaccccccaaaacttgtttaactatatcaatacaagaaaaacagactatacaagaaggaatataaaaatagtataaaatttccccactatcagagtggggaatctcaaatatattccttgtatttcagaatataagggaaaatttatcgctctatgtatttatgttacaaaagaggggagttgaaaatgaatgagctgagcttctatcttaagaaattaggaaacgaacatgaaactaaaagtaaatgcaagaaaataataaattcaaaaataattcaattacaaacaaatataagcacaattagaagattggtaaagtcaaatattgatactttcagaggaccaagaaaatgaacatatctgtagtaatcctaaaatcaagaaaagagctacaaaatactgagagcaaaaatgaaaaataagcacagatgccataaacagataaaaagaaaataaaaacatgataaataattaaatgacaaaaaattggatcatttgattaaatgaataaaaaatgatatttcaaattgactcaagaagaattgaaaaatttaaataatttcataactattaaattagtagttaaaaaatcttcaaacatacaccaaaaaactcaaggtgtaaatgctttcagtagaaatttctaccaaaaaaaataagaacaaatgatcccaattgtacacagttatttcacagtatagaaaagagggaaaataaccctaacaacaaaatttgccaaagacaatatgagaagtaaaaacacaagccaatcaccctcatgaacatagatgacattatataatgataaagggttcaattcaacaagaagacttaactatcctaaatatacattcacccaatactagagaacccaaattcataaagcaaatacttctagacctgcaaaaagacttagccacacaacagtagtgggggaactcaacatcctacttagagcattagacagatcatcaaatcagaaaactaatttaaaaattctggacttaacttgaccaactggacttaatagaaatctacagaatactctacccattgaccacacaatatacattcttgtcatctgcacatgaaacacacttccaagatctaccacatgcttggccataaagcaagtcttaataaactaaaaaaatagaaatcataccaagaacagtggaataaaaatagaaattaataccaagaagacctctcaaaattactcaattacatggaaatttaacaacttgctcctgaatgacttttgagtaaaacaataaaattaaggcagaaataaaaaaaaaaattctttgaaataaatgaagagacacaacacaccaaaatctctaagatgcaaataagcacaatcagaaatgacaaagatgacattatcaccaatcacacagacatacataaaatcctcagagactattatgaacacctctatacacacaaaccagaatatcaagaaaaaatggataaatttctgaaaagcagtgttaagagggaagtttacagcactaaatgcctaccttgaaacatgagaaacatctctaacaatctaacatcatacctagaggaactagataaataaaaacaaactaaacccaaagctagcagaagaaaagatataactaaaattagagcagagctgaataaaatactgagaaacaaaagttcatgcaaagaatcaatgaaaccaaatttggttctttaaaaggataagcaaaattgacagactgctagctaaattaacaaagaaaatgagaggacatccaaataagcacaataagaaatgacaaaggtcacattacaaccaatcccacagaaatacataagatcctcagagactattatgaacacctctatgcacacaaatcagaatatctagatgaaatgcataaatttatgaaaacacacattctcccaagattgaatcaggaagaaattaaaagcctgaacagaccagtatccagttccaaaatgcaatcagtaataaaaacctaccaaccaaaaaacactgaggaccagattagttcactgacaaattctaccaaacatacaagaaagagctgatatcaattctactgaaatgattccaaaaagacaaagaggaggggctcctccctaagtgactctatgaagccagcatcactccaatatcaaaacctggcaaagatacaacaaaaaagaaagctacaggccaatatccccaattaaaaaaacaaaacattctctaaatatactagcaaacctaatctaaaggcacgtcaaaaagccaattgaccctgattaggtaggttttatttctgggatgaaaggttggttcaacatatgcaaatcaataaatgtgattcatatgtttgttgaacacatgtatgtcttcttttgagaagtgtctgttcatgtcctttgcccactttttaatggggttgtttgtttttttcttgtaaatttatttaaactccttgtagattctggatgttagacctttatcagataggcagattgcaaaaatttcctcccattctgtacatgcagccaacaaacatatgcaaaaaagctcaacatcaccgatcattatagaaaggcaaattaaaaccacgatgagatatcatctcatgccagttagaatggttattattaaaaagttataaaacaatggatgcttgttgggctgtggagaaatggaaacacttttacactcttggtgagaatgtaaattagttcaaccattgagtaagacagtgtggccattcctcaaagacctacaaccaaaaataccatttgacctagcaatcccattactgggtgaatacccaaaggaatacaaattattctattataaagatatgttccttgcaacactattcacaatagcaaatacatggaatcaaaccaaatgcccttcattgatagactggataaagaaaacatggtacatatacgtcatggaatactatgaagccatagaaagggacaagatcatgtcctttgcagggacgttgatggagctggaagccattatcctcagcaaactaatgcaggaacagaaaaccaaacaccacatgttctcacttataagtgggagctgaacatgaaaacagatgaacacagggaggggaacaccatacactggagtgggttggggagtagaggggagggagagaattgggaaaagtagctaatgcatgctgggtttaatacctaggtgatgggttgacaggtgcagcaaaccaccatggcagacgtttacctatgtaacaagcctgcacatcctgaacatgtatcccagaactttaaattacacttttaaaatatgtgattcaccacaaaaacagaattaaaaacaaaaaccatatgatcttctcaatagatagagaaaaactttcaataaaatccaacattttatgataaaatccctcaagaaattaggcattgaaagaacatatctcaaaacaataagagccatctgtgacaaacccacaaccaacatcatactgaatgggcaaacaatggaagcattcaccttgagaactagagaaagacaaggatgcccaatatcagcactcctcttcaaccagttagaatggttatctttaaaaacagcagtgaaacctgatcaatttgttattttctttttccctctgtccctctttctttttcttttcttttctgcctgcctgccttccttccttccttcctctctttctctttctttctttttctctctttccctccctcctttcctcctttcctccctccctccctccctccctcccttccttccttccttccttccttccctccctccctccctccttccttccctccttccttctttcacatcagaaatttaattctcactgtctgggggctaggaagtcccagtacaagctaccaggagattcagtgcctggtgagagctcactctctggttcacagacagtgccatttcactgtgtccttacatggtagaaagttcatttatttttgtctttaatatctatcattgatttatattttgtgcactgctaatccttaatcaatttttaccacagaaataaaatcttttgaactgcttaaagttgttttctctctctatctacacacataatacacatcactttaccccaatagcctaagaactggcctctctttatccagtcttgctctgtacagcattctctatccagcaatcagagttttaattttagaaaataacttgaatcatgtcagtttactttttgaaactttccaatggcttccccattatttggaataaaattacaactcccttctacgacacatgagactctgcatgagctaacttctgcctttgtctttctctttgtcccattcccgcatttcttcatgctcatgaaagtccagccccatcattacactccctgttcggtgcatgcagtagatttattcctactgcaggacaaggcaccacttatctcctcagcttgaagtactgttgcccagagtgttgccttatggtctcctgaaatctaggtctcaggtcaaatgttaccttctcggaggccttcctgaccctctatctgaaattattacccctatccttgttacttctctcacacatctcatctggtgttcttcaaatcactcatcacactctgcaatgttctttttggtttattttttatttattcttttttttttttttttttttttgagacagagtctcacccttttgcccaggctagagcgtactggtgtaatctcggctcactgcaaactccgcctcctgggttcaaatgattctcctgcctcaacctcctgagtagctgagattacaggtgcccaccaccatgcccagctattttttgtattttcagtagaaaatgggtttcaccacgttggccaggctggtcttgaactcctgaccttgtgatccacccaactcggtctaccaaagtgctgggattacaggtgtaagccaccgcgcccagcctatttattcattttttatttgtctcactaactaaaattgaatcagggggcttgtttgcttttcattcagtgaccccagagcctagaattatcctttgtacatgtggaagctaaaaaatatgttttaaatgaatttttggagtaacacatgtacccaggtcttctgcagttcctaccttatatgtgtccatgactcaacctcacaaaagtgtgtgtagatggtaatagctcaagctaatttattaaggatattatgaggaatgaatgagacagtattatataccactctgaatttctttgaaaaaatataataacaaaaatcatattattatgactactttcatattactcagataaagagtaattacttttttatggttaaaatagcatggaaattgaatcagaaggttgtaagcagaagtagggtcagttccctttgtttatttaagaatattaactaagctgagttggattttcaagaaagcttgttttctactagtttaaattctgattatctggtcaactgaatttttagaactatcactaaattaaaaagaaacagcagtggggtgtaacttttctcatctttacttcatttacccggtgaagcatctgcaaagcctctgtgggaggtttaaatgctaatattcagaaaagcagtcttggaagcaaacacccagctgtatttaaggcctgcattttcgtggtgaatgtgtctccagggctgtacctttccactgcccagacttttaagcaccatccatattaagcacaaatcagaacgcttttcacaaaccacttaatgctgtttaaaacccacaagtaaatcatcttaactaaaccctttgatatagctttgctctccaaactgtccctatctggttttaaacactattataagattgttttaaaaatttagaggtggcacaccacattaaagctgttatatctgtataaatcatgtgtggaataggactgtgctcttcccccatactgagatcaatgcttaaaattttatgtgattgtcctctttgcgcatatgtgtgtgctgggaggcggaggtggggtgcagtatgcttgcacctgtgcacctggttttaaagcggtgatttccaacttcttttctctttgagttggttgaggccctggtgcttgcaatgacactgaaacaagatgtgctttttaacatataggctgtaaatgttagtatttctgagtttcgcagatccctactcgccctggttttggagaaaaagctaagttccatcctcttgcctcatttcatgggtcatttatatgtacatgagcctcttcagcagcaatatacagtatctgcctcctctctcaatgaccaactttgagtattgtccctgatccgccatacatgttctgcaacagtgcggggttgactcaaagacaacaagagtggctatttccttctgctagttcagccctcacagttatgatctagctgtgggaagccctgttttctctcgggtgttctctataccacagctagtgtttgttgatcacttctgaaaaatgcactttttttgagacagtcttgttctgtcacccaggctggagtgcagtggcaagaccatagcgcactgtaatctggaactcctgggctcaagcaatcctccatcctcagcctcctgagtagtggggactacaggtgtgtgccatcatgcccagctaagtttttattattttttttttatacagatgaggtcttgctatgtttctcaaataggtctcaagctcctggcctcaagtggttctcccacttcaacctcccaaagttctgggatttcaggtgtgagccactgtgcctggcccaagttgcaagttttcaggtgcacacccctatttaattgatgtctttttgaaaatatatataataaagcaagccagggttctctaattttttctacagtctgtacaacctgacttgagttcagggccacaatcaggacctcatgactgctcaacagcttttgccaaagtggcccagtcacaagaattacacgtggattttgttaggaatacagacacctaggccccttcccctggaaattctgatgcagcagatctaggtggatccccatgatctagaagttctattagtgcctaagtaactctcatgagcaggcagaaggagcaaacacagctggtcaggattaacatttcccttcagggtgaacaggagaaagtttcactctccagatttgtaccaattaactcaaattatgcaggttattcataactgtgtcggatccttttgtttacctgaaaccagacatatttaggctttatttaataatggtggttaattacattgttacatctgacaatgagaaaagaaggaatctcttgggttaaaaaaattaaaaattaaaaagcacaatgggagccaggtcttcaggagactgaactgagcagatgccctggatctggtagatgcggaaatcttatcagctatggtctatggatctaactctcaggtgctcccacttgactgaaaacttcttctttctccacctcttcatctcattgtgtatcttgctcctccccctgcctccaactgggtaagaactcatattctactaggcaacatactgagcacatgactttaatccagtccgtctgcctctctcacatcagctgcataatcatttagcttaaagtgacattttaaaatctcagttttcttactagccttgatttttaaagagtcagtcgacttttaaaccttttaagactttaatgttatcaaacgtttaaataatatttccctaatcactggagtaaagccctgatgtgtgttgtggaggggtgatttaattttctgggttctgagtacctcttttctaattgatattcttcactgccagcttctctaaagagagatgggtttgtggggagggtggaaagaaagaagaaatgaaagaagaaagaaatgaaggaaggaaagcagaccaggaggaaaaaaggaaagagagagacagggaaagaagaaggagggagggagggaggaaaggaaggaaggaaggaaggaaggaaggaaggaaggaaggaaggaaggaaggaaattaaaggagaaaaaaatcatcattattccatttatgcttgtttgaggaaaggtaacacatctttttatgagaatttgttgctcaccttgtataagtagagacactagtatcagtcaagacttcacatagaaattattattcattaaaaatcctttgcacaaatatatttaaaaattacttaagctaagcaaatataaagcactttcactccagtgaactgagtattttaggatagcatccatattgtagcacgatttctccactttgcttattagatgatgatattgcacaaagaactaataagccaaaagagggtgaaatataaaactagattccaacttagaggatggatatatgctatcaattttttttctgcaattacaaagtatcttcatttacactgagtttccaagaaaaacctagactatgtttttatgtggaagaaactaactagaagtcttgttgtcattgttctctttttattaaaaattactgtttttgaggggaagaaattaaagtatgtttttgagtggaagaaactaaccagaagtctttttataattgttctttatttattaaaaattcacgatgtgtttgaaaccacctagtgcttatttatatgtagattctggtgtctagatgtatatgaccacaggcaacacagtacacatcatgggtcatgtccatgccatctgtgcaaatacatgggtaatgtgcgtgggttcattgtgtatagttagttaccaatttgtctctctgtaaaaaattgattttaggtaaaaggctctatttgaatatcctagagcaagatgttgtttgaaataaagtttgaaaaatgtgattgtacttttagcacacatttcctcaatcagtaatttagtctcaagtttggtcttaggcaagatctacatgtaaggcttatttctgatggtttctcaagctgggagagaaaacaattaaagaaaatacttagtcagtttttatctacacgtgtgccttcggtgatttatttaagcattccaacagataacatgtctccattatttttagcaaagggctttttgtcagtattttgtctccagttataataagtgttttaaacatctgtcaaagctgttctacttcccactcaacagcaaagaaaccatgatatgtgctggaggtcaggaataccagctacaagcagaattaggattaattattggtagacagggccgatatcatggtctggccacctgtgcagttacataaagcactaaagttagaaggatcctttgcttgctttagtgttttactggcaccaaattgaaattcctagtaatttttgaacaagaaacccatgtttttatttttcactgggccccacaaattgtgtagccagaactattgctagactatttgcttgacgtgtagtcccaggcacattatttaatcttcctaggcttcattttccacattttaagaaggggaggataatgacacctatttcattggttttgcgagaattaaaagagatcgcgctttcaatatgttaagtagagcacatggctcatgttaaaggcccattgttctgagattcactgatatatacccgtattctgggatagtccgtctactcgcaccttttgcccttggctagtgtgtaaacaactacttcacatcatcccctgatacctgatctccctcccacctgggagctccatcactgttgctaccattctcctagccatccgggtttgaaatgataaaccccttgactgcctaggccttattggccaccaaaacgtacaaattatgactacctcatcatgctctaacactctcatcctagtgacttatatccagttcccaagtacacctacactagaatgtagtctgcatattctaccacggagatcaatctacctggcatgtcactttctaccagcatattagtctgctctaaaactttttggcctggggaccaataattccctgtgactctcccgaccacatggagaaagaaaggaaaacatgaatttacatcacatgtgtatttaaaggcaaatcagagactacacagtagatggaaaaagcttttttagctactaatgtaatcccagtagctggggaataacagaattttcaagctgcctgtttggcagagaaacccagtgttccacaagactttgctcttctcttcatttgtttcttaaaaccacgctgtgttatttaaggaaatgatgatcaacaaaattctaactgaaaagtaacttgatgaaatattttccattaaccgttgagatattatagaaatgtactttttcctaagtgattctggggcagaaaaatacctttataatcctaatatatcacaattcctttagtgcctaatattgagggagcagcttttattcaagatggaaggaatattagatatcattcaatctagcttcctcattttacagataataaaactgaggatgagagtggtaaagtgatttgctcaaattcatgaacctgcctctcctaatattcagccaagtgtcttttccagaatgtcacagttccctgtataataagaatcagctttattttccacaagaataaaagaggttagagttagaaaaagaataagttttctggatacagagtgtcattgtgtctatgtgaaggaatgttagcaaaagtgaaaaaaacaaaaaccttgtacagaataaaagaagttattcctggcaattgactgaaatggaaagaaatcataaaagacttgaatgacaggcaaatgaataatgtgatgagatatatcaaattttgactctactgagatcaaaaggaagaatagagtatagggaatgaaagatgatgtctggatttaacattcatttgggaatcatttcaaaatcttgagataaaaggttctttagaaataataaatgttgtgtttctttaatttttagggactgagagattcatgcattgtcacaagatgttattaaaaacagctattcatttttcatggaatgagacagaatgcatattgtatattggaggcaaaactatatcctctgttattcccatatatttcctttcaatagccgatcagatgaaattgtgagtggatatgaaaggacaaaattaaacatggtaaaagaaattaaatcggggagtttttttttaagaaaaaatccttcatttgtttcgttgtcagaattaccaagatgagctaggtaataggttagctttacgagctaaaagtcatcatctatacatgcaaatcacgttgcatgcaaacgttctttctggtccattttcattagtgcttaagtatggagagactactacaggactttaaagcttctgtccaattacccagggacatctcaacatgaattatagctatgtataagcaaaaaaaagtatttgactttaaagcaaatacatcagactgtaaagcaaattcaatattattcatcttttgttgtattcaaagataagaaagtagtgattacttacattataaaggtttaaatatctatatttacccctgactttagtacataacaaaatatgaataatattaagattcccaggatatgataatttcaataataagaaagccctcttttgactaggattttcttatttccaacaggtttttgtgttgtgtttaatctgtctgtctgtgttttagatttactctattaggaaatattagttccaaccattgtccttacagctgtccttgcaggaacactactcattttggaacagattagtgtatcttggtaccccctttaccttgaatgtataaattatcttttagatctatttgttgctatgtaacaaaccaccctaaagctgagtggtttctaatgttattgcccagtagcattttgggccagcaaaatggttattctcctgggcttatcatttgtctgtggtcagccgcaggttgagtcagcagtttggctgaccttggctggtacctttcatatccctcatcacatctgtcacatctgtacagcacaacagttgtccacaaattccatcattttctagcagattagccggacttgttcacccggtggtgagcagagtgtcaggaaaatgagtggaaatcttcagggtttcttaaagcctagggtcagcatcatttctgctgtattctactggtcaaagtatgtcacagagcaggtccagattaaagggcgggaaagacaagtgggaaaaactgcaaagtaactttggaaaagagcctaggtatacagagggggatatttgcagccaattttgtaaacaatttacaaattactgaagaatttctacagaaaattcattttaattaccttggttatacttaaacataaaaacagtgaggcccagagatgtcgagcaactggcccaagttcacacagaaagttaaaagcagaactggaataaccaactgtcctagtttgcccaggattatgtcagttttagcactgaacatcccacatttcaggcaaactggggtggttggacaccctagggaaagggctaggatttcctgattcttagtttgatattattttctgaacactaaaattgatctatgtgactagctattggtgtttaagatcaatctaccctcattcctgcatcctctattagcatgcatgctgacatttaattagtttgtccattggttagactctactctgttccaaaatggtttaaggcattttataaagtactgtacatcacaaggggataactacacaaggctaccttgccattcttcaaacattccacgtattttaatgtttatgaatgctaattctttctgctttgtgattagtctttctctttctagaatggtttttgcttttttttttctattaatatcattcaatttatagtttccaattaccttctctgtgatgtaggccccagttgaagaattcatcattatctcctctgagctcctgggagacttggcccatattttgatcgccatacttagtacattgtttctactaagttacgtgttatctcattacagtgtgttttcaccttacatctcctttatttagtataatcttccatatccagtaggcactctgtcatttctttaagtcattgtttctgttgcataaatgagtgaacagactgtttagtgacagcctagtgaaatgtggaaattttcactttcttcactaaaaacccttgactgcttttcttcttagttccaattatccatttgctgcatttttatcttttccgttggtataattcctgccctaagcaacacagctctcatataatctgctgggttttaattggctgcagtttccaaagctaaatgattagtttcaaaaagattgtttctgacccaatgcactgtaaattctgcacggggatctgaagtgcttttgtttgaggccctgtgtttttgtgtttgtgtatgtcatttttatacccattctggattagtttccagaatatccagaaaaataccaaacacataataggtgctcagtgcacttcatgattcattgttttatcatttgctcatatgtctctatacacccatttatacttcagggcccttcataggcctcttcacttttggaaaactttcctgagcaagcccctccctgtccagctggagttctacaaacatttaccatagaacccattcttttatattttcataaagtattcaattctttgtctctccatccactgtctgtaaactctttgaagctggcatctgtagactatttgcttttgctgtacctggctcacaggaggtaccaaaacaacctttgtttatgtgattgattagtcaaattgatgaatcaatcaaaaactacagtttcagaggaaaatgttataaaaagaaaaagtatttcagacgtcttcttggctcgtattacctgtgtcatagcttttccatattcagaacagtttgcatcttagaatttggttagcagatatacttataagactttgcaggtaagaagaggaaatgcccagcaatcagcttgctaaatttctcaatttgccccacctaaacttgcaacttaaatttagacatttttctgaaataggtaagtctaaactatgagtaggatggatttccccaattttcttgcatcaactgatacaatatctacaaattatcgaaaagatgtcaaaaacacatggggctttagccagtccttataatgagagatgggtcttggtttagcagaagaaaagaatacatttcagataaggaaaataaaagcatctaatgcataaaatagaaacaatacggtatgttcctgtaatagtgaggcctttcatacctttagaatacaggataaaaatggagatttgcatcaacttgatgattggaactaagctgggagatgtaaacttggcatgttggtatatatgagtagaagaggagctttcaaaagtagcattcatgcaagttcagtggaaaagaccagtgacaggaaaacacttgtgtaaacagacatgatattctgacagtgagaatggggaggaaggtaaatgctcaagaaggataagattaaagtgaattatatttctgaagggaggaacaatccacttttctagccttttctcttgccactcagtcatgtatcttttacactccaatgatagagaatttctcataagcatcgagcttattgcatccctttagattccatcatctttcctcatgcagcggcttctgctttatctttactctaaactcctaagaaattccaatgtattctttttttaattttttaatttcaatagttttggtggtacaggtggtttttggttatatggataatttctttagtggtgatttccgagattttggtgcacctgtcaccagggcagagtatactatacccaatatgtagtcttttattgctcaccccactcccagactttccctctgagtctccgaagtccattctacaattcttatgcctttgcatcctcgtagcttagcttccatgtatatgtgagaacatgcaatacttggctttttattcttgaattacttcacttagaataatggcctccagctccatccatgttgctgcgaaatattatttcctttctttttatggctgagtaatatcagtggtgtaaacctaccatattttctttgtccactgattggttgatgagcacttacattggttccatagctttgcaactgcaaattgtgctgctgaaaacatgaatgtgcatgtcttttacatataatgacttattttcctttgggtagatacccagtagtaggattgctgaattgaacggtagttctacttttagttctttaaggaatcttcatactgttttctatagtggttgtactagtttacattgccaccctcagtgtaagtgttcccttttgccacacccacactaacgtctatttttttttttaattgtggcttttctggcaggagtaggatggtatctcattgtggttttaatttacatttccctgataattgtgatgttgaacatttttaaaaatatttgttggctgtttgtgtatcttcttttgagaattgtctattcatgttcttcacccactttttgatgggattatttgttttttcttgctgatttgtttgagctccacattttagagaagtataaaatatttaaaagacagaaagaatgtagagcctttggaataagagacgtgggagaatgtcctgaaaatacagttttccagaggtcaaaaaaaagaagttttaagaataaaaaaggtaaactggtgccaaatgtaaaaagtggtcaaaaactgataaaagaataatttagaatttgttaagaatctgattattgatatgaaacgtttaaaagaacagttttagcaaaagacattactaaaatgtgtattttattatatattttatttatcctaggctataaaaacctcaggactgtaagatttttaattagtgttaataatgcttgatcatagtgtatgacttttctcccttctgtattaccagcaatctgaacattagcactaggcttaatgtgattaagagaaatggattcttcctctaactggctgattttggagaagacatagaacaagggaatctttaagggtcatcttactctcacccaatatgagaattcctcctacaacctccttaactattaacttatttcacctttctagatgtccgtgaccttgtctctaaaataacgcacttggacttctagctctaacttctgattaaatgaattagaacataaagtcactgagtcagttgccttcaactcattctgcatgcaggctgtacaatattttcatccacattttaaaagtgaaatattttaaatgttagtaaatgttaaaaattagtaagcaaagagcaattagcacgggcacattctgaatgccttttagcccttgcttaaacttaagagaacagtctgttaaaaacaagataatatttttattgacatttcagttgttgcaaatgagtctttgccagctttcctcctgattctagtattttgcctaattctgatttcacgcgtgggtactttctgaacaatccatgtcttggagcgcatcatgtactaatgttgctctgacaaccttgtaatgggaatttgaacagttattacatttttcttgttaaaaccagggggaaagagcattccaagtgtttatagctccctaaccttactgtgatgaggtgaagtttgatgtagctatttcctcttactttgaaatctcatttttaataacactgttccacgcttggcgctgcatgtgtcagctgtgaacccattcacctttgcaaggagtagccttaatcctgcaaatcctactttgctccagtcagtacagggttgaagagaagaatctattctaattacttaaagtttacttaccagtgcctgcaatgctacaagggaactggaagctataatagaccaccctcttcagtttgggggaaattctacaagaaaggcttctgtaacatgagcagctcttgacttatcagcaacttccataggctaatgattatatttgccaacatacccacaacagtttacagagatttttgacttacagcagataaatgtaaagattgaaattacgaaataagtagaacttgtgaaaccctttacaaagtcacagaatatactttatcttttttgtcaagtagaatggaaatttgttaaattatctgcttctcacatattattttaaaacaaaacagatgaaagctctgaaatacaaggtagaaaacgtcacttttttttttttttttttgaggcagagtctttctctgtcacccaagctggaatgcagtagtgagatctccgctcactgcaacttccgcctcccaggttcaggcaattctcctgcctcagcctcctgagaagctgggattacaggtacccaccaccactcccagctcatttttatatttttagtagagacagggttttgccgtgttggccagactggtctcaaactcctgacctcaggtgatccacctgccttggcctcccaaaggtgtgagccaccacacttggctgataaggtcactttttaaaaagaatagtttttaggcatcatagtgtcattaggtactataagcagcaagttctagaaaaaaaaatcacatataataactatcttttgttgactacttagtagaaaccaagtgtacttctagacactctgcatatatcatcaaatttaatcctgacctaattgaaaaacatataataaaatattaacaaaagtaatccttaggtgaaggtaacagttaactttacatgggttatatcgattaatagataaaaagacaggtaaacatactgttttcctttgaggaaaatagcaagtgttttcctttgaggaaaatgggcaggacatagtatatatctgggtaatttgacccctccattcttagtgcatcttacctctctactagttttatacctgaatatgcttactgtactattccctttttaactaagaaatctctagaatccttctacaggcatatcatatgttcctctcccctttttgtactatgcaagtatttttcacaaattttgcacctagaatcttcatgttatattccacatcaactagcatgagagaggctgcttttcattaggcaataagaagcagagaaagatctatactgcaataactctatgataaaggcaggacggtatattttacactgatttcaccatatatcctccgcatcgcaattggaaatgtagattttataatgcttattttgcaattcaggaaactaatgttcgaggcttaacttattcaaagcgattacttgaagcaaaagcttcatgaacttgcccagggttattctgctgctgagggggagagatagcattggaacacagggtttatttgccttcaaagttctgttattcctattacatctctgtcatgaggaagactccatgcagcagaatacctaaattttagcaggtgtttttaagagatgcatgagcagagagagagaatttgcatctgtgtggatagagggatcttgcttcatttgcaagcaagaacttctgtgagacttccggtacatcaaagaatgcctttgcatggctgtcttctggaacaacctgtataaccacatgggaataactaggtccaaagtgtcacactggcttatgcatctcctcaagtagtcctacaaagtctaaaaagttaacagatacaaaccaatatcggaaggaaggacccatacggtaagatgaccacaaacatagcacttttcccactgagtcccctgttgttctaagtctgcctttgatgagtatccaggagcttgtggtctcctagtccttttcctcctctcctttgtactctccaaggtctcatcgtttcagacctctcaacccctccattctccatttagagttctggttccaattcaaggcaaaatcctcccagccaggtcttcaggtttccaggcagtgcccaaggctccatgcagcagcaagtcctttgcacttaaaagcaagtctttcacacatgcaagttcttcaaagggaaacaactcttagtcaaacaagcctttctctcataacattggccccattttacagtggaactctgatgcttaattatactaacaaagtatactttttaatggaacactagctacctttaaaagttagccctcagatcataaggcttaccatgaatgaacatgatttcagctcctgtaaagttcaaaccagtgctgctgatcagaagtcggttttcccacaaagggcgattcagggactgcagatggtgctgctgttatctctacatcaagccactaaaagggaagtgacatgggagtttaaatagaccacacctggaatggcagctgtcaccttcactcacagttgactagtcacagctaactgccaggtaatcagagaataagggccactaaatggcacagcaagttataaaatgcattcttaaccggcatatgatatctagctggatatccaggaataaaagaagagaggtcagctaagcagatagctagactgcgtgatgcaaaattttgctaatttctaatgccttaccaaagattcctttcccttaggtttgggacattttgtaatggaagaaaagggagcattctgagggaatgagggaggagggaataaagcatgcatgttgaagaaaactctaccgttgtaatttaagaaacaacaacatacatgccagaatccctttgtaaagtgaacttacagtttaaattgtacattgtatgattgtaaaaccattatataaatgaaaaaaatagggaccattactgccttaaaaacaaacaaaaaaatgaaatacatttgtttggaagatgagaagactatccagatttgactagagatatttgcctataatatcactttaaattgtttctggggacaagaagaaataataataataatagcctccctctctgtaatagaaaaatgttattaggtgacatgatatttatataaaatgttgtttccaatgagacaaaagtaaaatatcctactgtttttagaagcacctggtattcactgtatgacatcttactttcaagggagttcttgaaccacctctataaggcagtcaacttttaaagcaacttagtattttggcagttggaagacatattaactacagtcatacctatttatgcctaaatctaaaagttcaaaaaataattaactcagatttagtagatttggaatatggattgatagtttctagttttgaacctagcttagacattaacaaagtggactaataataaacttagactaataaaagtatccccaagaccactttttcctcactcctgccttgcttacacacttgtcagtaaattagagttttatttccttcatgccaggtatcctgcagattttgagggaaatagaagcccctagtgtaaaatacaagagtttctgacaaccggttgataaattcttatttattaaaaataatttctaacttagcatgaggtcaatagacttaatgaaaaaatttcatggtataaacaatattaaaatattctaattatgacaattctggcaaatcccagaatgcattagattacagaatcacaggcttatttccagatgctgcaactatagtattcttttttttttttttttttgaagtctaaacatctcagtggttccaaaatacagcagaatcagataaatgtttgggaaccatactgaaaaccaattctgagaatttaattaaaggctggctaaaagcaaacaaaaaaactattatatagtgtagttgagtgtgacattctcattggatagttgataattgcactgcttttcctccatatcaccacaaattcatcaatcaataaattgttatgaaaaatttatgtatcaaacgatagagtttatacaagtaaaagaaaattcttattttcaaagacctactactccagtgatacaaatgtatacacatacattttaacatataagcctatatagatatatgtatgcatgtgtgtgtgcttaatatcaaactcttcacaaaatgtaatatagtttatagaaagcaaagtttattttagatgaaacctagagagctgagtcaaatttacctaaacagagaatagtggggataattttttttttttttttgtaaagaaaaggcctaagtaaagctagtaaaggcattcgaagtgcattggtttgatgaaagtagaagacttgtgtataaataaaggagtgagaaaattagagaagagtttgaggtcatacttgtgcaaatcccagaaggccaagctgagaacggcacctgatcttatagagagtagggagataaaatattagaggagttccagcattgtgtgacaaatgttattgagcttggatagaattcagtgagattagtgctatatagcaaaagaatgcataaaatacaacataagtactggctttacaaaaacatcattggaccaacatgtatgggctacatggaagtggaaagagattgaggtaggaagcagatgcaatcattgagatgtgtgagatgtatggtaggaaaggtggatggcgtggggaaggaaaagaaagggtcaaatgggagagacacatattttcagcacaaagcttcaataaatacttgctaaacgaactaataaatctatataatatttcagctcattacatatcctatttttcttagttctgtcaagatcctctgagggaaacaagcaggctgggtacagaagttaaactttggaacactttctctttgagtccccattatatatgttctcatacatgccctcattgatgctgccagtccatatttttataatatcatgtattattcttttgtagcatttattatgattttattaacttttatattattatatatgtaaactgacagagatcgcaactactctacacactccataagagtgcaatgtatattttctcacaactgtatctagtatatatcaaagttcaataatgtttaattgatgtcacattgctatgtggaagatcaaagtaatttgcagcatattagctctgtgtttcttgcataaaattatcgtcttgagagctggctctagaaaaaatgcaaaatcagtggggagaaaaacttcttcccactttataatgatacttcaacacccttgaccaaattcttatctccttcatctgaactctgtcatgccaccgtgtttgcctgtcatcactaaaggaaagcaaaccataaaattaaatcacaaataacgctagaatgatttgccttttaaagattccccaaatagtccaggtacagtgctcactcctgtcatcccagcactttgggaggtcgaggcggatggatcacgaagtcaggcattcgagaccagcctggccaacatggcgaaaccctgtctctactaagaatacaaaaattagccaggcgtgttgacaggcgcttgtaatcccagctactcgggaggctgaggcaggcgaatcgcttgaacccgggaggcggaggttgcagtaagccaagattgcgccgctgtcctctagcctgggctacagagcaagacttcatctaaaacaagacaaaacaaaacaaaatcccccaaacaaggaatcaatcactggatgatagtatttcaggcattcctgaggtacacactcctggcaactatctcttccacttattttttttatttcttctaacaaaaatactaactaaacttgactcaataattctttgttaatgagagagaaaaaaattgttcttatttcaacatatacttcagatagaatttagtacttgaataagcattcagaataaaatgcgaaagtattattaagggcacaaaagtattatgcacttaacgattatgccgataattgttaagggcgcaacctaacaatgtaggatgtgacaaaaatatcaatatcggctttattcaccttcatgatggaatgtaaggcattcatttcttatttctccttggctttggagttagctcactcatttctacattctagctgtctaactagaaaggcaaaacatagccatgtgtggtggctcatgcctgtaatcccagcattttgagaggccgagatgagtggattgcttgagttcaggactttaagaccagcctggcaacatggtgaaaccctgtctctaccagaaatacaaaaaattagcctggcatggtgtcgtgttgctgtagtcccatagtcccagctactcatgaggctgaggtgggaggatggcttgagcccagtgggtggaggttgcagtgagcagagatggcgccactgtactccatcctgggtgacagagtgagaccctatctaaaaaaaaaaaaaaagaaaagaaaaagaaaagataaaacataaataagcaaaatagaattttctctataagttctagaaatctaataatgccaaatttttagcatttaagtaaattgtactagagtgacagtttataaaggaacactatttaaacaagagcacctgtagacgtgtcatattttaagggcaattataagaaattctatccaagttgatattttccaataatataggattgctatttttttttctgatacatggttaagcaattttctgaattttttaaaaacaagatacatttcagttcatgaatgaccttagatatgagttttctcactaggtgttataaaatgcgctagaagagaaaaaaacacagaacaatctatttataaaccatataatgagaataaggtaccctttatctaatttgcaatccataatagaaactataattgtctatagttagaggaaaataacttatatttgcttatcaattgtaccttgaagggctctgtatttaattaaatgtccaatgacaaatctgattccaccaattgcatctttagaatcagagattgatagaagccacagagtcaggggaaccatttgccacaacagtgaaatgtgggattgatgtcacttcagcctgggatggtttatttgaaaatggtaagcctctggtagcatcaataatgccatgttattatcttttggcatttatgcatatactcctgatagtgcagtccattgagtattgaattaaagagatttcaagtcctgtccttcactagaatatagcttttcttgaagtgttaatgcaaaaaaaaaaaatgtaaagacaaagaaaacttgtaatcccaaatttttctgtaccagaacatgtttatataggtttaccaagggaaagagagggagaaatacattggatttaaggtagaacctgttcatatcaagactgtttataaatgacacccaaaatcagatactggggagtggagagggaaaggttagactaacctttttccacttaactgacttttgtgggactgtatagatattgttttaaaaccagtgccgttttttgtttcagttaaattctccagttaccaattcactttagacagtgaaaaaatggaatgacagagagtctgaatgaaacagactgatgaggcaacatctcaaaaaggcaggatacaaatgatgaaaggcatatgtcagccaaccaagttatctttgtgatccagaggcatggcagagagacacaaatctgtccctgaagttctcagaatgaaaagtttggttcatagttcaagcgaggttaatattcccaatctcattctattctttatctctctaccaaaagagacaataatgttgttcattttacctactgcaattttatcttctttcttgcagtgtcttttgcttatgaattaattttttattcttactgtgataagaacacttaatatgcaatctatcctcttaagaaaatttaagtgtacaatccattattgttgactataggtgcagtattgtagagaagatctctagatctcattcatcttaaccgaaattttatgcctgttgattaatatctccccatttgctcctactcctgtccttggtaagcatcattccagtctttgattgtatgaatttgactattttggatatttcatgtaagtggaatcattaagtatttgtcttcctgtgtttggtgaatttagtagtttcttaacatatctctttttcttatttgtttacactacgttgtataggaaaatattttttaaatgctgcaatttttccagtactagtcatgaatcttcataaatattctgactctatcctttccagcacatggagggattacacctccgtgttgacttggaaactaggtgtggccatatgacgtgctttagccaatgaaatgtgagtggaagatgcctgtgtaatttctgggtaggagctttaacagccagagactgctttaccatgttcttgtcctctgccaccaacatggactgaggccattccaacatccaaagagataaggatgaagacagtaaagaacagaactccagctgaccttcaatgaacatgttgaggaataaggggcaaaaagttctctgttatttttagatactgagattcagagtttgtttttttactgaagcatagtgcatatcactgatgatataaacactgataatagtagagaaatggataaaatagaaaaattctattttaaaacatgaattaatgatattaactatcagacaccgaaaatgtaacatatatccctgtgttgtcttagttccttataaattagtctggtgttagaactgtaattttctgacacctacttagagatacggtagggtgcttgttacagttcacttctttgcatggcattatgaaacataggcagccatgtttcactcctcataactagggtaataaaaatatgagaagatagagaataggcagcgcacatctttctttacttgaaattgttcagctcattttgagattgataaaatggcacaattaagtttaaaaataaagaagtgaaagtttcagactaaaggtcatgacataatttaaagctgagggcaaaatgatataattgaagagggaagagtgccttttaacaacagtaattgactaactcccagttaataatgttatgactgaaaattaagagcatagctatgctcaggtgatatatctatattaagaagaaagcaaaatcaaagtagtattgtctatttatatatcctactcatcaaatatctttgtaacagaattcttgattgcttctatgctagtcattagagttaaacatagaatattgtattctttatttaacctgtttgagtctttcattatggaagtcaaatcttagtctctctttaatgatatcggatagatattgctgtgatcagacaactgttctgtatctgtgctgtccaacaccatagccactgttgaacatttggtatgtagctagtgccacagaggaactaaattttcagttttactgaaattactttacatataaatgtaaagtattaattaatttacattttaagagcaaaatgtagctagtagctactatattaatcatacagctggtatcgccatgtaacctgaaactaaagttgaatcttcaaggtcacaaataaacatttgaaaggtttaatgcccaaccagggatgccatgccaaaaaaaaaaaaaaaaaaaaaaaaaaaaaaaaaaaacaagaaagaaaaaagaaaaagaaagaaaaagaaaaaaacaagcaaacaaacaaacaaaaaactttgaaaagtaccaacaccaaaatcttagcattcagagcctcagtattgttcaaaagttattaaagtggatgaagggagcacaatgaaaggttttgccaccagagaattacatagcatatgacaatactgaatgcataattttccccacttctttctaacttcttaatctaaatgggtcacatttctgtcagcaaacaaattcctatagtcaatacaatttcttggaaatctgacattattataaacacttcaaattactttaccttcttggtaaactatcagtttctcagatttttgtttccacacaagctcaaaagtctccatgtatgtaatttcactttttttaaaccttttagcgtatgtctcatgtggtcttgttgccaagagagtgtaacataagtacatttctaaaacttaccatttacataaaacttgaattttcaagtagagccatttgagacctcagatctattcttccatccctcttgaatgtatatggtcttgatttgtttggaactgccatccatgtaagtatcttattctaccactaagtggttggagcataggtaaaagtattcgaactttgggcgtgcatccaagatttgatttttcagcagtttaaaacaaaactacctgatgtgttccactgtatgagatcaaaaatagacagtgttatctttgtgagacaacatcaaaatttgatttaaaatattcagatgaaacatttttttcttaaggttgtttctgtgggtaaactcaagggaagattaattctatacctagaagctgtcattgatctggcactgatatacatatatagtctgttttttaatcagtatttggatcatattccaaagtgtcagttttatgtgatagttaaaacagtttgtggcaggaagaactttaaaagattttcatgaatctcaattaaataacttgaagttttaaaaattcaatcacattaaaatattttttgttttttaataaagttctgatttgatagattatcacattaattacaaaccttcagggctcgcctttgtccattgtttaaaatgcttagtgtagtgtgttaaaagttcttcaactctgggaccaaatttttagccccttcttacagaagttttttttccttctgctcacaacttaacttgtcagtccttgaaaaatgctctcttttgaatagttagaaggctattcttcctttccccattcaacaaatctcgctcatcctttaagactcaatttacatgtcatctcattcattcattcaacaaatagataatgagcacttgctgtgtaccagtcactatgcttagtgctttataaattaattcatttaatactctcaaatgtttttgtgaagtcgatattaatgttatcatttcacaaagacaggtaagaactgcctaccttttgtcccactccactccacccaccattctgactgtggaagctccatgggtgtccccattattggattgcgctgacaccattagtcttcaccaccagtcagtttctttaggactgcctcctctcccatggccaaacctcagagaaggactacatgaattttctagactgctataggtatacagtaaaaaaaaaaaaaaaaaaaaaaaagaaagaaagaaagagactctgattaatgtggcataaacctggttgcatcttgagaatttcagtctagagattcaagttagtttgttagcaaaatggctttagttcctactatgcttttcctatgtggtgactacaagttgtcttcttattcccatcaactattaagactaattaaggagtaagatattatttgtatttagctcattttgatcaatatcagaaaacatttattgagtgactattatgcaagggcatctacaaacacacacaccaaaaaaacaaaacttgatgtaataacaaaaaacaattcaaaactttgagagagaactgtcctgggggaagaagttgagtatatatttgaagcatgttgtttcctggagtgttatggaggatttaacacatgaacacgccagcagaatgtaaatgtaacagagaggttggggtaggagaaataggacacctctgtcttcttttcccagaagtgccccaaacctgtaagatgagaccatatgctcagtttatagcaggaatgttttggtaaaagacctattttttaattataatataatttttaaatcataaaatgttagtggaatttgagagattgttctattttttcctatatgcctgattggaaataattatttaaatggaaaattagatattgtttttaaaatgttacaaggtattttgggttttgaaactcagaaactaagaaatttattcatatatggcccagtgaggtgtgcatgaaagaaagaatctggttctacattcatgtattacctcaagccattcatatgaaaaattcaggccaatgaccacaagagggatgaagaagagaatttgttggatggatctgtctgaagccattaatgcttttggagaagaaccacctcttcctgcctttccattcttctagtactctaagacagtccctcagccagaatagcaataaactcttggcatctggcccaagtttaggttctctggggctggattgctcttatatcaaaaagtcacatatgagatccatcagtaccagcaagcagaggaaagagttcttctgactgctgggtcagtagaattcatccataattcactcaacaaacagcagttttatataaaagagaaaatacattttaccttgctgagggcaaaactaaatgtattaataaaccagttaagcaaaaagaagtcgccttcatattgatgttatgtaattgtcacttgcaaaacaacctgtagagcatggaaaatatcctatctaataaaaaaaatttggtgattataaattggacttagaagagtactaacatagtatattcaggtatcactgattactggcttgattaccagagggaattagaaaaaaaaaaagactttttaatgaacttggttacctaaaaagagaaaaaagagtataaacccagtttgtttccttacctgtttttttctaggttataaaaaatagcttctgagagacaaatagaaatataattgcctattacaattttattttacctgtataatgataatataatatcttttttcttcctcttaatctattattcttgactaatctcatctttgaaaggcaagtcttacattattttacatgtagatttttcacatttcttcttacaagtttgaattgttgatttaaaaaaaagtaaaataaaagatttaaacttactataaagagaaagcattggtatatagcaaagtgaatgaaatactggataatagctcccaagaagctcttttgggataatagtgcaaattgaattgcctgccttgaaagaacatcacaggtaggagttgaagaaattctcagcttctctgatttctttccagccagtaaatgtgtctatcaaagtcacatggtcagcactacttgcttgcttggttagacttgtattcagttaaaaaataaaataaaaaataaaagcaaatactgaaataagcatatgtttcttttctcctggcaaaaggacctactgtcttctgaaaaggaagtagattttaggcaaaaacattgtgtgtctattaaaatcactctacgtaccatcactcaaaagcattttttgaataacttcaggacctgggttctggtatttcttactccatcttgagcactgatctgctttgtgacactgattgagccacatccctgtactttcagtccctgtcttgcaaaatactggaaataaataatgctctttccaactgccacttgttatgcttctagtgtcttatttatgttatggaactctgctatgagaagaaaaatagcagaacacaaaatctatgaagtttcctggcctgatagtatctgttgcaaaatagtgtttctgggaggattacgtgaaatagtacatataaaatgtctaccacatagcatatgctcaacaatgttaatccacttgccacagggtcacttccaatatctcactctggtaaaaattaccttcaccacctgaaaatctctttgtatcaggcataatagctggacttaagaataacaggactgaagaatacctgaaagtctaaaattgttattgcaaaatcagtacactaacttttgcagggcatttttttttttgtaaagaatggcattctatttcaacacactatattttacttaacaactattagttattcaataagtggataacatttacttgaataagtgaatgaataagtcaattgaataccgtacttctccactacggcattaatgtataatgtatcttgggctatttgtctcattagtttacataggagaacctgacttactctgtgatactgatttggcctgtgtagcagattcctgtcgtgaattcaacacgaactgggaaaatttctctaacttttttaacctcgcagttgttttttttttcccttccatgtaatgggcataataacacataatgtacagagatttgtcaaaattgaagataatatctaacgtcaaatctatggtatgagataaatatgtatttatttttaagtaaatttgtatcacttttgagtatatcatgtgcttttaaaataaccactttaaatttactttttaataacatttctgaatgtacactgttggggtagtgtaggagattccctcactacctttggactaggctgttgctcatgacagcagaatgaaatttgctaacctctactgtgatcccgaatttcttgtgatcaatatcaaaaaaagatgtgaaaggcagtactgctcgttacactatagtttcttttaactatgcctatctattattatttggtcatagaaataagaaaatgacattgatataaaatgcaaatgactctttgaatcaataataaattactgctcacaaactattcaataacaagtaattgatttgaagccaggcagaattttagacttatctattgtcttcagctgtacagagttaatgaggatttgtaattactttggattttaactaatacatctttttcattttggaaattgattttatattagtgtcatattttatggtttacacaattacctgactaaataaaggttgacaaaattgaccataatcaaaggcttgggagtacaataagccattttaatgcatagaatgtgttttctcttttcaagaatacccatctttttaaattttttatgtataattgttaaaaatttctcctttagaattgtaaaatgggaaagggaatagcttttagtaactaaaaagcattattcacataaagttctttggatttttcaaattacattgtttacctagaaaaaagttgaaaacctgtatctggcattttaaatttctacgtcataagccatgtacattttctacattaaccatgtcaaagtgtgaacttttagtctcctttttaaaagactggttcaaaaaaaaaacaaaaaagaatataccagacattctttgaatgtcactcaccaaggaacacttacatatgcctcttgtgaaaaagaagaggcatagaacagccactgaagatattatcctaaacttttatttggcttggtttggaattgtccagcagcataaacacacgattgctgtattctcagctggaaacaggttaagctagaaacacatattactacagccaaacaaaatagatcaatttgtccatggttattcatttatgtttctccttgggggtccctaagaagcaaatgatatgcaaacagctgcatgattattgctatgctcttgttgctatttggtgattgctatttacatgtaaattactacttggcaaagtacaacttctcttcaccagcaaccagacaacaaaacagttcttactaagctgtccaagattaattactcaaaaatacttcctaaaggatgattcctttagatttctgcatttcctagaaaagtaattttagaatgaataaaatataaaagaacaatcccaccatgattctaaggcagtatctatttaataagcaactttagaagattatggaagaatatagaaatgtaggtttcttgctgtgaggactgatttgggcagaatgggaaagaaaagaaaaacggaaagctagagtagatgcttaaagacagatgataagagatcaaagataaacttgatttatttccaaattttatctctgagtcaggctagatgatatcactcctcgcccttaatgtgtttatacctaaaaattgtcatgagactagagattattaaactgcctgaattaggcaaataaaaagaaaaggagttctgcacattggtgtcagttaacacttccgtgcctttctttacaaaacaaaaattatttaatgatatgaaaatagatatatttacaactgggtcataatctatatgcagttttgcatgtttttctcctaacattatatgaaatgtcattttcatattaattaatgtaaccacagcaaaatgttaatgattgtataatatctcctttatgcctgcactgctacttatttagtccccagatgtgttgtttttcacttttcactattataggatattttaaaatggaaatacttaagcacgcatctttgttttactcatccagttacttacttggaatttttgtaacaagcatgtgattaaggattttatacatattgacaaattgctctccggggaagttatccaatttacaccaccattaaattagtaagagaatgtcatttccttcatttgatttcatttaaactgatcatagtatcaatagtctacttagtgactcttttttttccttcaatttcatgtttcagaggatattaatcaacccaaaaaagttcaagctgtattagtatagtcaagaaaaatgggaaaaatgaaaggatttatgattcaacagaagaatcataatccatttaatccacgtttaatccatttaatcctggtttttcacaactggaatacctatgattataagccatagatttgggggaagaaaaaataagaattttagaaacagttgaaacaaagtgaagacaaggtttattttcaaatataccttggagacttgtagattttatataaaataatagggtcaaaagtgacaagcttatttttacaccatttttgataaatatggttgactctatattaatcaagatagtaagggagaaagaaaggtataaatatcccctattactattttaaaaaggaattagtcataatgtaataaaaataaatttattttaaacttattttattgtaatagcatctagtatttttaacacataagtaattcgatagactatcattcagcattttttttcaacaaacattttatttttccagtactgtaggggtgaaagtaaagcatccccttcgccttcagaaagtttgctgaaaacccattccaaaaaggcagattaattggagaaaaaggcatacaaatgtattggatcatagtttatgtgacatgggagccctcagaatgaagacccaactcactcaatggggtgcagaagcttacataccatctggaggttacagaaagaatgagggcttggatcctggcaaaacagtttacaggagaggggagaagaggaattttgaaaaggagcaataaattacttctaggcggaactgatggacttgaagaacataaaatggtctaggaccaagactattggatccataaagtagacaatgttttgtgacaaaagtctgcctaggttttagacagattttaatcttccttcctgtgatgtgggttttgataatgaaaactcaagaaaggaaatagaggagatttttttcttctttggtgtgaccagactgtagacagataagggaacttcagcctgtgctttgggagaggtagaagattgaaaaacagtgggggcagggggtggggagggcaattgttcctctccttggtgggtctgcctggtcttcatgtagaggataagtgaaaagtctcttctagcatctgttgatctctaaaggactttaatttaaaatattcattataccagggagccatattttgaaatagtatttcctgttctccttcagtatttaccatgtgccaggcactgattgatgtcctggacctaataatagtgaataaaatagagagtctcttgttttcttttcatggagattccattgtagtgggagaaaacagtcaaaaatcaagtaaaaaacatagtaagcaaaatagaggaaagtattatgaagaaaaatagagcagattaaaagtattaaaaatgatagagaattacaattttaaaaaaagatgaacagggaaggggttttagggttctccagagagaaccaatggaatggataggcagacatagagacagatgtatacgggtagagagaaagagagagaggatttattagggtaatttcttccagatagaggatttattaggggaactggttcatgaaattatggagtctgagaagtcccagggcaggctatctgcaagctggagaccctgggatgccagtagcaaggctcagtccaaatctaaacacttcagaaccaagaaagccaacgatgtcattctcagtttgaggttgaagacctgagaacggggtgatggtggggtggggaggtggaatggtataagtcttggagtcccaaggtcaaagaatctgatgtccaaggacaggaggagaagaatgtcttccaagttcagcagagagattgagagagagaggccaattcctcttgcgtctctttttgttctatcaggcgcccagcagattggatcacactaaggatggatcttccctgctcagtccactcagactcacttgctaatcttctctggaaacaccctcacaaacataccccaaaatgatatcttgccagttctcaagctatttttttattccattcaagatgacacctaaaattaacaatcaaagaagtccaatctggagaggtcagatttgagcatagatctgagtaaaatgaaacgtgagcaatgtgaatgtctggggaggatgctcttaagcagagaaaaaccatttggagtatgcttaggtgtttgaagactactaaatgggccattctgatggtgtagttagtgaaaggaaaattgtcagaggggaggtcagagccaagaggtagtggtggtaaaacatggagtggaaggaaaacttacaggttaggctacaaaagtactttggattttttcctgaatgtgtctggaggtttgatattatcatactcatgttaactctccctactgtgggaagaatggattctaggcaatgaggatgtaagcaagagatcagttcagaggcttttgcaatatccaaaggaaaattattgaatatgttttgtagataatttgactgatttgctgtgtgtgtagatgtggggtgggagagaagtgaagtacattaatcagaactgtgaatttgcttccagggtaatagtttaaggaccaaaacattatataaatagtttaccagaagtatattcctacagtttttattccgatactatttttttttcaggagaatgtactcatctttgtctcatattttaggagtctaacaaaactaatgattcagctttaaaatttgtgaaatagtataaataaatcagtccatcacaatttctaccctttaaatatgaaatatttttgccacaaggtttttctattattgttagataaaaatcagcactttcttttatatctctatatatgtctagtcttaatattccatgcagaaagaggaatcaaattcataaataatacatctttacctcctaggtggaataaatataaatatggtgagttgtatgctaatcacaaatgtaatgtaaagcattttagtttaaaccttttgatgtcatttaactgattacaatgccaatcattcatctaaatattgaaattagtcatttttgctaatttaaaaagtcttccctaaattttttattgaaccattaatcagtcaaactcctaaggaaaatgaagacagtttttgtagtctaaccaagaatcaaaacaaattctgcaactcaaaatgctttgaggaacagaaaagatattgggtggaaaaagatatctagctttgagtactaatattcaaagttaataacagtgaatgactataatgcaattaaatgggttcggtggattataaatatattgattataaaaatattactataaaattgagttaaccagtatttattgagtactcactagggttaaggtagtttttaaaattattagctataaatcatattagagaataaaacaaagtttggaaattactatgtcatcatcaacttaatttgagcctacagtgaagagctgttaggtaataaagaagaatgtctttagggtatatcaaatgggcttataaaccaaaaagttcttgttcttctttataaaaatagccaatatttattttgtgtttaccatgcaccaggtactgtgctaagcactttatggtcaatatctttttcagtatttccagaaaccctctgagggcagtactgttattgtaaaagatacagaaactgaggctcagaattgttaaaatagtttgcttaaagtctcatgaagtaagcaacaaagacagaatatgagcccaggcattatgactctacatcccattctcttgaaaactggatattagaaatttggtaaatataagattaacatcccctttcctattatttgtgcaatatatctttttttctgtacataagcaccatcttacataaactatacataagggcaaaggtttgtaaatgtgtatcaagaaaattattatagatcctggcagagaagtcagagaacagagaaaggtaaacagcatgcaaggaaaaagctataaaagaaataaagatgagaggcagggagaagccaccaggaaaatttttaaagagatacatgacaagacccagttcagacagatttctggcaatgagccctgggaataaaagcaactaatttggaagtatcaataccatataaagtattgtgatttagtataaacacaacagtagtgctcagcatactatccacagcaaaagacatttatcttcactctttgcaagtcttgaaagagtaacaaatttctgaaagggaacaaaagagagtggggtcttgtagagaaactcatgtttataaggacctagacaagagatgcatcaggattaagaaataaaactgtgtaccaataaattgctcatgtgaataggtatataaaccaaggttcttcacatgtaaataaaatagttcttatgctttaagccaatggttctcaaactttagtatgcataaaattaatctggatggcttgttgaaatacagacgtctgagtctcatcctcataatttctgattctgtagatctggggcgaggcctggaaatttgcatttctaacaggtgattgccaatgctattggtctgggacaccatctcttgaaataggtaaggatgatgttgctaagaattgaagatgttatagaaaataaagtgggagatattttactccattcatctagtttatacaggcattctttccagtttttttcaacttttattttagattcaaggggtacatgaacaggtttattaactgggtatattgcatgaagctgaggtttgtgatatgattgattctgtcacccaggtactgaatataatacccagtagcttttcaaccttggacctctccctacttccctctagtaatcctcagtgtctattttcatctttatgtccatgtgtactcatcgttcagttgccacttataagtgaaaacatgcagaatttggtttcctggtacttcgttaattcacttagtataatgaccttcagctccaccttgccacaaagcacatgatttcattcttttttatggctgtgtagtagtccatgttatatatgtatgacattttccttatccagttcaccgttgatgggcacataggttgattccatgacttcgctattgtaaatagtgctgtgatgaacatgtgagtgtatgtgtctttctggtaaaacagtttattttcttttggatatatacccagtaatagcaatgctgggtcaaatggaagtttggctagtggtctatcaattttgcttatcctttcaaataaccaacttttggttttactgattatttggatgcatttttgggtctcaatatttccttcttttctgccgtgattttagttatttcttttcttctcctagagttgggtttaattattgtttttttagtttttctaggtgtgatgttaggtcattaatttaagagctttctattttttgaggtagatatgcagcactataaaccttcctcttaacattgatttttctgcatcccagaaatttttgtatgtgtgtatctattttcatttatttcaaataattttttgatttctgccttaattttgttgtttacccaaaattcattcaggagcaagttgtttgttttccatgcaattgtgtggttttaaaagatcttcttggtattggtttacagttgtattccactgtgacccaagagtatggttgggatgattttgagttttttttaatttatcgagacttacttcctgggcagatcttggagtatgttccacgtgcagatgaaaagaatttatattgtgatgttgatagatggagtattctgtagatgtctactaggtccaatttgtcaaatgttacgtttaagtccagaattcacttgttaattttgtaccttgataatctttgtaataccgtcagttggtccccctctactattgtgtggccatgtgaggctttttgtaggtctagaagtacttgttttatgaatctgggtgctcaggttcatatatatttaggatagctaactcttcttgttgaattgaatcctttaacattatgtattgtccttctctgtcttttttttaaaatcgttattggtttcaagtttgttttatctgatataagaatagtaacttctgctgttttatgttttccttttgcaaggtagatctttcttgaaccctttactttcagcctatgtatgtcattacatgtgagatgggtctcttgaagacagaggaaaaatgggtcttgtttttgtatacaacttgccattgtaagtcttttaagtgggttgtttagatcgtttaccttcaaggttaatattgacatgtaagcttttaatcttattgtgaagtcattagctggtttctttgtagtttctattctatggttgctttataggtcctgtgggctatgtattgaagtgtggttttgtggtataaggtaccactcttttttttctcttttgagatagggtcccgttctgacacccaggatggagtgcagtggcatgatcataggttattgcagccttgacttttcaggcacaatggatcttcccacattagcctcccaggtagcccaggtagctgggattacaggtgcacaccaccatgcgcagctaatttttttttttttttttttttttttttagagatagggttttgccatgctgcccgagctggtctcaaacctctggtctcaatctatccactcacgttggcctcccaaagtgctgggattataggcatgagccacagcacccagctggtattgctttttcctttctgtgtttaggaatcccttaaagatctcttataggctaggctagtgatgacacattcctttagcagttgcttgcctggaaaagatgatgataacaatcctttgaaagcagttatacgttcctgcttcatgttcccctggttttcatcatagtttttaatgttatttttcttaaaaaataatgttgtccccttacaggacagttagtaatataattgtatagcaggaataatttgtatcagttatgatggagttttcattccctggaagtggttaagttcaagatgtataattatttttctatgttttacctgaaatcctacctggagtcaaggaagcagaaagccaaatgaatcttaatggttcataaacagactttctgactttctttctttcttttttttttttttttttttttttgagatggagtctctctcttgtcacccaggctggagtgcaatggcacaatcttggctcactgccacctccgccttccaggttcaagcgattctcctgcctcagcctcctgagtagctgtgattgtagttgcctgccactgcatgcagctaatttttttatatttttagtaaagacaaagtttcaccatcttggccaggctggtcttgaactcctgacctcaggtgatctgcccacctcggcctcccaaagttctgggattacaggcatgagccaccacacccagcccccataaacagactttcttagggtaggaataatggctactctgagtcctacactgtcttttctaatatcctttctgcagatgatctctattgtatcaattgtcctttatgcaccaattattcaaaatttatatctttgactcgaatatctcctcttagccccaaactcatatatccaattgcctactgaacatctccacttggctggctttctcccttttacgtacccaaacctgaactcataatctcaacctcattcctaaacttattctccctccttttttcctgtctcagtaaacagaagcactatgtgttcatgtgcttaagccagagatttaacagtcatctttgatactttcctctttatcttttaccacatctaatcaatcagtaactgcagttgattctctatcctatacattgttcatgtttatttcaagttgcataatggctcccaaagaggtccatatcctaatccccagaacctgtaagtatgtcactttacatggcaaagtgttgcagatggatattatgtggctaatcaactgatattaaactagaaaaacatttctttctttattcctatgaacctaatgtaatcacaagcacctttacaagcaaaacagggagacagaataggagaatttgagaaagatacagctatagtagaaaggcacagagagatacaacattcttggctcagaaaataaaagctaaggtatgtgtgtagcctctagaggcttgaatgggcgaggaagctataatgactccatgttccttcttgcctcagagagaccttttatgtgctactacatctatctgggatactttccctccccacccactcctatgccacccccctaagccaacttctacctggctaccagggttgatataaaatattacttgcccagagaaaaactatctgaatttgcataatactagattgtatcccccctcccatcatgcattagtgttctgcaattatacattatatcactcgctactatttcagatcattaatatttgtgtaacaatttgtttacagagtttgttttctccaatagatttaagcactagagaatatgaggccagaatatatatccactttatttgttgtgatatccaaataacttgtacactgtttgaaatagagtaggtccacaggaaatatctactgaatgagcacataattaaataaatgaatggatggacaaatgaaggttaggtgaatgaaatgagaaaatacatttatatagcgtgcgttatgccagtttaaggtatattttgaagtggctatacccctttcaggtagccttttttctattcacagctagaaatttgacagaaactttcaagctgggttttcaaagtagatttgtcttaatcttgaccaatgggccagtaaacgccccagtccataagagttatttgccattctatgaccatttttctatgcttccatttttacacttatacacagacactcatcacatcaaaattcctttgaagaccgaagaaagagattgcaatcacagataaaactgcagttgcttagaagtgtgagtaaagctattttcatcagtatttctaaagagtggcataaatatatggctctctgtgcatgaatattttttaattttcttcggagctacagaagttcttttggtctcttttacatacatttaaattgaccagtatgaaatatttccccaaaaaaataaatagctaaagtccaagatgttgcatatcacagaggattatcttagtgccaaagaaaataccagttgttcatattcacactcttttctcataatcacatgtgaaagctacaattagtatgtaaaaacgagaatctcatatatatttgtgtgtgtgtttgtgtgtgtgtgtgtgttgtattaatcaggttaaaaaaacacctgactggtacaactaatggttgtgctaatcattagtcgtggtaaaaaaaatcaccatcactagtggttttttaacctgattagtacaactttccaaaataggaatatagactggaaatcatacatggaaaataaattctaatttttactgatgatgttctattggcttcataagtgaaataagcaagtaacctctgttctcagaaaaaaagaagtaatgcatatacacacaccatattcaaattaaacccacactttctcattgatatccgcatattctttaagaaagacaaaggtaaaacttaaaattcaaacacttcaaagacacagtcatttgaaagcttaccttttatgtttcattcacttgtttccttcattccctctcttattcattcattcattcagtacatttctttaaatggcacccatgtgctagacgctatgttaggcattggagaggtacttgcaaacacaacagacgtagtccctgctctcacgtaccttagaataaagctataacagaacagaatttaatatactggtagtacaaagaatatggaaaagaatattttcttaaagggaacgatatgtataaaagtactgaagtgagaaagaggtgggcattgtgagcaagggccaaagtatccagtggcaaaagatgagacatcacaaggttatcaagcagggctctgcagggcagggatggctgtgtgaactacagtagttctagaactgtgcttgagtacccacaggatgccatgggtttgggcttacttattgttagtttttacgttgctcaggaggcatgctattctcctagataagatttggaagtggaagtgtaaggatgagagcagaataaatagcctggaagggctgaggaaaggctattgcttggagggaggggagttaaagagatggcatgatccacaggaagtacagttttggcgggggaaaattgggcaatttaagcaggattttaatgacttattgttgactgatttggaggtaagctatattccatctcccataaaaattttcaaggaaataccaataaacaatggcttttcagttagaattgtatgctgttgatcggttgttatgtaacattggtatcaagatggtaacggagagcagggctacctaaggggtctccctgaaattcagagttaaaatgttaagtaacttttattatatcctcgtggcaatggtaagaaaattaagcacgggagttatctgatcttatttaccgtttaagaggttttccctggcttttgtgtggaatgaaatgagttgcagagaagcaagagtgggtacagaatcactaattaaaaggctattttagtgttcaggagacagaggatagtggcatggactagtgagctagtgatgaagagcaaaggaaagaaggatttcaggtattttggggaggtaaatgcaacaaaccttgatatggatttgatatggagtgtgaggatttgagtgactgggtagaaacatatgctttttactgagatgggatatgggaggaagaatgattccaggatggaatgagaggaggtttaatagttaagttttcaacatgttaaggttgaggtatttgtgagttatccaaatggctatgtttggggggaaactgacacaaaaagcctggacttgattcttggcaggtggtaatggtcgaaacaaagcaggtgaaagagattgccaacagagagtataaatgaaaagggaacaaagcccactgcctaaaaatggaaataaaaaaaaggctgaccagagaggtaggcggggagaacaaaaggcatgtctgaaaataaagccaaaggaaaagaacttttcaagaaactggctcatcataataatgtgcttaccagtgaggatctaaaaacctcgaatttacatccctgccttacagttgaggtaggctgaagttgggggaagggagacttgaacaaaaataatttcaacaagtccatgataagggccatgatagaagcatgtacagagtattctagggaccttagagaagcatttaattcagcttggaagggcactgaggcaaggagaaaggtagggcgggggcatccacacacagggactagaatgtacacaggcgcagtttagagagacaacagattcatttccaagaggaggccttgggagtagaagaacactgaacgtttgagggctttgagcaaaggaaaagccaaatcatatatagccaatttggcttccttcaacaattcttagttgaactctggttgacctcattagacaacttctctcattagactgagaactctttgagggccaaggtcaacgcttattcaggtttctaatacttatttgaccatgagttatttacctatctcctggggcagtttcctcacttttaaaagtagacactcaatataatgattatgaaaattaaataaagggtgataatggatgtaatgcatctcatatagagcctgcctggcacatactaaaagcacgacatatggtaggagctggtagtggtagaagagatattaatgggggcagtaggagtagtaactgtagtaatagttgaggaagtaaagtcaactgctcttgcttatttaaataatgtcttctcaaattttaggggttttgagatatatttgtcagtgtttctagtttatttttacatggagatatcatggattggtccattatgcacattgttgaaataagcttgctagtgagggcactacagcagttaggatgaatcatatttatcttttgagaatatcatgtgacattatagttaattttgagtaactaagcaataaaatccccaagtgtttcatacgtattttttagaactgaaaccaaatggtgcgctatgtattatgaatgcaccaaaggttctaataatcaagaccaccattttgcaaaaaaggtattttccttaaatacaatctatctgccttgagaaagcaaatatttatgattacacagtttttgcttttcatatatagcaaaactagtgtttttgaattatgatttgcaaataaaaaggcaactcatattttctatttttagtattactctataggattattatagactttatgtattataaattattcaggcctttataaaaatagcagaacagtatattttaatattaattttaatgatattacaaaatggacagcataaataagagatagttggaaattctgtggtaattttctcaaaaatgaccacatagatcaaaagaaattatatacactgatgtttatatgcagtcattggcaatgacattaatgatgaatagcaacttacatatgcagttaatggtgagttcaacccatcacccttcacacaggctgtcagcttttagatactctgcacaaaaatgtactgccaccaacagatatgaaaagaattgccaacatgagaggattaactgttccatttaggatgtccagctggctaatgggattcattttggtttgttgtcagattcagcctggcatatttaatttttgttctcttgaaagtatagcttctcactgagattctgcacgcataacaccaatgaaaatggcgtagtaaaaagttgaaaaattcagactccctgtttatctctagcaacacagctacaaagaaaatataattatagttttgcattgggaatgtatttataagggcttattggaccccagatagatattttaaccctgatgcaattcaccaagaaccatgtaaagttataaatgtggccatatgcctcttcttcactcattccctccacacgtatttattgagctgctctctgttctcagcaacagtgagcttgaccccctttaccatataatctgaaagggtctagactatttggccttttgttactgatattagttccaatgggaggttaccgagggtaagtaatcaagatacttgctggtaactggagttaaaaattgaacactacaatttgtatctaatttcaaagatggttctccctcaaattcaatttataatgtcatttgattttgattattttttaatgataccaaagatggatttatagatggaagaaccaggaaaagcaaaagctagtccagcaggtgaaatgtcagaaaataacgaaggattgccaggatagaaatcagaaaagctaaatggaaaaatgagataaatctgctaaagatacaaataaatgatatctttaaactccttaaatatatcaacaaaaaaagataaaggaaatatgtcttctgcaggagatagagaagggctcatagctgcttctaataattcaattacattcaaaaataaacttattgagcatgactttttcctttaaactcagtttttacaaaaataaatgaaatatgaacttagaagggcaggctgtaaacccttgaggatgtgcttacagaatcttattttcttctatgttcccctgaaagggtggtattctcgatgaaattcagcctccacattttattggctgtatttccttgggcaaattcacttttctaaacctcagtgtcacaaattatgacacgggtggtaggaatttaaatgagataatgaatataaagtgcttatgtcagtgccaggcatatggctaatgcctaataaatgataaactggagttttattattttattccatgtatttctttatcaatcaattgggttcattggactacaaatccctgtaaatcaggggctgttatttatttttgtattcttagcatgtaacagagtgcctagtacattgtacctactcagaaaatgcttgtgcaacaaaactgcacattctgatcatccatcagccttaaaggcctctatcaatttctaccaatctgcctaaatttgactttcaagatgcggcagaaataaacattttcccaaaagctttccatggactccagtccacctaccaaatacaagcacagtgagttgccctgtctctgtatttcagttgtattttattgttttctgcactactccaaacatgaggacattgcaattatttgttcatgtgttcatgttttccctccaattaactcatctttttatacttagaatttataccgtggcttgtatgtagataactctcagtatatattggtttgattaattgttaattcattcattgattcatttaggggtttattattaaagttaattattatattttctcttgggattctaaagacataaagagacaacataatttaagttgtgataaaaacatttacattcctgtttggatatgtgttatcttgttaggttggatataaaagtgtttttttttttttttttgagacagaatctcattctgtcattcaggctggagtgcagtggcatgatctcagctcactgcaatgtccacctcctgggttcaagcaatcctcctgcctcagcctcccaagtagctgggactacaggcatgtgccaccatgcccagctaattttttatatttttagtagagatggggtttcaccattttaaccaggatggtctcgatctcctgaccttatgatcctcctgcctctacctcccacagtgctgggattacaggcatgagccactgcgcccggccagaaaagattttttaaaagaattatatttaaatccctcagataaaacaagtgtgcctcttaccataaaattgtgagaactaggttagatcactttcctaattttcttccatcactaatagtcttaaataagcaatatattcattaaatatttactacttgcccagcacaaactaatatgacgagttttcttacacaaagagtaaaatcaccatgagtattactctctcttctgctttctgatattggtgacaattttaactgtgctgttttctgactagcaaatatggctatggtcacacctgtagttgctggtattattttgtaattctttcatctttcattcgggtttatgatctcttgtttctatttggtttcaatcataacttataggttgattttaaatgatggtccatcatctgctttgttagatatatctctgctgttctttgagttaaggtctggtttcattcctgttcgtaatttattgaatactggtacatgatattatttgtcaccattatctggaagttcagtgctatgttcaggggcatataaaaatgatactctcaatctataaatcatacagtattgtcttaactttggaataatgttttgttgaattaggaaaacagatgtgactaaatcatccatagctcaatgaagatcagattaaacccaggattgtcaaagcagacgtacaaaagaacaaccatcagcataacactggtcttgggaatttgaaatactttgtccttgaatatggtattcaaggctggctatttcaatcttctgttcaatataaatggaaataaaatttcttcatatatcactccttatggcagtggcatttttacatcttttctaaagatcacatattcatctgtatttggacttagagcctgccagaaatctgatttatgccagttcttttgcttttcttctaatttagtttgaggaattaaaatgaactttgctctatttcccttgaagattatattttcaattctggaggaaaaaatgacctattttatgcttatgttcttttaatttattttagttttttgtaataattgacattaatcaatctagtgataaataaaatcattatacaaaaaaaatcatatgaataataaatttttactaccaggacaatatcacaagtgtgttcacagcactttcaaagctcttcctaaacaaaggtaaaaggatcatcatttgcttaaacaaactatgtgtatgcccagtatggatttattacaccattcagttataaagagaatgaaaataaatatgggcctggtttccacattgttaaaaaaaaaaaataaagtaacacagaagaaacaaacacttgggaaaaaaaagaaaaataatatgtcattttatttcacctttcttatttagattggacatcaagaaaagtctatggtaatgtgaactccattacctgcaaggaaaattagagaaattaaaatgaattcagatatttttatcattaacagtttaaaataaaatatatacttacttaaatatgtatgtttacatatatgtaatataatagatattttaactaaaacatacactccaggtataaatacagaattctatggcatataaaagatttaaggtaaagacaaggatgtgtttttatattttactaaagaaagatgttttccattatccatttctcttttatatgtaaatcattcttccatcacatgtgtcaaatagtgttgcacaaaataaaatgtaaatatcaattttaatattcaggctgttttacccatataggaggcttataatgtgaaattcctactgtgaaccaataattcaaagagtttcaaatataaatttatttcaaattggaaacataccagaaactatttattcaactattaattcaatttaaaatgtatctactgaacactagctatgggccaggtgctatgctaaatataggaactctcatggggaagaaagcaagaaattacacaataaataaattctaatttaaatacctagatgataaatgaaaggatgacattcatttttatctgattaaatagctatctcaaattatccatgtaatattatctaaataaaatctcagggaagttggtgactgtgtgtgtatgtgtatcaagtgtcctggagtaaaaatcacaaaacctggaatctagtcacttattgagaacttgggcaagtcagtttatcactatgagcttcagttctgctggtaaattgccatacattatcaggccggtatggaaaatgcaattaggatatgattaattgaaatacattataaaaagtactttaacaaaattatgcaaaagatgatgtgggagcaaagagagtaaagcattacccatatttcttaatcattctgcccacagtgtaaagggtggttttgagagaactgggaagacagccagggataccagtcaaaatgatggaaatatctaggtgagtccctaaatattgacactggcgatgaacttgaagaataaaaaactgacttgagagatattggaaagatagaattaacagaacttagttgacaaaatagatgacggaaagggaaatgaaggacagagagtcatctggattcaacttgggttagggtgccactcattaagatagaaacatgaaagagaataaaataagggagatgagaaaatgagcaggttaagaagagttgatttaagggtacttttaaaaatccaacttgaaatgttctgtaggcaagtggatatatagtcctggcactaaggaaaaaaaaaaatgaaccgataccaaacatttttgagttaacattcactgattcaataaatactcatggagtacctactatgtactaggcgcttttctaggtaccgggaactcagcaatgaacaaaacaaagtctctgccttaaataatttgtattgtatcagggaaagtcagatgacatttttgtaaagaatgtgatttgtcagattgtgttaagtgcaatggagaaaaaaataaatgggtaaatggaatagaatgccaaaaaataggaattaggattttggcttcatataatacaatcagaaaaggcctattcatttaagaaacagcaaacagattactatggctgatgatgattgagtgatggggagagcggtaggtgatgtggttacagagctcgtaggaggacagaatgtgtgaggtcttacggtcactgaaggactttgatttttcactttgagtgatatagaagcctttcaagtgttgaggaggggatcatgatatgacttattctctactggattgctatgactactgggtgaagaatgaactgaaggagcataatggcagaagcagaaggacaggttagaatgctattgtacaaattttaggcaagaaataagggtggcttgaaccacaatgcttggtagtagagatgatgagaagtgatatctttctagacgtatttggaaggtagaaatgacaggattttctagttgactggagtttgagtgtatgggaaagaaaggaatgcaagatgattctagaatttttgacctgaggaattgaaacaactaaaagaataaaattagtccttattgatggaaccatttgcagaaaaaagtagatctggatgactgaagaatttaagtgagaacctaatataaataagaatatttgaagacagttaaatatatacattggtagcaggagatgtagtcacagggcagagatatggcataatcaccatatagattataattaaagccccggtttagctcaccatggaatttgtgctagtgaaagaaattgtagaagtaccacacttcaaaatttgaagtctttggaaataaaaatatcagaaaaagaaactgatttacatagtcatttagatagaagaaaacaaaacagaagtcaagagcagaaagtatttcaaggagaagaaaagaatcccttgtgccaaatggtgctgatatgtcaagtaaagatgaggacacagttttgaccatagcattttagtaacatagaattcagtggtaaccttgacaggagcaggcgcagtaagccagggacaaaagtctcattagggcagtttcaagaaatcataggataatggccaggtgtggtggctcacgcctgtaatcccatcactttgggaggccaaggtgggcagatcacttgaggtcaggagttcatgatcagcctggccaacatggcaaaaccctatctctactgaaaatacaaaaattagccgggtgtgatggcacatacctgtaaccccagctactcgggaggctgaggcaggagaatcacttgaacctgggaggtggaggctgcggtgagctgagattagcctgggtgacaagagtgagactctgtgtccaaaaaaagaaaaaaagaagaaagaaaataataggttaatatttagagaaagcaagttgtagactcataaagaagagaagaaactgatggctaagaatataatccctggtgcaatgctctcaagtatggaatggctgacaaatcctagcgcacagtagaaaggttagcccagcagggtgtcatgataagttatcaagagaaagagaggaagtagagtagaaacaagggcatcccttaacagtgaagaggggaagagatagaaagtttgagccaaaagaagttggtgtgaaataattgcctgaaagagcagaagaataaataaaccagtgatctccaggcagtattaggagcttacttgagttagtgctcatgaattttaaaagaaatatgccaacatggctttgtatttttctccagctgtgtttaactgtatgggtgcaggcatagaggaggtggagagttcaatttaaaatagaacttcaggttttaccaagtgagtatgataaatgtaaagagggggaagtaaaagaggcaagaacataggaagaagtggttatgataactcatcatggaatttaagctagataaatagatggcaaaggacagtgagattaatgaattgttggtcttgatgagattaaaggcttgttggagttagggtacagaaaagggtgaactagaaggatggagttgaagttcaagagtaggatatttgcaattgagattatcagggggttttaattactagtaaaggaaaggccaaaggcctgaccagaggcgtgaagagccgagatgagttagaggacagaggagggtaagaaactgagaagccagagaagtagaataattatctgggatattaaaatcaccaagaattaagacagatagagtgttagaatgaaaaacggcaagctaggagctaaaattttcaaggaatgaaagtgattaggaagaaggttactatataattctaacacaaagtgtcagttggggctatgacctggtgatgtaagagtcaaagttgaatatttttagtgaacaggaaatgagatgttctggaaagggcagtgagaagcaagaaagtcccccatccttcagctgccatccttatgggcatgagcgttgtacagaaataatgttcacatcaaagggctaacagggaagtattgtcggcaggaaaaatccaggtttccattggaacaaaatggtcgaggaaaaattgaaagtttgcaaatatgacagtatggtgatgactgaagcttcatttccatagggcacgtggttggggggaggcatgttaaagttggagaggggtagaattcggagtctaaaaaggcaatacatacagccatgtggggattaaagtctagggaatgaaagacgacttgggagtcttgcagttattgtgatttcaaggagcagggaacagggaaaaatgaaattagcccaatcctgagggttccaaggcagaaagtgttgacgagactgcttgttttggaaacagtgaggggtggggtgccctttgaggaacacacgaacagttgggacttcctaacttctgctttgtggctagcagaaggacaatcctgagcacaggggtgttcttttgacctctcttaatagtggcttgcagaaggagaggtatttagcacattctcagaagagagaataacaacttacctctatttagtccctaatgcattttgttataattttgtagcagtcttctcagagtgaaaacatcttgaaaacctaggaatattaattttgtttcccagtgcttgtcaaagtatttggtacagagtatcctctaagtcaacatttgttatagaaatgaataaaatagcgtaagaaatcctaacctgacagggttattcaagtgatttaactggtgattaagttaggtagcatatgtgtaatttatggtaagctgaaaattcttatatattatgatgggtaatttgaggtgtcaatttgactggattaaaggataccttgaaagccagtaaagcattatgtctaggtgtgtctgtgagggtgtttctgggagagatttgtgtgtgagttggtgggctgacaggaaagagctgccctcaatgtggatgggtaccattcaattggctggggtcctggatagaacaaaaaagcagagaggaaaggcaagtttactctctctttcctggagctgggacaccctttgtctcttgcccttggacatcagaacgccaggctctctggcctttggacttcagtagacccccaagttctcaggctttcccctcagacggagaattacactatcaccttcccttccctggttctgggactttcagacttgaactgagcctcactaccaggatttctgggtcaccagcttgcagatggcctatcttgggacttgtcagcctccataatggcataagccaattctcctaataaattccctctcacacttctatgttatccgtctgtctgtctgtctgcctatctgtctatctgttgatctctcttctatctttctctcctgttggttctttgtctctggagaactctgactaatacatatgtagattgagcatccctaatctgaaaatccaaacatactaactgctccaaaacccaaaatttttgagcttctatatgaaactacaaatagaaaatttcgcacttgacttcatgtgacaggttgcaatcaaaatgcaggtgcacaacataatttattcagtgtctccaagcggttactgtatcaagtaaccttttaatcaaaacacagcatcctaggtgtagacagaaagcttggcattttttgctgttgctgttgttaacagctgacacagatattcctgggatgctactgtgtttcttggttaccctgaacacattattttttcactgcattaatgatgtcattttttttttactgtaaagtacttatatgtgaataagttcaggaaagtgattacatattagtagaatataaattcaaactgagtaattattatggtgatgccaaacaaccacagattgtccacgtggatggctgagaaaatgacacctttgctttctggtggttgactgtacctaaaccttgtttcatgcaccaaattatttaaaatcttgtataaaattatcttcaggctatgtgtacatgtatgaaacataaatgaattttgtgtttagacttgggtctcccaaaatatttcagtatttatatacaaatattccaaaatctgaaaaaattcaaaatctgcaacactactggtctcaagcatcttggataagccaagggctactcaacttgaacatacaatgtaatatgtatgaatcatttcatcctagttttatgttttttttctagtcatgtttgaaaatgtatctgtaacattgaaccaagcttcattgacgacatctataaggaaacattactttcctctcccttattatctcagtattaaacacatttggtgagtattctaattgttaaagccagctggagcctgaaaactgtaaatgccagtccctgagtaggaggtaggatcttcctactagtcaactctagccattgacaaacatgaactaaactcagaaaaatgagactcgctgggcaaaacctagttatactaggaaagagaacagatctctttttctcttgggtcagattttaaagactccacctgtgcaggtctgcagtcactcctggacagaatggcaatgtgcagctggaccagttccgggaaaaaaggaaggagattccaagggaaggggagggcaatgtttatgaactacagagtttaagctatactcctctatgccagattgttagtaatatggtacccactctatttatgtattccacttttgtctttaaaaaatttagagccagtgtggcaaataaaatttagggaaggtcaggttcatctatgcatgagtcagagctttcacgggaaagggacctgaggtagccagagggatgctagcagaaggcattggtagggagagatcaggtggtgtgatttgagcttttttcctcctcaaggcatgatctcaacttgtaaacagtccaaaggtttttattatccagatgattctcattttagtgcttaccttgtatatttctggttttctcgcattaaggaaaatggcattttcttacatcattctctgtaatgattctctataacaattcctattaacatttaaaaacaacattatttctaaatgaacaattcaagctcaatcatgactatcaaattttactaaaatttggtagtttagtatctgcttcgatccatgtttcataaaccaattcaatataatgttaatgtgttctgaagaaacaaatgagtttcatggttaaacaagtttttttattttatttttttattttatattcagtgggtacatgtgcagatttgttatgtagatttattgtatagtgctggggtttcggcttctattgaaacccatcactgaaataataaacatagtaccccataggtagtttttcaagcctttctctcctgctttccttccactttttggagtcccaagtgcttactgtttccatctttatgtctgtgtgtacccactcttttgctcccacctacgagaacatgtggtatttgattttctagattaaataagttttaaaacactggattaaacagttaaacagacttagaccttcttggcgcattcaatatatgcatttgctctgactctgaaaggagatacagcataaacttctaatgcttatttaatctcagaaactcctttactggagtacctgttgccaacctagatgtcatccacaaaatataattgggaaattctaatctaggtgattaaattatgctttcttttcttcagcctattggagtgaggaatttttttttttttgagactgagtctggagtgaggaattttaagggaacattattcttgtatttcataataaagccctgtacttggttataatgttaaaaaattgattattcttcagaattcagtgtgctagtttccttccttctttccttccttcctctttttctttcatttctctatcatctgtctccgagattgatgcataccttcctctttcatactgtctttctcaagtttaggtgtcaagtttatggtaccgacttcacataataaattagagacctttccattggggtcatatctttaaattctgtcttttttaactagattcaataggtctttaaactctattaactacctgtgtgattatgagaaagtcacttcttgatgtctcatttttgatatatgtaaaactcaggataatcatacctactttgtagagttcttgggaagagtagacaaaattacgccgctaaatcacttagcacataaaatgacatttaacaccaaacgagtattagctactgtcgttaccattctggatagcatacagctggtttcttccaccaaccaccaattatatatgtctttattgaagtcatgtttttggtgtgcactggtttggtattttcagacctctaacccatttgctgctcattgatcactaatctcttggctctgcaaatgatgatgcgtttaaatttctgatgagtgactcttacgtaggtaggtgttacacatttgcaacatgtctgaacacacggtttgtatttaaatggaaactgggacttgacaggagcctctggggaatcatcactacctaataggtttccttaatgaccagtcaattaagaacttgtatttgcaaagtgctttgccatcattgtttttctttcaattctctgagccattactatcatcttactgatgaaacagagatacagaaaggcttattgacttgcttttggctacatggcctgaaattccagggactctagggatttaggtctcaaaaatcctgcagttctaagcaaacagggttaggctttctcaatagactcactcaagagacagagaactaaatgtagcctgctcacaaaccatgagaggacttaagggcttttggtctgtaaaagagttctgtgatcgtccccaaatcactccattaatagccgttctctaacagtcatgatttgctcattaaattattcaccagtattagaatcagataccatggaatagagaagttttatcttaatgtgtgagatatttcaggatgagtgttacaagacttaattcttaagtaaaaagcgagacattccctttagcttctctgtaaatgtagtaaataccgctgtataaatataagcatgggctctttgtagcctgcaaagcagattttgtgttttatgtgagggaaataacaatcagtaatacttagggttttgaattcagggtttgattaagggtgactgtattacaatttttctcatctaaatagtgttcattaaatattagaagaaaagagctcaaaatgtaggcagtgattatgtctaaatgttggaatcatacaagatctttactttcttccgtacacatttttacaattgtcatatatattataatgaattgccattacttttatattttctaatcaggagtacacacacacaaaatttaaataccctttgtgtttttataacattagatctatgatttttattataaggagggctgagagtataattacagaaacagcctgttagcttctcttaagaaacattctctcattatttcaagttttgttttcccttggatctcagctttttagtgacaaatgaaataagtattatgtcagtttgtaacaaattattcatttcaaaataagaactccacagaacgtttaattactattctcagcgagtagatcatattcactgttgaaaatataatatagttagaatcttctgtttgggcattttatacacaagataaattcattttttcctaataatttttacctttaagctaatgtaaagggatataaatgattaggcaaggtgacttttaaatgttgtgaacaatgcatgaacatctttaagtatacatattagtagaaatttattgtgtcagctctttgtaatatatttcactaagcaatgcaaaataaaataaaagatacagtctccattttcatcattgcctataatctaagccctcctcatattttgcataggctatttcagtaacctcctaaatgatctctttgctagcataatcctctgtttcacatgtaaacgtgatcatgtcttttatagtctcctcatgcctctttctctacaggataaagtccatactctttagcatggcaaacaaggtctctgcaacctggtttcatctttctgttaccttctgccagcccacctcaaatttactctggaataaggttgggctgctgaagtcccctgagactccaggcagggtcccatctctgtgcagctggcttatactattttctctccattgaatttcacgcattcataggggaaaggaatgagctcttccgtctggtctttttatctcccttcttcagaagaggagtggcttatctgacttgtaagaccagtgacagctagatctgaactgagttattgtgttaaaggtcactgttcttatggacttctcatgtctcatggtatcttgcctcagttctgcatccttaggtggaaagagtttgtcttgcccctataagttaaacctgaatcattcgaacctgcaactcttgcctgcagctgggtcagttctgctcggaagccgcgatttatacacacgtctccaccattttctccaattcaactctgctaggggagccttatatttttttgtcaaaaaaaatgcgtgtatttgtgtgtgtgtgtgtgtatcctttattgtccctttccttctattatatgtcttcatattattcacgacacccacagagaagaaaatgactaataggatttggggtgcaaaaacctgccttgaactttcgaggttctgccattctccagggactgggtgctaattttaccttatggtgggatacaggaagccttgccaggattacaatcaggttttctataaataaaactcactgatgacatttacgtcttcattttctctctagggagtgtttctaaattgtttaatttagaaggtgtatgtttgaaaccctaaagcttttaaaaatattttaaattaattctctgtaaataaaacatttctaaattacacttaacccctttatctcattcattctcctctcatctggaaggtttagccaatattagtaacttttatacttgttcacaggctctagcatttctctttttaataagaccttatccatatactcataatttttaaaaactgtaactcattcctttgtttttaataaaactctgagcactctatctctgcagctttgagatacctgcttagtttataatccaagcttgtcccatagttgtttggtcttgtacatattgtcatttaatatctcagcccccaaatcagtatctatacatggagaagataatacaacttcaaaaggagagttgctctcagggctaagtgccatggctgtgctgtgaaaagtttgtatattttaactcatgtttcaatgtgaaagacaaatagccatagcctctttctcttttccctgcccttccaagctttaacaatatatctctttcaaggacagtatgcagggcactcactgttcaaaatacactttgtcaccccccaaaccggtgtaactgagatctgctaactaactccctttgatctcaagtatttgtgtgagtcgtttttgccaccactgccctgttggcctctttggtgtactggactaatgtgccttctgtgagatgcatgaagcccccgggccaacaaataacaggaccaatggaaagtatgaaaaattacaggtcagatagatatatctaacaaacaaacacgtgtggataatggaaactgggcactcttgtaacatatagggagtagtctatgctcttgctctagcatccttgtcacttatcttgcggtgtaaatatttatttgattgtttggtagtgcggttcttatttagtaataaatattttggcagcatgagctaacaaaaaaaaaagaatgtttaatgaaaaaattaagtactgaatttataattcttaaagaacttgatgaacatattagtcgaacaaaatatttgtagatacttaccaagaggactgctgagcacttgaaaaccagggggcagaatgtgctgatgaaacatcagcgttttttcaaaagttaatagattttaggaagattatgtctaaagatgacaatttgacatgtgaagctgctggctatgcatttgcatattactctgtgaagcatcacttttcatttagataaatgtctgttcctctaaactaatttcattcattttctgttccaagttttcatatgaaagtacaaaaagtgaagcaattgctgttaatgcgttgccttcattaacagcatcagaccttgaaaatagctaaatgatactggttttaaaacaatgcagtaaaattaaatatcaattaagtttattcaaattgaatcaatatctgtcttcaaaaccatggaattgaagtatagctctttgtgatccattctgttgaagatgaaatatctgacaccataataaatgctatgataaattcagtttaaaatgtaaaaaaattaaaggaaaagtgtttgcttttaaaattatatttattgaattattttgaaatgataaaataaaatatacatttgggtgtagcacaatgtcatggcacaaatgatattaggaatctcatgggggccaggtgcggtagctcacacctgtaatcccagcactttgggaggccaaggcaggcggatcacgaggtcaggagatcgagaccatcctggctaacacacagtgaaaccccatctctaataaaaatacaaaaaaattagccaggcatggtggcgggtgcctgtagtcccagctacttgggaggctgaggcagaagaatggcgtgaaccatgaggtggagcttgcagtgagccgagcttgtgccactgcattccagcctgggcgacagggtgagactccatctcaaaaaaaaaaaaaagaaaagaaaagaaaaaaaaaatctcatggggtagagctcttctcaaaatttatgtagtgcacatttaagttacactttaatccaaacaaactgtgatattctaccaatataaacaggagaaaagtacttggtgtggagagaaaacagtattatgaaaatatttagtctcaaacatttatgcatttcaatagtaactgcccctccaacagaattgaggatgtcttccatttagcagaatgcgcttttgcatatcaggtaatttatcacctatagagagaagatttttctcaattaaatatattatgatctgcagaaaagttccatgtaatatatcaagaattttaaaaatgcattcttcagaaaaatacaagtgacgaggcattagacacatatatatgtaagaaactgagtaaaatatatggctttgtatccagaattattattgtgcttgcttgtgttattttaaaatttgcataagatcaatactaagatttcaaatttttttctttaatgtgtatggccatatgttcaatttttgaaagaattttatttttgaaaatggcctttaaacagaatgattttataggtccaccgatattataaaactgatttgtcagttaatctataaatatttcaaaaactctataattttagttattttttgtgcctttttttccctctcaaaacttttctaatttggattacaaatttttacggtcagtcctcatacacatggaatactcggaaaatcagtaaaatgtcatcaacacaagcagaagaacaatcaacaaaacacaacttagttttctagctgaactcggctaaggctttttgcctgttcttcgtgaggaaaaactagacattaacaacaatattgcattgttatggatttaatctttgtgtctccgaaaaattcatatgttgaacacttaccccctaatgtgatggtatttggaagcagggtctttgggagacaattaggttttaatgaggtcatgagaatgtggaccccatgaaggaattagtgagcttataagaagaggaagagagaccagagctctctgcttgaggacacggtaaaaaagtaaccatctgcaagccaggaggaaggttgtcaccaggagccacattttctggcaccttggtcttagatttcccaccctttagaaccatgagaaataatgtcaatcatttaagtctctctgtctgtggtattttgttgtatgagcccaagctgactaagacatccattttataattaatttagttgttgtaattgttgtgtgtaattaaacttgtataagtaaatgcacattatacttattcacaatgtaagtggagttcatggtatgtatatgtgtatatggtataaaatataccatgtatgtttattacataccatgttccaggcattgtcctaggtactgggaaacagcagtgagcaagagacaaaaatcttcattgagtctatgttctagtgtatgcgtgaaggggtagggggagacagacagttgccaaaatgagagtaggagattatagaaactctagttagttatggcagtgaaggtttttgggctcaaagtgcaagccatataatatcagcattctttttagaatgcttctgaacctaggtatactcctaacggggcaagcaacccggtacatcgacttataggtttccctacgttaatttgaacagatattaccaacttaagtgtcttcaattttattgtcataccaggtccttaaatctattcccgctctacctatttcccagattttattaaattatcttgtgcaatttagatagatatgcttttcctcagctcaaagctacatgagtattttttttccagaaaagactgactgctacttatactttttttgtatacttaaagtattttgaaatatcttcagctacactgtgataggtttaggtgcctcttagcttcctgtgtatagtatgtctttattcctacatgaaagcctcttggcaggtgggttagccagtcctctggcctcagttctgtttaataatatctttcagacagaattctctcctgatcctatctgctagtttttctgaaactcttaacctttcacaatatgaccttaaccacgtctcctttagtcacaattttattcctggaggaaataagcaatcttcagccttgagcctctaagtgaaatcgtcaaccagacttccaccaccctgtggcttggctgcctgcctgaattgttgtgacttctacagcgactcatttgtctcctttttctccttaaccccaaaggcttcttccacttggtgcgttcttttaggctatgatcatccagcaagtcttgctgtattctgtggcgttaacaaggtagccttattacaaacagagacccagaagcgtttagagatctgcttaagtttggaaggttaattgctggcagaaccagacctggaactctggtcccctgactccctgttccaagcattttctaattcacgtactgccaaaacaaagcaaaagcaaacaaaaaacccccgctgaataaaatgcttttatgcgtgacacagaagaagtgaactgaatgtcaatatgtgcctgaagaaaggtggcccatttaggctgatgaagctgtgatgaaggtccctagttgatgaacaatatatattcattgattgattgaaaataattgacttcttattccttgagattttccccaaacgaaaactgcatgtttagtgcctccttctaaaggtatctgaatttttttcagtacttaaaagactcagaagtataacctgtattatttttcactatttttaattaatgttaactcattattaatgattctttaaaaatgtctactctgtatgagtaaaatcatctataatacaaaatgcttcaaagtatgttatagcattcctgttttacagatgaggaaactaaggttcagaaagttaaataatgtgccaacaatcagacagagcttaagggtgagagccaggatctgcctcctcagggcatgccctgagcatgagatcaccataatgaagacatcatgggttgtttttacccataaagtattaatttttaatggcttaaccacaaaaaaagtattctcataaaaaggagaacagaaagaagtaataaaaatgcaattttccattccatttgatttatgagaaacaataaggggctagagcaactgagcaaacattctaaaattagaatccagctagtatcaaataatcaaactctaatcagcaaaatcgtttacatgacacttattataatgttgctactttttgttgtcacaggattgcatcattaacattattagtaaacctgcgcaatcagttaaaaatcactcatttcctgagaatcgcagaatgttgaatttttttacgatttcagtaaagttatattcttggagtacaagtacttttaaaattatttgttcttaatcagaaggttatgtgatgtctctgataataatgtatctattttaaatattgaaaattccctttcatcaaatataaaaaaacgcttattatgttcttgcccccaaattggtcaaaatgtacagcaaataataaatcagatttgttttgatgtacttcgtattcttgttaaaaagaaaaagatttccaaactctatagaaaattataaaagcaaaatgaatttactgattattaatcaaatggcgtgaatactaacctttcttccttgaaaaataaaatgggcacacagttttggtgagtataaaaagcctttcgcaagaaaaaactatgccaaaacattatatctggtattaatgctgactataatttctggcatcataatgcctaaatgttttaaagaagctaacaaataatttgatgaccgtatataaattatattattttatgctaacttttgtttatatatggaatagattaccaggcagtaaagtattatttctagtgcatataagtttcaaatctgttagtataagtttcaaatctgttaggtttcaagtctacttaaaattaaaatgtttctctgctactgaactaagcaatacttagtaatttaattatattttaaatatagcaattttatcacatttctttttttattacactgtaagttctggggtacatgtgcagaatgtgcaggtttgttaacattaggtatttctcctaatgctatccctcctctagcaccccaaccccgaacaagcccctgtgtgtgatgttccccactttgtgtccatgtgttctcattgtttactgccgctaatgaggacatgcagtgtttggctttctgttcttgtgtttgtttgctgagaatgatggttttcagcgtcatccatgtccctgcaaaggacatgaactcatccttttttatggctgcatagtattccatggtgtatctgtgccacattttctttatccagtctatcaatcattgatgggcacttgggttggttccaagtctttgctattgcgaacagtgccacattgtccagcctatcattgatgggcatttgggttggttccaagtctttgctgttgtgaacagtgccacaataaacatacatgtgcagatgtctttatagtagaatgtgttataatgctttgggtatataagcagtagtgggattgctgggtcaaatggtatttctggttctcgatccttgaggaatcgccaccctgtcttccacaatggttgaatgaatttacactcccatgaacagtgtaaaagccctccaatctctccacatcctctctagtatctgttgtttcctgactttttaatgatggccattctaactggcatgagatggtatctcagtgtgggtttgatttgtatttccctaatgaccagtgatgatgagctttatttcatatgtttgttggctgcataaatgtcatctttttagaaatgtcttttcatatcctttgcctactttttgatgggttttttttcttgtaaatttgtttgagttctttctttgtagattctggatattagccctttgtcggatgggtagatcacaaaaattttctcccattctgtaggttgcctgttcactctgatgatagtttctttggctgtgcagaaactctttagtttaattagatcccattagtcaattttggcttttgttgccattgcttttggtgttttagtcatgaagtctttgcccatgcttatgtcctgaatggtattgcttaggttgtcttctagggttttcatggttttaggtctaacatttaagtctttaatctatcttgagttaatttttgtataaggtgtaaggaaggggtccagttttagttttctgcatatggctatccagttttcccaacactatttattacatattgattcctttccacattgcttgtttttgtaaggtttgtccaagatcagatggttgtagatatgtggtgttatttctggggcctctcttctgttccattggtctatgtatctgttttggtaccagaaccatgatgttttggttactgtagccttgtagtgtagtttgaagtccgagagcatgatgcctccagctttggtctttttgcttaggattgtcttggctatatgggctctttttttgttcatatgaaatttaaagtagttttttctaattctgggaagaaagtcagtggtagcttgatggggatagcaatgaatctataaattactttggggagtatggccattttcacaatattgattcttcctatccatgcacatggaatgtttttccatttgtttgtgtcctctctgatttccttgagcagtggtttgtagttctccttgaggtccttcacatcccttgtaagttgtattcctaggtattttatttctttgtagaaattgtcaatgggacttcactgatgattgggctattatttgtgtataagaatgcttgtgatttttgcacattgattttgtatcctgagactttgctgaagttgcttatcatcataaggagatttggggctgagaagatggggttttctaaatatataatcttgtcatctgcaaacagagacaatttgactcatgtcttcctattttaataccctttatttctttctcttgccttactgccctggagagagcttccaatactatgttgagtaggaatggtgagagggggcacccttgtcttatgctggttttcaaagggaatgcttccagtttgtgcccattcagtatgatactggctatgggtttgtcacaaatagctcttattattttgatatgttccatcaatgcctagtttatttagagtttttagcatgaagcggtgttgaattttgtcgaaggccttttctgcatctattgagataatcatgtggtttttatcattggttctgtttatgtgatggattacgtttattgatttgcatatgttgaaccagccctgcatcccagggatgaagctgacttgatcatggtggataagctttttgatgtgctgctggatttggtttgccagtattttactgaggcttttcacatcgacgttcatcagggatatcggcctgaaattatctttttttgttgtgcctctgcctggttttggtatcaggatgatgctggcctcataaaatgagttagggaagagtccctctttttctattgtttggaatagtttcagaaggaatggtaccagctcctctttgtacctctggtagaatttggctgtgaatctgtctggtcctgggctttttttggttggtaggctattaatttcagaacttgttatcggtctattcagggattcaacttcttcctggtttagtcttgggagggtgtatgtgcccagaaatgtatcaatttcttatttcttctagattttctagcttatttgcctagaggtatttatagattctctgatggtagtttgtgtttctgtgggatccgtggtgatatcccctttaccattttttagtgtgtctatttgattcttctctctttatcagtctggctagtggtctctctagtttgttagtctttttaaaaaaccagctcctggattcacagattttttgaagtttttcgtgtgtgtgtctctgtctccttcagttctgctctgaccttagttatttcttgtcttctgctagcttttgaatttgtttgctcttgcttctcttgttcttttaattgtgatattagggtgttgattttagatcttccctgctttctttttatcacttttcttaatatgcaaattagttgaagcagtattttgtttattaaacccttataatggcatgttgttagtacataatgaagtataaacattgaaagagggaaaaaatcacatacaattgcacatactgaaagaggaaaacatatagattacgttttagaaataagattcacatggttgtagttttatatcatgataagagcaaatagttgcaaaataaaaatattttaagcagatatttaatatagaattttgaaaatccagaacccaggaataaatatgctaaaatgggcagaattctatttaaggaaatttttccagtagcattacagaaattaaataaatgtgagatataccatgttaatgaattgaaaaactcaatcttgtaaaaaaaaaaaatcccaagtctcaacagtgttttagtattggtcatgtatatttgctttgtttttgtggagcttgataagcaaattctgaaaattatatgaaagtgcgaaagttgaaaaattgtaaagattcacataaagaaagaaggtggaaaacttgccttacagaatatgaagacaactatgatacagtcttataagaatgcagaatttaaataaaatactgacaccaattggcttgcaaacacatgttatagaatggatagaaacaccaaacgaagatctgcatagttacagatgcttaagacagtggtgatattccagatctatatagataaataaaaaaagcatgtgaaaaaaggaagaaatttacccctattttgcattatactcaaaaatacattcaggtgaattaaagctctaaatacaaaagtaaacataaaatttttaaacatgatattggagaatatcttaatgaccttggagtggagcagaaaaatttaaaaagagagaaggaaaggaaaagggaggaaaaaaacaaaagtggcaaccattgaggaagactaattttttgaaaatctgtattagaattaggaaattttgttcttcaagtgccaagacaaactcagaagagaaagatgagttgtttgaactacaaagctaaaaatgatctatctagatttacagtcacacaaacaaaccaaaatcaaaacgaacaaaatggatcagggttactggaaatggagagttgttggtcaaaggatacaaattgcagttgtaagatgcataagttctggagatctaatgcacaggatagtgactgtaattaataataatgtattgcatacttgacatttactaacacagtatttgcgctacacacacaaaataacttcaaggtgatgcatatataacatttcatcttgtatacatatatcaaaacttcatgttgtttactttgaatatataccattttgttaactatatcacaataaagctgggaaaaatgcgataaagtagaaaaattggcaaatatcctgaccaagctttccataaacaagaaacttcaatagaagaagtgttcaactttattagtattagagaaatgcaaatttttaaaaatacattgtgtgatagccttaatacaaatgctccaaattaggaaacattttaataatctgaaaataccaagttataatggaacaaggggcaaccatacatgctggaagggttatatattttcatgaccactccagagacagtttggcattatgttccaaggatatgaatacccaagaatttagcttttcaacttttatgcaaatataccactaatctgttgtacatgtgcatacaacaatgttcatagcagcactgttagcactagcaaaaactgaaaaccacccacgtgtccatcaacaatgaaatgataaattcatgacagtgtattcagataatggaatactatgcaacaatgaaaattaataaactaaagctatatctaacaatataggtgaatcacataaacatactgttgaatgaaaggagtaagacacaaaggagcacatactgtgcaattctattcacctaaagctcaaaaacaggcaaaactaatatagatgctaaaactacaggaaaagtcaatgaataatcatcaccaaagtcagactggtattgcatagatttgtcttgtgaaaaaaaaaagttaaaatggtgtgtagggttgtgatcatggtgggccataaaaaaagtgtaggttttaaaatgttgccaatgttctagctcctcaccttcataatgattacataggtgttcccttcattatttctgcactcttcttggatataatgttaaatttgtacttatttttaaaatatctaccatacaccaaaactgctctattactgctaagtcacctaggttgtggatttctcagaacgaatatggatggctgtttatacttctgctgttgagctttaaaaaaaaatgatcattgcaattacattgaagagatgtagatcaatttgactccagagcttgtatttagagtttctttcatgtgtatgttctaatcacacctcagaaccctaagaaatagacattatagaacagtagaggtgaatatttcatgcattggtttaaagaacaccaacatgttagaaatttagaagaaatgtgggtgacaaaggtcgttaggttctccttctaaagataacaaggtgacaatagagcacatgccagatattacttatgccagtgaacttgctgaatatttgcagcatttcctctgaggttcaaaagacctccaaaatagacataatctagagtgattgataggcagttcccatgggccactatttcttcaggcagtgtttttttaagtactgtgaagtgcactcactttatcacaacatgtatatttcttttcatatatatactttaagttctggggatacataggcagaacgtgcaggtttgttacataggtatacacgtgccatggtggtttgctgcacccatcatctacattaggtatttctcctaatgctattccctcccctagcccctcacccaccaacaggccctagtatgtgatgttcccctctctgtgtccatgtgttctcattgttcacctcccacttatgactgacaacatgcggtgtttggttttctgtttctgtgtttgtttgctgagaatgatggtttccagcatcatccatgtccctgcaaagaacatgaattcaacttttttatggctgcatagtattccatggagtggatttgccacattttcgttatccagtctctcattgatgggcatttgggttggtgccaagtctttgctattgtgaatagtgctgcaataaacatatgtatgcatgtgtctttatagcagaatgatttataatccgttgggtatatacccagtaatgggattgctcggacaaatcacaacatgtatatttgtaacagatgaagaaagatgattgtttatgattcccagtagaaatgtagtttcatcaagagagaagagagtgaaagagtgagaaacagagatactaaatttaggaaattcattgaacagaaactccactttggactggaaatacatttctccaaaatcacaaaagagttactttgtgcacactcaagttacttctacttatggggaaaagtcaactatacattcataaatgattaacacttatgggataataatgacaactaacatgcaccgtatgccaggaatcatgctgcgcacttaatattcattacttcattcaatctttccatcactcctatgtggtggagaacactatctgcagtgccactaacgagcaacgtttgatctccctaatatgtaactaagatacaaagtagttaagagacttaagttgtataaccacaaggtcacataactagatctggatataccattatagggatccagatcagtatgactccagagcttgtattcttaagagttttcagaatatcttccatgtatatgttccagtcatacctcacaacagacattacagaacagtagagctgaatatttcatgcaattgtgtaaagaacaccaattctaaaaattatcattaggtatcccattcattttttttaattgtcaagtaagattagataataaaccaatacaattttctttactgaagtttttcatgattgggctgtgactcttcacaagagagctgtatagctagtggtattatctaaactgatgaattgtggggtccccttgaagaaggcccaagccccaatagagatgaaaatgttctaaatgaggctgtagagaatcagacaattgaaggacatttctagcagactgacttggtaaatattatagttaatacctgcagattgacattgcattctattaatgttcagtaaaacggttatatatcatagttcattcaaatatattttactctttgcaatttgtagagtatactgaaagatattttcatggatgatgttcaatattcttactagtaaatgcatattgtaagtaactttacagagagaatgtctaatcagagactaaactgacttcacatagacagtaggaagaagtccatgaagtggatttgagtcctctccttgctatgtagtttattttttcatttacaaaatgaataatacttatatcaaaaaagcaatgatgtaaataaaatttttatgctagacatacatatgacagaaggtggttattaattttagtaaaagcagaggtcagaggtctgtgcttttttagactagtaattgatatctcctctcaaggatagccctggagcttcctacacacacacacacacacacacacacacacacacacacacacaaaacaaaaaacaaaaaacaaaaaacacacctaagcattgattggtcttggaactgctcaaattcccttgacttcctaatttactcaaataagtcatcttctctaatggaactttaaaattgagagtggttcactatgctatggaggagtgaggccagcaggagacagccattcattcgtccaagtgggtgaatagggaagagtctgggctcaggatccagactccttggactctcattctggctgcctcacctactccctgctctttgttctcatctgcaacatccagacagtgaaagtaccaacgcagaaggttgtcatgagcattaaatgaactaaccgcgataaagaacttagaataatgcctgacacatattaacaccataaatgttaatgattctagttcttccatgcccaatcaatgataatgcagccactttcattatcctctatgctaattatactttattctattcactaaacagaactaactagcaatgttttgttagcctaatactagttattgtatttgagaataacaaattattattttattataaattattcataatttgaaatgtttacaaacagaaactagctggcttcatgaatgaaggcgtactgattttttaatttttgaaaattaacatccattgattttgatacaattcctccaagatattgtctagtattaggcatctgcttaagctattgcttttctcaccttgttagatataactcattcacacaactagatcaggcttatcactaccccataaaaaggataattacaatcaggaacatcaaaaatgtggcagaaacaaacgagagaactgaagagttgaaacttgatatttcatctcttgtttgctaatggtgcaaatgctttttccctcttcatattaatagtaatgagatctttgaatataatgtatatttcttggtaactgccttttttccccagttgctaagtaatatttcacctttcatcagaagagaaagatagatggtacttaacctgctttgcaagtcagagtaccagataactcaattcatttctggaatgccaaatgaggtttttattctcactagaggaagccaagggagtgtaaatatgactctagttcattattgcctttgtgcctcctacagccttagaaatgtgttagagtatattaagttttaaaacaacattatttttagagtacttggcaaaaattatctttcaaaatctctgtactaaatttcatttcgacaaattaaaaacaaaaaaattgatatttagcttatttagacatgacctttgttaacattcatttggagaatcttaaattaagattgagacataatagctaataaaaataaggagtcaggttacaacctgagtctcattataaaaattattacacttataattgtttatattatatacatatttaaacttgtttatgtttttttctgttttgttttacattatgccactcagtacagagcattctcactgtaatgttagtggtctaatgaatgttttgtatatcagagcaatatatttacatgatacagctgatctggatatgtacagatggatatgaaaatatttcttgaaggaataattcccttggatgtcatactactaatacttatcaagcaactattttctggaagtcaataaatacagtatacaacttcctacattattgctttggagtttactgtgaataccagaggtcctgaaatcaatcaatcagttgtctgacctactgcctaccacacacttcttgtttctgctgaccttgtttatttgctcaacttaatgtgcttaccttctaaccaaataatctcttctccagcccactgattatttcatttcctctgatttagttttctctgttttgaatagtttacctcattaggaccttccattatccctaaggatatttctgagtgaaaacaatcaaaatcattgctgttactcctatgtaccagacactttaaaaaggacttcatatgttttatatcatttagtccccaaatacacacatgagttattattattcttattttacaaatgaaagaattgaggcttagagaagttgcataactcacccaaggtcaaaatcctatctgactcaagtctacactcctaaccacaaaggtgagtttgaaagattctttaaaaactaggactagcctactactgttaacctacccttgtaaactgctaatgttattactgtgaacattcatagatccttattgaattttaaatcaaaagcttgagagactaagttttcatgattctctatgtccatcatttggcattgacgatatggacaatcaaaggcaaaaaaatctacttctgataacaggagaataaatagaaggagatgacaaagtgtatagttaataatgtatacttttaatgtggttctgtatttcttagtcctttgaattttatttagcctttcaattattatttgctggatttctgctttaaattaaaatacaatcttattaaaagagatagctatatctttcttattctatataccaatcctcatattacattaggctcatgaataaatagcaaatcaaatggaaaaattcatattttagttatacctaggtgaattagaaaaaaatggaggacacagcaaaagtgaacaactaaagagaagtcccaaaatacatactaaaaatataattttgttctgttctcattctccatcgtttataccataaattataacactagtactatagttgtatttcaataacagaaaagacatggaataaaaatgataaaactgctttaaaaataaaataacttggtaatttagtaacagatgactaatatgatttttgtagacatatcagaaaaccagcatgtaatattggtgagagtatggaaattagccagaagattctgtttgggtttttgaatattttagttacttgcttgcacaagttgcataacttttcttactaatttgtaaaagagattgataatccctgacctatgacactttttaaaaatcaagggagatattacacataaaagtcataaaaccataaaatattgtataaatgtatattttttacttattttttaagcagtccacagtcaatctcaggttctagttgataggtttcagctaaggagttgtctgttgaaagccggagtgcatcaaagtgaatgggaggttgggtaaaggaagaggagatgagggtcaggactagatgggtggcagcaaaaataaaaaattaaagaggcaattttggaaacattatgaaagaataggagactcagattctcatctactacaaatgaataattattaatcttgtaaataatatggttgaaggacaataaaataaagagtacatagatcttggtgcccctcctgctttcactgtactccagtgggaagtatcagatcctgtgtaacttggccctctcctctgttatcagtgtttctcacatagcaggtgctcaataagtatttactgagcaaagaaatgaataaattaatgaataggtcacagggttattgtgtcaaataagataatgtattgaaaagtgactaatgtatcaaaagagctctgttaattgtaaataatgacatataggaaaatgttattactaacttacaggaagtatttttaggtttcttagtaagaaagttccaataaagctcttcaaaaattaattgggttaccttcaaaatagtgaattccctatctctgaaagtttaaacatagaagttgaatcatcttccatcacataaccaaaataattactactgagagcgggagagtgaatgaataaggtctcatgcaattttaagattctacagtgccattaggaatgatacctaatgtttatttgatgcttgtttggtgtttgttaggcacagtgctgatcgccttgcattctattttgttaacccctaaagcaatccttgagataaatattattattacatacagaaaaatgggggctctgacaagttaaagaacttgcctgcatcataagctaggacataactaaggaaggattttaagccatatttatctaactcctgagctttcagtttaaagtgtgtatcactatgatactctgtctcataaaagagtagttttctctgttccagtttaccttctaaatgattggtgttggctgcttgatgattcaagtctctgttaccagaagcaaatcaaaagtaccatttctgatttcatgaatccctttaactaccaaatggtacgtgatgcatggaaagaagcaaataactataatatgattttttggagtgaaaaatacatttttaataaggtgtcattgatacttaatattccagaagcagtgctcaagattttgaaccaattagagatttgggcttcatctgaccagacattattacaaattttacaataatagtttagtagatgattactgcccccggcatatgaaaatgttccatgtaaacatctcattaccaagactaaatattaaagaaatgtattcctctaaaaggccctttgtgtttcagaatatggaaataattcttctgttcatttcatattattcaaggtaagtgttggcatcctaactgtatatggcctccaaataaggagttaatactaatgtattctattactccttagctcatggtaatcatgccaagaacactttttaaaattaaccccatgctctctcatgggttcatttaagaagaaatgttataagaattctttggaattagtgaaaaacaattttgtcctcctaccattaagtctgtcttcatatctaaagcagaataggcacaaaggaaagtagttactagctttgtgttaatgacttttaatttgtgtacacttaacagtatcttgaaaaattgtcttacctggtggattctctgtttggtcagatatctaaattaaaaaggcctttctctatgagtttcttggatcagttatcttagttttagagtcatatggtgtgaaggactaaaagatacattagaaatcaactagaataatttcctcattttataggtgaaagaaattgcctgtaagtgaaatgacttacttaatgacacacagaaaaatggggcagaagaagacttagaccccaagtgtcttatttcctagtttttatcctatgcatgattcatggaggaattcctgattgtgctacaatataaaatcatgtcatttccaacccttttaaagtggcatttcctgccacaacttccaaaccccgcccccaaattccaattaaaacagtacactgagtttaatattcatcaaaaacaaacaaaaaaaaattaaagtaacaatgtatttaatcttttattctttcagagagtgattaagacatatactgtgtgtaagatactgtgtgtaagagaccgtagcttctgcttaaaaacattatttaagcttaatttcaatagcaacagagaaaattggagatgactgataaatacatttaaagcaggcaaaatttgagatgttttcttaaacattcatttctgtattaatgtattcacttaacaaatacctagcactttatctgggtcaatcctcatgttagacacgagagatacaatgataaacacaaataggcctggaactgcctatttgagcttttaatataatggagaagcttatctcaaataagtatcacactaattaatgagtaataaattaggttaagtaaattaactgcttttctgaaggaaagaggtgtgatcctatgcatatgtgtaacaaaagaaacagacctagattaggactgaggtagtcaaggagaacttctggaaggaggtgacacttaaactgagaactgactgaagaatgggtgtcagctagccaaaagatagatggcagtagtggagtgaaggagctagaagtgattaaacttgttgaagaaggcatgtcaaatgccaagacaggccaaaagctaggcctcttgtggcagacagttagccaagctgtgaatgcaacggaaaagtcctggacagaatttacaagtgcatctccattgaatacacaaatgataagagtgcacaacagtctttgctgctatggagaaaattctggtggtctaggtagatcaagccaaccacaacattcccttaaactaaatcctactctagagcagagccttaatcctcttcaattctataaagtttgacagaggtgaggaagctgtagaaaaaaaaattttgaaccttgaagaggttggttcatgaggttgaagaaaataaatcatctccataacataaaatcacaaggtgagccagcaagtgctgacgtagaagctgcagcaagttacccagaagatataactaagggcattgatgaaagtggctacactaaacagtagattttcaatgtagacaaaacagccttattttggaagaggatgccgtctacgacttccaaagctagagaagagaagtgaatgcctggcttcaaagctgattctcttgttaggggctaatgtaactggtgattctaagttgaagccaatattcatttaatactccaaaaattgtagggctcttgagaattatgctaaatctactctgcctatgctctataaatgatacaacaaagactggataacacaacatctatttacagcttgctttactgaatattttaagcccactgttgagaaatactgctcagaataagattcctttcaaaatgttaccactcattgacaatgcacctggtcatctcagagccctgttggaaatggacaaagaaattaatgtgtttttcatgtctgctaacacaacattaattctgcagcccttggatgaaggagtaatttaattttcaagtcttattatttaagaattacattttgtaaggcttaagctaacatagatagtaattcctctgatggatctgggcaaagtaaattaaaaacgttctggaaaatgtttaccattgtagatgccattaagaacattcatagttcatggcaggaggtcagaatatcaacattaacaggagttggaagaatttgattccaacccttagggatgactctgaggagttcaagacttcagtagaggaagttactgcagatgtgttaggaaagagcaagagtagtattggaattggagactgatggtgtgactgaattcctgcaatctcatgataaaagttgaagggatgaggagttgtcccttatggatgaataaagaaagtggtttcttgagatggaatctattcctggtgaagatgctatgaacactgataaagaaagaaaggatttaggatatcacatcaactttgttgataaaactgtggcagggtttgaagagggttgactcctatttttgagagaagctctgttgggtgaagtatgaaccaacagcattgcatgctacagagaaatctttcatgaaaggaagagtccattgatgcagcaaactgtatcgttgtcttattttaagtaattgccaccagttacttaaactgtgactggacaagccatttaatatttctgaataatctgagtatttgccactagtcagttaagccaccacagccttcaacagccatcaccctgataagtcagcagccatctacggtgaagacccttcaccagcgaaaagattagaactggctgaaggctcagattacggttagcgttttatagcaataaattattttaaattaagatatgtgcattgtttcttagacaaaatgctattgtacacttaaccacagtatagtataacaataacttttgtatgcattggaaaacaagacatttttgtgacttgctttattaagatactgattttattgaggtggtttgcaactaaatccgcaatagttctaaggtgtgctagaacttttcttccatagtagctgagatttaagttgtctagttagtatgactaagtttttccattaatacaaatgtctatgctcatatcttcattgactatgctcattcacaccggccttctctctgtccctaggctaaaacttattctagtctcatgacctttttacctgttatttattccctccaacaagaatattttcctcccagattctgtgtaggtatttcttatccttgaggtcttagcttactgttactgtatgaaaatacttcccccaacttttctagataaaagaacacaccacagttcctgacccatggaaggcactccacaaatagtagctaatatgtttaatgttaaataataataattgaacgccttctattagtccttgcacagtaatagccacttttaacatttctaattctcaccatacaaatattaccatctctcattttgcaaatagattattcagacagattaaatggcatgcccaaaagcttgtgacagtctgtctaaatataaaatctgtgtatgattttgtttgcactatgtcaattttcattacaagaaataaaatgcacaaatgatgcagttattttgggcttaacacttcataagatagtcaggctattatgattttagattgggttatccaaacaatactatcatatttctccaaaacctttctatttatggcactggctaagccctacactcaaccaacattttaacttattcttgatttcctcatatactctagtcaacaatgacttaaaattctttttgtacttacagttatcccctaccacagaaattagctcttgagtgttgtcagtaagcaggttgtttcacataagtgaaaaagggatcagtgattatctcaaacgcactgagcatgttttatattcttgcgtgtcatccatagacaaggacagttccatgctgtctatggtggagtacaaattggaagtcagaaatggcatcttttctttgctctgagactgatcttgatgagaaagaaacttaaacttcaaggcaacttcagagaaaggaaaaaaaaagaatacactgattctctgatgcttactgttaactttaagatagaaaagaaattatagaaggtatcctgaaacaaaaacaaaaaaaaaactttttatttatgggtaaataggtgaaatgtgctagaaatcttgcccacactcttctttttatacatgagggggatgaggcagggaattaaagggaggtcaattacacatgagattacaagtgatgttattgtactgactgccactgtattttacaatgccacacataaaagttgattgatgttgatttgactctgttcaaaaaaataacttgagctaaattgtggaagagctgtgaatgaattgaaacaataaataaaatgagttcttttaatattaaaaagcttagccacggtcaagctttctaattaggtcagcataatttaaaatggactaagaaccatcccaggtggggatatcaaatatttataatcttgccccggatgctatctctgtgaccttagtggtttcagaagagcacttaatgtacccctagttcctatgagatttagatatttatgcagacaacagattaaaaagaacacgcaaaaatctcacacaaattcaagaaataatgaaggttacaattctttacgaatatttgtccttttcctttttagtcagcattaagaaatactgtcaggcttcatgtccaagttaatgtgaaatgacagattattcagttcagagcactgtgaagagctacagggtaaatgattcaatgccacctcaactatgtgtttttactgaaaaagttatcagttttgaactatatccaattctacagcatatttcagtgtaggaacatctcagtggaaacgtttagaacccagtgcaaagtcactctgaaagcatttacttagctttattgtgtttggttttaatttctctctctttgtgagatcaatttctcattagtgcaaagccgaatacttccaggggaaaacgaaggaatgtatttagttgagacaggtttttaccaaactattcgaaaagctaaaagaaaaaaaaacctctaatatatagtagaaaaaaatgttataaatacgttggtttatatctagctataaatagtgttttttcaaagtatggttcaaaggagaaacaaccattaagttttcagtagctttgtactgtcaaggaaaaaccagcttattcatgttaatacacatactgtagtaccatatgtacctaaaacagtgaaaaatcataaaaaatattttagcagtggaaataaagacagtaattgcaatccagtcaaatgaagttaattcaaaatgcaaacgcagtttgcattaaaactaataatattaaaacaaatactattaaaactaatagtagttactgtctctatctgtaactttcactccctgccacccaactgtagttagatagccagagatctcatcatgaaccttcatggggaaaaaaaaaatgtggtctgataaattaattacattaaaaaaagtgattaatcaaataccctgatgaggaaatggagaacatattaactaccatttgttgactacttattgtgttattatgatactcatttccttcctcaagtaaatttcagtctagggaaaacatttacaacagaatatgctgagtgctgggatactgaggagtagactagaagtataagaggacagaggaagagtaatgatgtgtgggtgaaaagataataactaggaatctgggaacattgcctaggtgtaatttgagtatcagcaaaacaataaaaattagagaatgataagtaatgtattagatatgagacttggaagcaggaaaagtcttacagaagtgaaggaaggctatttgcaaaaactcaagatcatgacaaaacagactcttcagagaccaagtagtgcattacgaatggaaaataggatggatatagatgtaaaaaagcagctgggattttgagatggaatcagaaaggcagaaagaggttatgattatgaggaatatcctatgtcatgctaagaagtttgggttttatcctgaatgcagtggggagcattaagtcagttagtgacatcaacctatgtcacactgtgaaggcatcaagaccaatgtgttgaaatggggagtggcctgataccaaaggcaaaggtagcagaattgcagtaacatagatgaatcctgatgagagtctcaaataaggtaggggaggtcagataaagcagtaataacataattaagcctaaggtgggaacaaagctacattaggcacccagtatactgaagaaacacctaaaattctggaaatcagacagctcctccagagccttgctagctgcaccagctctgcttatccaaatccttatcagcatagcattgccttccccattatgccaccttccattcctcacccctttacatatgagaatattaaagagaagggaagacattttttgcacactttagcgtagtgggggttgctaggctttttcttaacctaaccttcctacctccaaattcaaggaagagggaaggctcctagcactcatccccagaaattataaaaccagtattttatttcttgtttgagagtttgcctaggcaacagacttgccgattagctcttggccctgtttggacaggaagagaaaagaagtagagagagatgacaagacagagcagtggcaggaaagaaacctacacctccaccgtttagaaaggcaagagtatgcaagtttcccgtgggttggatggatggactttggagaaggtaggccagcatgaactttctaggctccatgagcaaaatggtagaggtggtagttgaaagaagtttagaaaagacagtgccagaggagtcgtctaagtcagggaactctgcagtaaggaggttccacagacatcacaggtgtgcttacaagagcgagcctttggaggcctgcctcagtcacagatggttctgtggacaaccagcttcacccagagtggcagctatgtcccagaagggaccacaacagaagttacataagtaagacgctggtcccttgcctgctcattctgtcctactttgatacacagagaaggaaaggaacctggaagcaggaggagaacaaatgtgaaaagagactttcctcctcacagctgcagggtcctgggtcccactctattgtcaatactgaactagagaagagaaagagaagagcaataaatcagagctaagctttacctttataacaactgaaagttatcaaaaagctatgggaccttcctggatgtccaaaagggatagaaaaatggatttgacagcatagttaaaggcaacggttagaaggagtaaaaccacttcatctttgttacccactgcatttagactctccagtaagtcagaaacaaggatatggatatcagagatacgtaaaacgtggaatagatccaacttcacctatttgttataagagaaaaaggaaagtaaattaaaacttttgagttagtagcctgaattatgttctgagctttaaaaaagaaatactctaggctttccttctctgggcatagtaatcgcacctataaaataaacaattgtatgatagttcttaaccttgttttcatcacagagtcccttgagaatctaagggcaactatatactgtctccacaaaaataggtacatgcacacatggaagtttccacacaaaatcctataaaatggaaaacattgaaatgagaagccaatttgagcaaaaagattgagtgtagctctatatatattaagcctgatatgcctgtgacgaataccttgtagagacagccttcagaaagaagacaagtctgtttctccattttgttttttgtttgtttgttttaatctcaagcaccttctgatatccagctgacaaaaaggcggcccccttcttattcttccattagagcctggaggttctgaaattattcggtcgcttagcacacaagtctctgcagtttcttcatgattcttgcagtgatgctgagccccaggggtggtggctcattaattaaagtaaattctgcacttaggctttcttcctcactttccaagtgctgtcatccttgtctctctgggtcacctcacttcttccttccagctaaactttatctagaagaaagaccatggtgacagcacagcctttcttgagtgtgtattgcccttagctgttaaaaaattttactgatcacgttaaagagtatgaatttctttcatttccatcatctgtaggaaacacgtgtcttatcttgttacccttgagtttcctcttctgtcagcctggattgtaggtcagagctgctactaagcatgtgatcttatgcaaagctttcttttgatatttacttcaggtcagtgtgcagtggctgaaaattcagtacaaatttgggaatccagcaggtctacttttaaaatcctcaggtttgtcagcccggtgtgcttcattttcttccttttcctgtattaaatgagtgtaataatatatgctaggtctttgtaagtgttaagataaggtatcaaaagtgccttgtacagtgcctagcaaatactaagggcttaataaatgttatcgaagtaaattattaccattgccttttttaacaaaaaaggaatttaaagtgatctggatctcaatgtcttcatctataaaatacagtgattcaagtatattcagtttgatttagtcctcatttattgagtatgcagtacttggaaaacactatgtaccagttaatgtgtcctttatgaagacaaaaagtgaaggaggttacgaattagtcaaggagacactgacgggaaaatatgtaacaaatcaaagagcctggttgaaattagggttctgccacttgctaaataaccttgaacaaggtagtaagtcatactgagccacatttttatcatcagtaaatgagaccaataatactcaactcacacagtggttagaagcattacatgaaacaaagttgggaagaaaagtagtatgatgtctgacacatgaggtgatccgtaaatgtttattattagcagaaacattttaagactttcataggtcctgggctctcttatttttttaagatctcatcctgcattatatcaaaaataataaaatgtacttatatcctataaaaaggtgctttttgctagaaaaatgtaaaaattacttttataattgactttatagttgaagggattcataactttttttttcttgagatggagtctcacccttgcccaggctagagtgcagtggctccatcttggctcactgcaacctctgccttccggttccaagtgattatcctgcctcaacctcccgagttgctgggattacaggcacctgccaccatgtccagctaatttttgtacttttagtagagacggggttttaccatgttggctaggctggtcacaaactcctgacctcaagtgacccacccacctctgcctcccaaagtgctgggattacaggcataagccactgagccagcctatgacaatggaagaattaggttgtagttggctgattgttataacgttacattgtattattttcaacactacagttattattttattgttcaagccaatagttattttttaaggtctcaaatttttatgttggcccttaaaaatgttgaaactatagtgcttaatggacaagtgctcttgtctattaaggaaaaatgtaacaaatgctatgatgaagccctgaggaagcaaaaatgaaggcaggaaaaattctatgtaaagtggattaaggatgagttcaggcagatatatttgagcagtgataaatagttaggaatctgaccactgaaaagcatgtggtcttacataactagaataatggtctccaaatagaagtctgagcaatttagagagtgagcaagagatccatgaggggaatggaagatggaagggagaaaatagtataacatacttgcttttaattctaattctaatttgaaactactgtttgttttactacatatttaatatatgagtatatttcatatagtatggtgtgtgtgtgtgtgtgtgtgtgtgtataaaatgcatatgtaacctctcaataaagcatatattgaggatgcattacaagacagttccgagatcttcccagcacagagcaggaaataattgaggttatgactatttggtgaagatattcagctcttctgctgaagagtatgttatcttgtaggcatggggagccatgaaatgtttaggaaaagagtgatcagatttgtaattttagaaattaaatcctgagataatgtgcaatttgaaggaaaggagcaaagactagagttcagaaaagtaattaagaaaaaattcaataggcttatccatggatcattttacctattcccctcccaagccaggaaaaagataaggctaactaattttgaacctccaagtgagatgtcagctcctctgagatgccttccctaactgtgctcacagcacccctgctgtgtatttcaagtagctccctgtatttccccctttccagaattgattacactacatagtaattgcgtgtttacttgtctaactcttcctttcacactgtggtacctgagggtaggaactgggtcatattcagaatcttatcccagaagccatctacagtacctggaatttagaaactactcaatgtgtagtttctatagtagtagttgatgaatctgactgaaatacttcactccttctccacttccagccattcagtgaactaattcccattagttcccattttcaagtctgtgcttagataccactttcacctgaaaggtgtgtctctgtttagcacttatctcctttaattaaaattgtatgtataattgtctttccttttaaaaagatggctatttcatctgccaaaacagggagccgacatatacgtagagtttaaagttctgttcagtgttaaattgaatatattcatgctcttctggggatattgttgtaagtcctgtggtgtgaaggagatggcctacatagtcaacccagatgacgtcatatactttcagcctctatgtagccactgtttttctcgtccaagttctctctcttctgacctggtttatggccacatccccaccctgtactcagcataaaaaaacctgccagggttctcatttcaaaggagcgaactcaatgtcctgtacagagaaaataggtagaggcaaaagcagagagtaccattatttatgaaggttttcagaatccatctgttctctggatcatgaaccctttatcaatgcactgtagcaaaaccctcagctccactccctcttctaccataaggagaatagcagctcttttcttgtgctcttcattagtagctactgacagtacagctgccatcatgcctctccaaacgttattaactcgttttcctaaaagcaaaacactattctggtctgttttatttcttttctatcttataaacataccatgctcacttttgaattctcctcctttgctcatttgttcccttttttcttaaaatcttcgtctacttcctcctccctgttcattctttcaaatctgtatcaaatcttgtccacttgtaactggactcctccagcttttattggtccttccttctgagctacactagaattatagtttgatacataattttaacattctgcaattcgcatgtgaacaattaaattgttaggactttatggacaaagattgtaccttaaaacttccttcatctcttctgccattatggcatagcacaagatatacactaagcattaatgctattcaccagacagttgtggtttttcttccacacacatagtaagattgtgtttccttgctgttctgaggtcacatgagactatttgccttgccagtgaagtgtgaatagaagtgttgtgtgctgtttttatgtgacaaatttaaaagtcacagtttgatttgggatattctatttttctctatcttggtcactggagaggtgtcagcacggatgcttaaatgaaggtgatatattgaagaactctccagctgacccccaatgggtggcatcccaaagattcaacgtcacttgctgaaggtgctgggagagccacctgcttagtgcatagcatgttttcacatttttgtgggtacatcagaggcatatacaagtatggggcacatgacctgttttgatacaggaatacaatgtgtaatcatcacatcagggcaagcactcatcatttctttgtgttgtgaacattccaattgtactccctcagttattctaaaatgtacaacaaattattgtcaactgtagttatcctgttgtgctcttaaatactagatcattcattgtatctaattatatttttgtacccattaactatcgtcatctccaccatcatcccctactcccatgctgccacagcctcaggtaactatcattctattctctagtttcatgagttcaactgctttaatttttaacctgtagcatttggatcatgagcatcagatattgggccagtttaggacagaagcaatcagagataacagagaaaacttctatggaataaatgtgaaacttctctactcctgacataagcataaccttcctattctacagtactgtaagagtactggtacacaatagtataaaaccattaggttgaaccaagtaaaattgacatttttataagataaaaatagccaaataatgaaaattttctatagttcaaccaaatagaaataagaccaggaggaaaaatgtgaaaaacctgcgagaagaaatgtgacacccttgaattagctattgagtcatatagtgtctgataataatgaaacctgcatttacctgattatacctgagaggtgatgatatactagaattcacttgttactagattataaccatattgaactaaaaataatttatccattgctaagccagaactaatgaatcaaatttgcatttacataaataacaaaggaaatttatattttataattacattccccagcttaaaagtctttttgaactcatttaagaagtagataatcgtaatagtcctatgtcttttttaaatatttaatgtgtagcttaaatctttcccacaaagaaaactttaggtgtagaactccctactggagaattctaccaaacatttaaggcaaaattaatgccaactctacaaaaactcttccagagatttgaggtggggcagatacttcccaactcattatacaaggacaacattatgcttaaacccaaactagacaaaaacattaacagaaaatacaattataggcaatatctcatgagaatcaagatgcaaaattcttagcaaaactatcttgacgaagaacaaagtgaaatgaattatttttcccgatttaaggattattagatgactacagtaatcaagactgtgtaatgctggtgcaggaatagacacataggttaacagaacaaaacagataacaaaaataaacccacataaatatgctcaactgatttttgacaaaagcaaaaaagtaattcaatggaaaaaggatagccttttggaaaatggtgctagagtgatttaatatcctgaggcaaaaacaaagacaaacaacaacaacaaacctctcaacctgtcttacatctccacaaaaattacctcaaaatgaatcagagacttaaacgtcaatgtaatattgtaaaaattttaaaaatacacacaaggaaagcataatgaactaaggttaaacaaagaattggcagatatgattccaaaagtatgatctataaaaggaaagttgatagattggtacttatcaatcaaaattaagaactcttgctctgtgaaagctcaggtaaaaaggataaaaggtaagctacggactggcagaaaatgctttcaaatcacgtacccaacaaagaactggtatctagaatatataaagtactctcaacacttatcaggaaagtaaaaataatccaattagaaaatgagcagaagatatgaagagacagcaagcacagaaaaagattttcaacatcattacaatcagaaaacaaaacaaaacaactaaaacatcacccactgctaactggtgatgatgtgtacaaagtggatcattcatacattgctggtatgaatgttaaatgatacagccaccttgaaaaacattttggctgtttcttacgaaactacatatgcaatttccatatgacacagatattatactcttgggcatttatcccagagaaattaaaacttatgttcacataaatatctgtacatcaatgcttgtagcaattttgtttgtaattataaaaaagtagaacctgcccagatgttgttcaatagctgaatggttaagcaaactatggtacatccatagcatggatcactacttagcaataaaaggaaataaactactgatacatgcaacaatttggatgagcctccaggcaggaaagtaaactgattgaaaaaaaccaatccccaaaagttatatactgttagattccactaatctaagatttttttgaaatggaaaaataatattataaatggagagaaattagcagttgccaggaattaggaagcgaatggtggtgagtatgtgggatgaagatgagtgtggttataaaaaggaaaataaagaatcggtgggttagaaatgtccaatatttttattgtggtggtagataaacccaaagtggtgaaaaatattgtataaaacttaaaatgcgcacttacacaaataagtcaaactggaaaaatctaaattaagatgaacgcgtataaaaatatcaatatgctggttgtgatattatactataattttgtaaaatattattggagaatactgaggaaagcatagaaggaatctgttttatttcttaaaactgcatgtgaccttacaattatctccaaaatgttcatttattaaataaatactttaaaaaagcaccaaaaatatagatataaacctttaaaaagatgtctaagatctatagaccaataactataaaacattgcttagagaaattgaagacctaaatagatggagttatgtcttcttcatgagttatatgactcactgaagttccaatcaaaatctcagcatgcctttttagaaactgacaagctaattcttaaattcatttggaaatgcaaaggacacagaacagccaaaacaatttgaaaaggaagagtaaagtaaaaggacttaatctatacaacttcaagagaggtcattatgctatagtattcaaaatggtgtgggtttgtcataaagacaggtaaatcaatgcagcagaacagagaatcaagaatttgacctacatatatatgccaattgatttttaacagtgatgtaaagcctgtgggaaaatacagtgttttagtttgggcagctgtaacaaattactgcagcctggttgcttacatatttatatctcatagttctggaggctgtgaagtccaggatcaggatgctaagatggttagtttctagtgaaggccctctttttggtttacagatggctattttccttctgtgtcctcacttgtcagagagcagagagagagagaaaacaatctctttcatgtctcttcttataagggcactaatctttatgaccttactaccatccaaagactccatctctaaatatcatcacattggcaattagaggcttatcatatgaatttgaggcagacataaacatccagatcatagaagttcatcatttcaaaatcaaagtatgatgcaactgagtaaccatttgcaaaataaataaatagtaagattctacttcataccacaaacaaaaagtgattcaaagtgtatcacagacataaacatcaaatttaaaactataacatttctaggaaaagaaaaacagaaatctctgtgaccttaggttaggtaaatatttctgaataaaacaaaagcacaatgcataaaataaaatcaataaattaaacttcaacatgaggaatttctgtttttggaaaaacattgagaaatgccacagactggtagaaaatagttgcatgtttcatacctaaaataagagttatttatacactgtaaaaaaaaaactctaaatcttgaaatctaatgaataaattgataaaaaagggtaaatatttgaacaattagctcaccaaagacaatatgcagatggaaaatgaacatatgaaaaattgctcaagatcattagggaaatgcaacttaaagccacaatggattctactacctacttgttatgatagctaaaataaaatagactgaccatacgaagtgctgcaagagctctcatacactgctggtaggaatgtaaagtggtacaaccacttggaaagattatgtcagcttcttaaaaaggtaaacgtaagcataaagaagttgatctagtcattgcaatcttaaatatttacccaaaagaaatgaaagcatatatccatagaagacttgtgcacaaatgttcatggtatctttattttttatagccctaagctgagagcaacccaaacatccatcaacaggtaaatggataaacaaattatggtatatacacacaatggaatgaatactactcagcaataaaaggaagtgaattactgataattggagccccagggctgaatctcaatttaattatgccaagtgaaataaactagagtaaaagtatgtaatgtattattctgtttatagaaaattctagaaaaatgcaaactagaaaaatgcaaactaacttatcgtgatgggaaacagatcagtagttgcctaggacaacgatggggttagaaggggctgggggaatgcaagggaacacagggatgcttctgagggtgatgcatatgtttattatcttcactatggtaatggttttatgactacagacatacaggaaaacttttcaaagcatacactttaaacatgtgcgattatatgcctataataactcagtaaagttgttgaaaaatgttaatagcttcccattgcccttaaaattaagaacaaatgattttcacaggatactatgttctacagggtctccccctcgcctacctctccagtctcatcttttgcccctccctgaccatctctctgttgccatcaggattggccatttcttcaaggttttcttgtccttccgacctcaggatctttgcaaatgcaagtccccctgctttcccacactgaaggataagctcaaatcaatcacccttcagttctcagctcaaatattaccccctaagaagagacttaactacttccgtaaatagctcaggtttctgtgttatttcctggcactctctactatttcctttttaacatttatcacacatttcacttatattttcagtaaaatttaatgtatatcacatgccactacagtacatttacatatattatgtaatcaatacttttaaagaactagatattatgacagttttacatttaggaaggagattaagaaactttgcttaagatcacacatagagtagtcagtgtcagtaatttgaacacagccctatcctgctttaaaacatagggtcttaattaatgattaattaaatgattctatgatataatgtccaccctgatatgataccaaaaagaaatctgatctgctgaaagcggatgtatgccaaggaatgcaagtggcttccagaagctgaaagcagtatccagctgacagacagcaagggaacagggacacatacaagacaaattctgccaacaggcatgaacttggaagcagcttcctctcctgagcgtccagagaggagccctgcctggccaacaccttttgagactgtaagcagaaaatccaattaagcccacccccccagacttctaaccaaaagaataaatgtatgtttagttcattaatagctatttgttatgcagcagtggaaaactattacttttctattttctaaagtgcttacatatgatatatagggatcatttacaaattatatttcttattaataagttgatacagtatggctctgtatccccacctaaatctcatctacattgtaatccctacatgttgaagaagggacccagtgggaggtcattgtatcatgggggtggtttcccccatgctggtctcatgatttgtagtgagttctcatgaggactgatggttttatatggggctcttcccaccttggcgctctctctcctgccgccatgtgaagaaggacatgtttgcttcccttttctccatgattagaagtttcttgaggcctccccattcatgaagactgtgagtcaattaaacctctttacttcataaattacccagtctcaggtacgtctttataccagtgtgaaaattgtctcatacataagtcatgggctcaatcaagtcattttaacttttggggggttttgttgcttgatctgtaaaatgaagttttactggataagttctactctctcaacttccctaagtctaagaattcatttctagctttttgcaactattgtgacacaccctgatcaggtatcctccattctcctctccagattcattctccacccttcagtactctgcagtataccccaagagactgacccctaagaactacatcagtgggctcccttgtccctgagaatggggcagcagaagtgataaagaagagcgaggtctcggtatttatttcctggcttcctacaagtacacaatacattaaggggaaaaatgattcctaacttcacttgtgaatttttggaagcagaggaaggacacgtaatggactgaactgtgtcctcccaaaatgcatatgttgaagccctaaccctcaatttaaatgtatttgagggagggcttctaagaagtaattaaagttaaatgtgttcataagtataggctcccaatccaatagaactggtgatgttttagaagaggaagagaaacctctctctctctgccacacatgtgcactgaggaaaggccacgtgagcacacggtgagaaggcagcaatctgcaagccaggaagacagacagcccttacccaaacccaaccattcttgcacctgattttggactgtccagtcttcagaattgtgaggaaataaatttctgttgttaaacaacgtaatctagaaatcaaagatcactaaataatatcgcaatgggtaaacagacggtacttccaggcaagcagtctatttgtaaaggtttaaactaagttgtgtagtatctgacaagtaagccaaacatagatatggagagtccaggctgggcagggtggctcatgcctgtaatcccagcactttgggaggccaagacaggtacattctttgagtctaggagtttgagaccatcatgggcaacatggcaaagcccatctctacaaataaataagtaactaaatacaaaaattagccaggcatggtggtgcatgcctgtagtcccagtctttactcaggaggctgaggtgggagaatctcttgatcccagaaggttgaggctgcactgagccatgactgtaccactgcattccagcctgggtgacagagcaagaccttgtctcaaaaataaataaaaatataatgaaataacaaatatagggtccagaaaatggccccgaaatcaagataggcaaaataagtcaataataaattcctacaagataggggtaatcacagtgatgtcctacatgaactgggctactggacagactaacaaagcagagactgagtaactaggtgcaaggtgagaagcaagacatctccagggctagatagaaacttatggagaagtctagagaccaggacataagtgtgacttgatcttgaatgcaagaatgctgatttaaatttccaaaatctctcccagcccctgaaaaccttcacctcactgctcccttcactccctttcttcaagtcaaagactgtctgagcagaattaatccccatatatgaaaattctataatgtagaagccacatggtaatagcagaggaatgaagacaaaggggctgtattgtaaggaagtattaattcaatattaaattatctaagtaattacgtgtgcaataaccagacattgtaatgtaaatcacattatctaatctgtatttttgtgaagttaaaaaaaatgagctcagctggtaagcatttgcaatttgaatcagtagacagaattttggagaaatgacactgccacttaacagacaaaaaacattgtggaattttttttccatttgtgtgtgtcttctattacctctttcagcagtgttttatagttctccttatagagatctgtcacctccttagttacatatagtcctaggtattttaatttttttgcagctattgtaaatgggattatgttcttcatttcactcttgcttgttgtgtatagaaatgctgttgagttttgtacatcgattttgtatcctgtaactttattgtagttgtttatcagttccaggagtcatttggcagtctttagggttttctaggtatagaatcagattgtcagcaaagctggaaaaatcagtattaaaatggccatacttcccaaaacaatctacaattcaacgctattcctatcaagctgccaacggtttttttttttcgtgtaactagaaaaacttattctaaaattcatatggaaccataaaatagaccaaataaccaaagcatttctaagcagaaagtagaaagcgggaggcatcatattacagggcttcaaactatagtataaggttacagtaaactaaaacagcatggtactagtacaaagacagacacatagaccaatgggactgaatagagaaaccagaaagaaagctccacacctacagtcatcttaccaaagttgacaaaaataagtaatgaggaaaggacttcttggtcaataaatggtgttgggatcgctgacaagtcatatgcaaaagaatgaaactggacccctacctctcaccatatacaataattaactaaaaatggattaaaaatgtaaatgtaagacctcaaagtataagaatcctagaagaaaaactaggaaacatcattctggacattggccttgggacatttgtgactaagtcctcaaaaacaattgtaaccacagcaaaaaacattgacaagtgtgacctaattaaactaaagagcttctgcagagcaaaagaaaactatcaatatagtaaataccctgcagaatgggagaaaatattctcaaactacgcacacaacaaaggtctaatatccagaatctatgaggaacataaacaattgaacaactgaaaaacagctccattaaaagagcaaaagacatgaacagacacttcttacaggaagacatacaagaggccagccaggtgcagtggctcactcctgtaatcctagcactttgggaggccacggtgggcaaatcacttgaagccaggagttcaagaccagactgaccaacatggtgaaaccatatctctacaaaacatacaaaaattagccgggtgtagcgggccacagggggcgaggagagacctgaggcaggaggatcccttgcatcccccagaggttgaggctgcagcgagctgtgattgcaccactgtactccagtctgggtgacagagtgagactctgtcttaaaacaacaacaagaacaaaacagacaagaggccaacaaacatacgaaaaaatgatccacattactaattgtcagagaaatgcaaatcaaagccataatgagacaccatctcacaccagtcaaaatggctatcattaacaagacaaaaacaacagatgctggtgaggctgtggagaagagggaatgtttacatactgttggtgggaatgtaaactagttcagccactatggaaagcaatttggagattcctcagagaacttaaactgctattcaacccaacaatcccattactggttatacatccaaaagaaaataaatagttctaccaaaatgaaatactcatatgttcattgtagcactagtcacaataatgaagacatcgactcaacctatgtgcccatcaatggtgaattatataaagaaaatgtggtacatacacactgtggaatactagccagccataaaaatgaacgagatcttgtcctttgtaacaacatggatgcaactggaggccattatccaaagtgaattaacacggcaacagaaaaccagtgccacatgttctcactcttaagtgggaggtaaacaatggaactcatggacattaaaatggcaacaataaaaactgaagactactagaggagagagggagaaagtggggcaagagttgaaaaactaactattgggtactgtgctctaccctgggtgacaggatcaatcaatccgaaacctcatcatcatgcaatatacccacccaggtaacaaacctgcccatgtatcccctggatctaaaataaaagttaaaattataaaataaataagttgaattaaaaaaaaaaaaaaaaaccttgtggtactcaaaattctgcatgcccaagtggatcaggggccgaaagtacagggcattcataaactgtctttaatagtttatgttaaatgttgcctcctgtcagtaagaaagcactcctcttaaatcaaaaactataatactgccagtgtctgtgacacatttatttctttaaaggaagtaaacttttaagccaaacttcttacctgctagatgagaattcacccaagtcagtaaaatccacataatttcaagatattaacaatcagcacaaattaatgtcaaccatctgtaattcttacaagaggatgcttgtttgtttacaaagagtataatttttgctttctaatacattgttttgtagcataggtatctttggggttgaaatggaataaataacatttcattttcatagaaaatgaacactatataatgaatagaacttttcattgacaatcttgaatgcattacattactcttaagggcattgtgtttttcaaatgttttaagctagcatctctcctagacttaaatgacaaaatgaagttcaccatttctagtttgactttttttctaaatttgtcttccttcttacacatcataaatcaagtttgatccatattggaaaccatatgttttcaaactgatatctttattaatgaaaatatgtaagtataaattcctgggcagtttttttcagcagcctagaatctaatatcaattgttacgaagttcaatgctctaaataaccatgagctccagttaattgacaagattgaatacacattttaaaataacataaagaatgttgactaaacatttagtcattatttctaaatcttaaatagtttaatattatcatactgccatggaataaattgtccttagaatcaggaggatccaattttaggattttaggattttaaagttcacaggggctactggttcttacccaaagctagtggcatattcactaaaaccacaacagccgtgtctattatgtttcaggttgccggagtaggtcgatgcactggtgaaataataggttatatttctggagcatagaagggagaaaaggacaaaagtactaattaaatttgaaatctgtataatcctggaataaatacacaggagaatacgttaattccaaatgtcagcctcattttcactgaacttctaaaaatttttaacaacgctttaatttttcaccttcatatgaaagtgaaggtccagttttaacaaaggtcttgaaagagcccaaatgcaaacttagatatcatattcttatgtttagaaagtgcagtgcaagcagcccaggtatcaggttgcattttcatactcttgctactctggtggcaacgcagaataactgccataaatcatctcttggctgtatacaattaattttgtgttctgtacttatactcctctatgtttttatgctgttttttttttttatatatgacttttgaggtcactcttggttttaggtgaaatactcaagcttaatattaaaatatcactgggtgatattgtagtaacaagttctaataaccaaactcagggtcaccccttctgcaagttttaaaattaactgtcaaaaaatgtcaaaagaaaaatatcttgttactccttaacctttttgaatataagaagatttaagtaagcttattatacttcttgaagggtaaaatatttctactatcactgcatattttcacagtgatcctttatcttacttattatcaccctagaaatggttttagacttcatcattggttcttactatttagctgattgcagtaaaacagaaaaaaaaactgtttttaaataattttcagaatagctattcttccagacgggagtctacggatcctaaatgcttccaaatcagacgagggaaagtacgtttgccgaggggaaaacgtctttggttctgctgaaattatagcttcgctatctgtaaaaggtaagacagcacgggtaaatgttttacaagcatagtctcatggtcttatcggaaagagaataaatataatataaatgcatatatgtttggacttaagtgtgtgcatgcttgtgtttataaaatacattgcaaacatagaactaaaacagccacattgttactttccaccatttagggtaccaaaaatgaaggaacctcttattggcagaaattttattttgctttgaataaaatttgtgagagaatgaggcaagctttctgaagttttagtcagtgtctcaaaacttgaaagtatgccaacggtataaaaatatttttcctctaccaagaataattttagcatcaatcactaatattactctgttatcacttcaactagggatttggggcagaaaggagcagcagcaggaggatatgatggaggggtggtataggacttcgcattagataaactggctccagagctgtttgttgatgtctgtatcaatgaaatttttatatgcctttattttatataagcaatattaatattactgcttatatgtttccattcattttatcgttctaaaatgagctcgatttcaagcctagaacattctgttgaggctctatgtcattgtttagtgacagaaaacctatcttaggcagtcccttcagatgtttttcacattgagtctttaattgttttcactgtgcatgtatcatatggcaaaccatactccggccataaaaatataaaaatattattttttctgtctttaaaataaaaatgtaattaatacatttacattactggtactaaaataccagtactctgatattttagaagagagaacatcaagaaagaaaagaacaaaatgtaaaatatactttcatttatataatgcattactggactcaaacgcagcctttcagttcttattccttctgtgtgctagttgttccattttgtaataaggcaatgctagatccaaagacatttttaaaataacaacaaaaatgttattttcttaatcatgagtttaattgtttactcagaacactccaatccccacaaaatttaaactacagtgtactgcttttatctgtcttctctgatgaggccagaacttagaatgccatatggaacatttgacttccagaatgttaatatttacagtgacattcctgtcccaggattccatttttttctcagtgactgcatagaaggacatggaacattaaaggatctgatcagtggttaggagtggtgtttcatcagactgcactgtcgcaaacaatagacctagaataggaaatttaagccaattgttaatcactgtgttaattgtcttgaggtatctatgaccaggaatctaactaggaaagaagataaaaccaaaatcttcatcacctctctactatatttaaaacacatcatcttgtaatcagctaatcactaacttaactcttaaatgtaaagcctgttttagcctttattggttcaaagttgctctaaacccagtaaaaaagtgtgtttttaaaatttaactgaatcattaaggagttaaacataaacattgttttctaaaaacatttccattcagtgtttctacctttctttatatatgccaattaagccatctacaatacagcaaaggtacaaaaacaggtacgttcttctgattaaaaaatacttttctactcctaaaagctttttgtcgagtgtaaagcaaatacaaggtagtgttgttgtagtattatatttttatctctgttaagatagttatttggagggaggtgctttctattgccctgtagcctcctctcatctttaagcaagtgaaccctctctgaattcttcctgaaacacataacctttttattgtaaaaaatcttttatttacttaatgatccttgaaagtggtcagagaggctacagcctcttctttttttctaatgttcctccttccataatgtcaaatgctgcttctaattaggtagtctcttgtctttttaaaatccaagtcacattcttaataggaacagaggctcttaaatcatttctcccctacaaaaacatggtaatatgccctagcatccaaaagctaataaagatgtaaaaaagctggtatatgtatctggagcaactgtattgtatagatttcttcttttctcaattatttcaagcaaaatattatgtatggtaacacaacaggttgattatcttaattaacgtatttttatttctatagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggccgtaagtgaatacacttttattcttttagtaatgataactttagaaattttgaatcaaatgtaagaccttgcttagctatgaagtgctaagaaaaaaaaaaacagaacatcgacttgataaaaacaattactttctgccattattttatgttatgtcaaactgaaagtaatatgtaattattttaaaacccccagtaaaaaactgagaatacctcattatttaaatctggtttctttgccacctttgtttaatatttacacaatacttctcaaaagttatgttgctacataaagtggcaattcattatttaaagcatcgttaacagtaattatgataaaataaataaataaaatgcctgcctgtccttctcctcaagaacagtaatttttggagtttctttaattttttacaagctatagagcttaaacatacaactcgtagtcataaatgcacattagccttaagtcagtattcaaagatatactcatttctgccatttttttcttaatatcttcttttatattgtgtacctacatggcaatcaaccaaatggagtgggaaatctcttgaaccaaatcctacagaaccatcacagtgctttaactctagagaagtgaaaagaggccccttccccacatggacttatttaaaatgtaatagagtaacataatgagagagggaggagaaagacagatggaactggggtggcagaaaaagagcgactttggctggaatcttccttctatattggctaaagagatggagccaaatacaatttttgcctacaaattggatttaaaatgctgttgcatacttattagtatcagttgatccatcctgaaacactttgagaagcattggaaaaccatagctttagtgagcccaagtatttaaactcagtgtcaattggattttattttaaaggttatgggatacaaggaaaaaaaaaaaaaagccctaaatccaaagtcaggaattctctggatcaaatcccagcttaatctctagtcagctgtgtaacataaagccagtcacatgatttgcctgggcattaatttctggagaaatcaaagtgaaaaagttacaccagataatttctaagatagcttctcaccttagaatttggtaaatgtatattagtggaagagtaaagatgagctctctttgttgcattttccaatgtaacaaaaattagcccactttcttcaaaactattcctttcttcctggtttactatccaattaataggagagagtatataaataagaaacaattgccaactacattgttcaccatctcattaaatgagcgaattttaactgttaatatccaagttatatgtaaagtatttagagtgtgttaaattaaacacattttgctctgctttatggttttccttcttcctttaccttgggtgataattccttcctacaatacttttcctacacattttataacatggatgttgtaaaacagaccaagaaaatttaattttaaaatatcacattttgattaaaaaatcccatgagaaaaatatcttcttaggattgtctgcaaacatcccttttgagtgatcacatatctaaagaaaaaatacatctaaaaataaatagcccctcttcttataagtaatccctctctttattttacaataccaatataaaaatgaatgtacctggtgaagttacatgaattattgtttttgtctcttagacatagatatgtttaggttgatgtcattcatttgtatcaataaatacctttttttccatgaagttggcagttaagaacatctgctgtattcttctttgcatatatgctttccttgccccagagagtgccaaatggactccttattccacgcaaacccatataattacaacccactttgaaattaggctctggattagagacagtaacaataaactctgagatagaagaagaaagcaaatcatggtactgagaagggagaaaaacatttagctttaaggtataaagccaaaatatacttttagtatgcatatgtattttaaaacatatggaagcttcaaaactatggcatgtataagaaattatctatcacctttctctcagttacttcaaacactgagtcttggttggcttcaaggacacacaccagagaaaataccattgtatgacaataaaaaggcaaagaatggaaagaacaacattctgtttcccttctgcccttctcatgtaaattatgtctggaaaataatgctttaggagaaaacatataaaagtgttataaaggcagatttgggaggccttctgggcttgtggataccttctttctgtgagaccaaggacagactgtgggagtcagagggacaggatggggctgagaagagagccaagtggggtgactcaaggtctgctttgagtttccaagaagagtcattaaaggatctcctaaggtgtctaacttatcccagcagagtaaaaaaatgaaaatgggattccgggacttaagcaggaatagagtgtgcctatgattggagcactgtccaggctaactgtcctgggacagaaccctgccagtgggtgagtgaatgagggtgaatcagaagaaaaacacattaccactgcatgaggtaacttaaactaactaaacctctcaggtgggaaaaagagataacaatattttgtattattttgtagatgccaaaatatgacttaatgatgttccctatttttcaactgttgtactggtatcttttatacacagacattagcttgcatataaatctctagtcaattattttatgtagccttcatatacaatctatatacaatgtacattgtatacatccacatctatatacaatgcacatttttatgttttaaaatagatgattgctttgaactccatttcaacagagtgcataaacatatgatcacatcaggctaaaaaataatagtattgctttaaattaaaaattaagtttaaattaaaacattcataatgaaaatgcttctactatttatgttgccctcttaggccatgttttacaaactcagcaatttgactaatttggagtgaatccattattggaagtcactgttgaaaggggagaagcaatcagttagtacataaacatttgatccaattcatccaaatccttttttttggcaaattttatgaataaactgaatgtgataagctagtgagtatattcttaagattttaaatctttttagttctacaagctaaatgctgttgggggatggggatccaaaataaaaggcatagcccttcacacctaagagagcaccatttaagggtagaaattgcagtatgggctatgatctgctataataaagctacaccagagaactatgtgcattcagctgtttgttagaaggggttggtatttgaaatggacctggcctcagatccattcaaatggaaggatttcagcaggtgcataggagaagctgcatctcagacagagcgagcacgttgggcaaacaaagaagggcagaagagcttagtgcgtgttttgggaacagtgaggaaccagtgagggtgtatagtagacaataagtcactgtttgttgaataagtttaaaggaaagcagcagaggcctcaaaggcactgatttcggagctataaaatttgatttgtattttgagtacagcagggattcacatgattcagatttgtttttaggaagataattctgacagctgtgtggagcagggattggctagtttgtggattttacattcagtgtagacctgttaagtagaggttataataaggagataatcgttgtaagtgttgaccttaaataaccatcctgtaaccaaataaaagcatttactatggtgtcctgacttgagagtttatgttggtcagaggtctacaagaacctctgattcctctcaggatatctgaatagcatctgagctattgagcattgccatgtggccccagagccacagtcttaatggaggactgtgctgagccactgttttccagtgacttgaagtcctctaattattcaaataggatataagaaagtttctatccttataatgcataaagaagtgttacactgaatatcatggtggcctgcaatttgctgcttttttaacacagaaaaatatctcacgcatttgttgtcagaatggtccactagagaagaattgccctttcattgtgaacttgataaattgcaaccaaataggcaactgagccaaagtgctatatagctgtatggtccttcacatttacccaattctctggttatagcaatacatgtaggaaggcagaatgggaattttgagcccatttttttaatgaggaaactgaagaataagacttttccaggccacataaattggggtaataagattcaatatcatgtgatttttaaactacacatttgttcactctcctttataaaccctctccatattcactgaccacttcttatgtgttaagcctttgtctataaactgtgagaaataaaaataaaaggaaggtttgaatccagtcttcagtaaacataaagataatgcaagacattaagcaattcaagaaaaatatgaccataaaaacaattactaactaacttttaaaatcacagccaaattttgttgaagactagaaagagattaatgtgatattttgtcattgtggagaaaagcaaaataaataattgaacacctatgtgccaagcactgagctaagatagatggatactgtatgtatgtctgtctagacacacacacacacacacaatagctcactgattcctcttaacagccatatgaagtaatgttatttggggaaaacatgctacctgacctagacctcagtgagtagcattagaatagtcaaagaagaaaaaggaaggcaacctaaggtgagaaaagatattgttatcttagggttgtgctggatcttagagattattgagtttggcctaggctggtaccggaagtctctttcagtatcactagtgtatgtcctaaccctttaagtgatgaggactcactcctctaaagttcgtttcattatcagtcacttctgaatgtcagaagattggaaagtaggagtaattatgatcacctgtatgccaagcatgagactcataaggaaacatgcctgattcatatgcagaatttttgtggaatattaggtgaatagaaagacagaatataaaccccttagtgccttgagaattttatattagctggaaaactctagcctatattaattttcttattacagacacttctactcctagtttatcttcttcagaattagctatttcctaaggagtaaaagtctctgaatagaacatagtaagtgctcaattggcaacattctgtttcctgattgataaatattaattgtgtaaaaatcaatggaatgcttgggtatactgccagtttactaaggcacaaagctgtaagcgtttcataagcaaatgcttcatcctcttcttcatcaacttggcatgcgaagtcctggagccatttcaccactaaacaggaagtgtatcaaagggcggaagatctaacaaaggctcacagtctcttagactcattatgtttgctagtagcattcacactttcatgtaaatggtcccatggactccgagcgctaccctttccctatctcactaagggcctatcctttctcatcagttcagatcctacctcttggttctttggcctgctctgaacgctggcaacctagtaatccacccattttctattccaacctcctgaccgccacatatttgctatattactgttccctcccaatctttcacctaacttaaaaaattgtgtaattttaataggacagaaacatacagtaaccatcaaccaaaacttggggaccctcacgaagaaagattaccttcaaaggttttagaatattcagactatcccagaaaagtgcaccatattcattctccctgacttgtatgtgctaaaaaatgtgtctccactcactgtcttctcaaagtagaaatcattccgaaagcaaataagaatgtccatcttttttttggtattatatatgtttgtttcatatagtttatgaatatgatcaatatatgccatttaattatgttattctataatatttcatgtattgatgataaactgcagggatcctaaaagcaagggctaataagtaattttatttttcatcactttgtactaagaatgtccataaaacagccattcagctagccaatgctgtttcaataaaaacaaaacctgatataaagcgttttctctgcttagccaactgctacattatttcagaggttttaatataattaaatactgcataaaattctgttaaaatctgttttcataacagaatagtttgtttccttgcttttttactttttacacaaaatggaatatcacgttagcacagtttggaattgaatgaaagatgactgccttgatgacacctaagacagtctgttattgggagacccttacttcctatgggtcacagggcagtcagtactggaaagtagtgctgtattgattgcccatctccactttactctaattagcagatttttcacacatagcaaaatgtgaagtgcgtctcttcactttctgtagattgtcaaaattagtaaaattaggtaacgtcttcaagttgtcccatataaaaagacaggcttagccatccaattcataggctgaactttgttcatctaaatataatctaccaaaacaaacttcctatattgtcgtaggtatacagagcatttttattaatttggaagttccatttttgatagctgttttatctttatgacaggtctcataacattatgtgtgctatgaatagttactagtatccttgcaaatttttattttggtgtagaactgcaggtctttgttattattgtcagagagagaatataaagctctctgatagagaaaggcaatttttgtcgggggcatgcttggaaatattagatcaataccttggattctgtaatctctgaggggataagagtaccgtaattcccagagccagctaggatattttaggttattggatagaaaaaaaattgaagaatgagaaatagaagacactccttactccttagaatttgctctcctaggttgtaaatttcaaaagttaaatatgcttctagctcagtaactccagaaacttaaaaaatgcttacaggtatctaggactgtatatgttttctctttctgaggttttgtgtttttccaatgttgtttttccatttcatacctatataaactcagactagtttttaataatcctatattctcactgagttgattgtttttaatccaacaaaaacatgaatttatctggaatgaagtgcctattattgggaaatgtgatcactggtaggccacagtgggttgttgcattcactgttgttaactttgacagtaaagtcaatccgatttatttcagtgatgtttattaaaccaaattctcacctaactccaagttacttttgacaatgacttacttagacataacagtctttctgatatacataacaaacttctcatgcaaatttctattgattatcctgtaattgtacattgaagagcaatcaatggctcctggctttaaaaccattttccctttccaatctgacagaaacttcagaaggcaaaaaaaaaaagtcttaattatatacatgctattaaaagcttagaatgagtgaataaccaaataaatgaatattatcaaaaccattctttataacattatcactttccacttgtatcaaatgttcaagttactgaaatgagtacctaaattatctttggtgcctaataaccatcttttctcagtattcaactttacacataatcggtactttcttttatttatatcttaagggactgctgttcacatcttgataatttttcaatatatctctacctccctcctgttttcctttacttgtctttcactattcatattactcgtgagcctattccaatgaattgaaattggaaggataactaatgtgtcaactttaactgaagataccataagccagtgtagtagatactgtggtgtgttgcccaggttctcccttcaagactgaaccactccttccccaagctatggagaatattgggggctgacagctctcagcagtgttccgctctgggaattgccttcagtcaaagagagttatctggttcaagctgtgctccaccccaatctcatgctcaatgcatagagatgattagtgtacaggggtgattataaagaccagacccctggcctcagctccagaattacatctctcacctgttgaatgcctaatagatacctggcaatatgctagacttttcaaatattatttcatttacttccctcaaatacgctatggtatagaaattgtgttattgttgttgtcattgttgtttgacaaaacaagaaaaagaaatttagaaagataaacaactttcccaaacttaaacaactgttggatacaagagttatccaaactaggactgaactccaatacattatcatttatcagatctagggcatatctagaactatttagcaagatcacatttttaatttcctacttagtaaacttagtaatatcttgtgaaaaatgtaattatccttcatccattttagaatttgtgagtcaattatttccattgccggtaacattttcatgtattcttctaatattactcattcttatgaagtttatattatgattatgtggttacatttacactatatgagatccaattttcaagtatttatacatttcactatcatgggcaatctcctgcccctttgccagaaaacatatttctattaaatatagatatatatttatatttatatatttatattaaaagcagccgtataagtcagattattaaaaccttaattgtttgttttataataagtttgaaacagtttcattgtctgagtaagacctaagctaaaacatttaaatagaattttacatttttaacagccctttttacccttcttccctcataggtattatttcattggattcctgtaactacactgttagtcagccaagttatatataaatgagaacactgagccccaggaaggaagacaagtaaaggtcctccctaatgaagacctgagcaacacaggcccatttacgcaacagcccccatcatcacttgggcttccttgaacttaaaacttcattgccatgaacgatgttccaaatctgatttgctgttgtaaagcacagagagaactaaaactagctgtaactcttcattgtgtcttttaacactgagatgataaaaaagatggtgttattctctgaagtcttacctctttagctgggtaactacatctgttactactatacttacttgatcactattaaaacattaaaattaaaattatgttcagtaagataaaatcatcaaattgtttaaaattctcccataaaagttactgagaattatttgaaaaacatcttaaaatatcctactacacttgcctcttcagatgttctgtgggtgtgttttcccattaattaaagctcattcttctggctgctgcaattgtttcattttatggtatgtgaacccatttttatcaacatccctttttaggctttgaagcttctctcaaaatggatatgagatgcagtatgttacattgctttaacaactgaagtggatgcaaagaatgtagagtacaaaggtctcaatcattcttctgaagaaaataattggtatccacattttggacattaaaatcatacctgttcttaataagtatgcatttacagcattgttttatgcagttttggccaccaaaatccagttttcaagtcaggtatctggcagtgtctcagattcttttctttactcccatatatccatcaaattttcaaatattactaattccattttgaatctgttgattccttttctccattcctggagtcaaagtcctattcccagcacttatttctagtgctgtcatctcaccaccttttacactataatgactatcattaccatgtttctaacaagccgagtttatcatactgcccctccccatcccatccaattacataaatgtgcacgtacacacacacacacacacacacacacacacactgcccctatcttggatctaactccagcctacatatcaaacttcatcttccaacatttttctcttattattttacagcaaagcataataattctctgaaaatatcatgttctcacatgctgacccactgccaagaatactcttccctgacttgtaagctttgcaaactgcagcatttgcctccaggcaacttgaagtcctttcccagtgcttccattataccttacagatcccgccaccaggatctatgctgctttaaacatttgctcagttttttttcctcttctagtctttatgtttctgaaagttagttaggaacatacttatttgctgggcttaacacagtacctggtgcacagtaaagaccaaataaatatttgtagtcattaaaggaatcagtagacataggagtatatgaactaaaaactagccatttagagtagctcaccaagaaacaaacattgactaatatatatatatatatatatatatatatatatatatatatatatataattataggcagacagatagatatatcgctctctatatagatatctatatatctctcattgatctatatggagagatgatatatagatatctatagatctatagatatagatctgtaaatatagatacacatgaaaagaaagagagaagagagacaggctctcactctgtcgcctaggctaaagtacagtagtacaatctcagctcactatagcccccacctcccagactcaagccatcctcccacctcagcctccagttaaagagttttagttaacagaggaagtttctaacttctgttgtaattatagaatattatcagtgataaacatgtttattcattttacttcacataaaaatttaagtatttttaatgttgtcctaaaagtaattattttctctggagataataatcacaggagttgctcataaaagagaaaaatacaatggattctagttttcatgttgaagaaatactgatatgttttataagcattgcattattttaaggagaatgccctacatatatgtatgtatctaggagatataatttaacctggagaatgatgaaatgcgtaatataataaggccctgaatactggaatttttaccttgtaggaataatatatgaaaaagatttttctttttagttttttgaaagccttcttagataaaagattgttcctattatttaataccacataaggtttaggatttatataagcaaacagttcagttttacattttgaaatactattgatatgtaagtattgtgtttttagattgactcctatgttatttctcaaagtgattttcaaagagttgggtttttgagaggccattatttctaagacatctttaaaattctaccttcattttgcaatttctctttcggcatctgttttgtattaaattctaaagggtgactaagtgttatgatatatttagttttcagcttttcagaatcctctagtttctttcatggactatttttatcatattacagcacaaaaatcagctttaggagtctagaattaataataggtagcatctcaaatatgttttctctctcagaaaaggaggaagaggaaattttagaaaagactattggactattattcacttcctttttccatctggtatccattatataagagacctggaaaaggtcactttaaagaatttgagaagcatgacaccattttatttaatgaataattgaagcctctattgagcatttatcagtgtacaatacaatcagccttctgtctcacgggttctgtatccatggattcaaccaatgtggatagaaaacactttaaaatcaataagagcatacaacaaaaaatacagtacagtataacaactatttacctagcatttatattatattagatattataactaatctagagataatttaaagtatactgtagagtatgcattaggttatatgcaaatactacactatttcatataagggacttgagcaagcatgcattgtgctatgctgtcctgaaaccagtcttccatggatacagaaggcaactatacataagttcttattttatctcagttccatggaaataagtggagcattcacacactaggcactattcaggagctgaggattctgtattaatcaataacaaacattatatgggaggtatacgaatacaactgaagtaaagcactgtctttgagggtcagtcttacagaggaacatacatatagagatatggcaattgtaatgaaggaagtatgttcaggaagctgagtcaaaggtacacatcatccaacccgtggaagcagggcagacttcctaaaccaaatgttacctgtgcctactcttaaaacagagtaagttttgcagacaaagcagagagaggaagtacaaaagaaaaagactttacaggtagagggtgagcatgatgaaatatgggagatactgaagttttgtctactaaatcccaataataaataatgatcttatagttaaacttcatttaatatattactatagtaattctgtattaaagagggcttctcaaattccctatgagagttaagtaaatgaccatgattattcttggtttcaattatagcaaggtacatatacatagcaaaagtaaagttgccagatttttccaaattaaatccagggataaactatatcttgcttaacataagtatacgtgttttacataaatttagatgttgcttgaagctttctgtggtatagataaaatagaaattattacaactgtaacactcaatttttagggtcattgagataattccctgaggactgtatgattttttttcgtgaggctgcttgttattctaaaggcagttctaagaataaatgtacttcgggaaaacagggactaatatcagaacttctgcttcctttcacatttattctcatactaaacaataaatttttttaggacagggattatatctattttgccaaccactgccagcacctggcatcatgcctggcagatatatttgctaaacaaaatatatattaaataaaatgtttaattattatataaacaaatagaattgtatatccttatatatcagcacttttttatatccttattatctgctgaactacccaaccaaaaaataaaaatatatcaatgtcaggaaaaatgtgataactttgttcactttgcaaacacttaatggttacctgtaatgtgtacagcattaaccagagtatggttgaataagaccaggccagtgtcacccttttacatagagctgtttgtctattaacagatagatggacctttaaacaactatttaacatgataagctttatagtattcagatattatactgatgagagaaataaactcgaggagaaatttgacttaataaataggtatgtcattagcagaaaagcttgttcttacaattaatgtttaattgaattcaactaagctcattactaaaggttgttcaaccaactagcataagctaaggtaataatctgactgataatttttgaattaccttaaaatcaactctttttctttatataccttacacattctataaaaccaaagaatttactattttcaggcaaaattagataaaataatttagattgctttaccagtgaagatataacattactaacttgttcaaagacatcttaagaagcctcactaaaactaaaaaatactgcattttatcctttctaactactgatagccccataaataaatatattatatttacaaaatttgttttaaagtacctattaaatatagtgatagtatttcctaaaagcatttttgaaacctgtacttcaattgccattatttatcatttgcaagaaaagttaaatacttatggctttccccaaaataagggaccctgtgacatgctttgctcactgagctcgtcacatcactaatcattccaacagtctgctatggtgtctctggtgtttaaaattactgtagctctaccatgttaaactgcaaacatttcaatatcatatgacaatatcaaatgcttccatttgctttgtaaaataatcaggcaggagaatttaaagttcatttttgttgctaactttttttgggttttgcccacattgctgtttccaaccacatttagtctcataccaaaattctgactggaataactcattagtctgtctcatttttatattttaggcattgagatttaaatatttttagaggaaaaaactacatttaagtatcaatgaataccttttgctcatctgctgtaactataggaaaggaaataagaagttgttatcctaaatatatagaggtaagaattaaatatggtctctatcaattttcactacaaaataaaccttgcaaaaacctagtggcttcaaataaccatttatttagttcatgattctgtgggttggcaatgtgggttgggctcagccagagtacatctatgggtctcaccaagactcacgcatctgcaatcagctgcctatcaacttcaaggcattcatttcgggcatcatctggccattggctggggctgctggaggaagtgagccacatgtttctcatcatccaccaggctagcccaggcttgttcacattaaagatctcagggttctaagaccaagagcagtagtgctaagactccttaggcctagactcagaacttgctcaaagaaacttacatcacattttactggttaaaacaagccataaggccataccagatttaaagggtaaggaaataggctccacctctggttgggaagaactgcaaaattttgtggccatttttgcaacctaccaccatctgcccacaatttttacatttctccaacttgcaactttcataccagaatccacagaagtctcattcaatcatggctccaaatttactttccagttagcttttgctgcaaaacaaactgcccaaaatgtatgactcaaatctaatggtcagtggcttgatctggactcagttgagtgactgctggtggtctcagttggggtcataaatgcatctactgtcagcgatcaggtcaactgggagctgtttggtgaagggggcagctaggatggcttgtctctactctaagtggtcttctattctgcagcaggctagtccaagctatgtcgcgtggttatcacagaatttcaagacaggaatctccagtgcacgcacgcaatgcaattgtctgtttgctccatggtcacacatgtctcactgacctatccaagtcacttacagaagcacagagtgagtgtgagaggagattatataaggatgtggatccaggaccattactgtagcaatctaccacacaacctctaaatgatactttagctgtgatatcattttgatactaaactaaaatttagattttatgtgtggtgtgatgtggaggagagaggtgtaggagatagcctttcaaaaaataatcatttgtacaaccctaaaagtcaacatatattgtcactatcaacatgaactaggtaaactgctcttaccaaattaaccagccactatttgaatggatccttttttactgaattaagttcagccagacaaagcacttaatctggttaaagagagtcatttttccattttacatggttaacattctttttaacatgttagaaaattctaatcactttacttgttaatagaaaatcagcaacagttagaaattaacagggaaacattaatttctaatgaaaacataaatgggttaattggtttttcacaaaaatagcatgtctagaagacagtcataatatttgctacctcatctgtcctaaaataatccttgttaaatgtttctaccacatgttagttctagtgatctcagtgcctcagccacattttgataaaaacaaaagcaggtatatttattaataaactactataaagagactatgggcatatctgaagcaaaaataaagtatactgcatgttacatacacaaaatgaattcataggctcttttaaaccagcatgttccagttgtttcctcactaatgaataagggtattgttatttgtgttatcactgactttgctgcagagcttaactagtggagagaatgaaaatatttatgaacctgtagctaatctagaattacattaagcatttattatataaagctgtgataacagtaggttaatctaagaaaatagtagaggttaaaaaaatagtccagcctgcacacatggttcaagcctgaaatcccagcattttcagaggccggggccagtggatcacctgagcccaagagttcgagatcagcctgggcaacacagtgaaaacctgcctctatacaaaaaaaaaaaaaaaaaaatacaaaaaattatccaggcttgatggcatgtatctgtagtcccagctacaagggagacaggtgggaggatcgcttgagcccaggaggcagaggttgccgtgagccaagaacctgccactgcactccaacctgggtgacagggcgagactatctcaaaaaaaaaaaaaaaaaaaagtccagatttatattgttttcaacttctccaataattctgtttcctatgaaacttatttatatagattatatgggtggctttgaggtacaaaataggtatacacattttaggatgtgaatgtgtaactcaagtattagacttgataattcaaagatttaggagctttcaaaagatatttgaagataaaaacaaagatgactaatgtatattgattaatgcatttgagacttgacaaagtttataatgatgatagattacattaggcagttttgctgaatttcttgtattcaacagtaatgtttccatctgtgaacacaatgctagaaaatttgtttcccatgaggtaggtttttagctagtaataccaaaaaataatgtgaaccccatcaacgtccttcaagaaacctttcaagaatgtgtatgcagtcatgatgataatctcaatacataaaatcaaaaagactttggaaatcaacttaactatatggctcgatatgccaaaagataattcaaatatagattgtgtattcgtcttcacagaaacccaatgtgctgccaagataagtttgaagtaatataactatttctaggtagttgacacattgtacaatgtgctagattaagccaaaaataaaaactgtctgtagttagcttgagccatcctagttgcataaagctcgaatcaaacctttaagatccagagaccagttgtaaaatgtcatcctccatgtgtctagaagtccttgatcagccactgaggtttcatctatcattataagcattacatttactatgctattacaattacttttaacattaagaacttctggtgggtgatgcccaccagtagtaaaggtaacatgcttttgaggttttggaactcagttgccagcatttacgtatttctgctagcttgaaaaggtatgatgaatagttaatagcaggacaacatcgtagcagcttccccaagattaacaactaaaataagacttttgctaagcaactttaaaataatgtatgaagaacgatgtcaaatgaagaccaacggaattgagctatagattgtagcagacaaccacagtgctagatcagtctgatattgggaaaaaaaaaaagtggggatttttttttaccaatgtcttgggaaagaccataaatcatagaggcagaatcttaaacagactaagttctaaatagccatctgtagttataaatagaaggcaatcttcacttggacacaacttaagaagagctgcttatcaggtatggatcatgttagccatacaagttgattagtttataatctttagttgatggtaaacacttagctttgtacttctccatcataaccctagctttcagctctaagtcagtttgtttgtttttttaaccacaatgaaggtacatttaatttttctaacataaatttttaaaagtttattgtagatcatttgaacatattaaaacttgaaagaagaaaataaaaactacctggaaaattatgtggatatattcaccagtaatgtttgtaaccatgttttcatatgtcccttcaagcacatatagacacacactttacacaggtgagatcatatcatggatgtttaaaatgctttaaaaggatgactttccccctacttttatctccccataatggcatctatcacacccagtttagtttgctaatatcctcatgtatgtccttctgtattttactctgtcctactgtagtcctgggcagatttacatatgaatgggaatatttttataattgttttataaaaattaaatcatattttacattctttttctgaatctcataattatcactcaataataatcttgaaaattgttctatgtcaccttgtatagctctaatgcattcttttcaatagatccataataatccataatgtgactatacttcaatgtatttagccatttccctattaaataccaactttgtttcctttgttgagagatttctgaacaatgctacagaaaacatctttaaacatctgtatctttgtatatcaacaatttcctttctgtgggacagattaccaggaatagacgacagggtcaaagaacaaaactatttttaatttaaatgggtgctgccaaatttttgttattgcataaaaatatgcagcatctaattacattactgcattacagcattatgtggtaaaagttactagacagggggcaagagttctttgtgtaggcccaactttgtttctagttagctgtacgaccttggggaagtcatgtcccttgtctaggtctccatcttcaaagttaaaaggctagagtagatgattcctaatgactttatctagttctaaagtttggtgatttttttcatttatattcaaaaagtaaaatctcagcaactctccagatataatgtccaataacttgaaatcatgaaatgatctaaaaaaattttagtggacaccaaccatgttttaggagggattactgctagctctaaaatcatatttttctctcataaatattgcaaactttcttaatcttggaagatgtttcagtctcatggcacccttagtactgggaatttctcaatgcaggaggaacttcaaactggaaaaaaattcaagtcagaattattccccatggcagaaacaacatttgtatctgtaatatcttactaaataataaaagattcctgtaaagttaaagattttctctaaaagcaacgataagcttatagaatgaaaaaatgccattctctctgtataatagatcagcatcctttattttgtataactagttccctccaaatttcacatacaatgaaacaatcaagccctatcaatatgaaatcttggatcaaatatataagcatatatgataattggtgttgcaataaattcaaatgtgtacaactttgaaagtcttttaaatataattctaaatgcacctgtcaatgacttcagttccagcatttacatatttctgctagcttgaagacaataatctacagggtctcttgtaatactggaagctgtattatacagttagagaacaatgagcagtagtagaatatggtctcgatgatttttcagtatcaatctgacttgactttgatttttgaacattcaataaatggtgaatcctctttcataaaattcaatgcctagctaagacttgttatttaaaatgagttttctgtggctgtgtcttgactcactttcaaaatgtcagttaaatttgactgagtgtccttgaccttgaacttttcatagttggttttgattgacacatctattcaaattgacctttttttaaactgaactattcttctatttgaatgttcattggaagattgttgctgtactctacaatgtaagcattgctttgaatagttagctttttctgacattgatgtgttttaattgcctcaattctaagtatttttgaagttgatgagaatcttcctgattgtgaaagatagtgttaaaatggatgctatcacccattttcttcttttgcagtcaggtattttttcattcagaaacttgtttctaagcatcagaaactttcaaagcaagcttggcaaaagaatactcagtatttggtcttaaagcacatagttgaaataatacagctacttgttgaagactatgcttattaaaatatttactagtattgccaaaaaagatgacaaatatgtatctcataaacttgaattgtgaaaaagtttgaaagatccaaatattaatttactggaaaatagtctttagaaatgctgatataaaattaattatttcattagtaatattaagttttgtaaaaaaaaatgtatgaaagttcttctaccatttttgttcatttctttcttttaaaatgtctgccaatatgcgtattccatagaaaactgtgtatttccatagcaaaagcagttagcctaaaatatatccctgaagggtaggggcattaggagcaaaatggagctagtcgtgctaggccttctttccactgctacaattgtgcttgaaaaatgagtaattctgtctttacaactcatctccctaaatacacagttaaaccagttggcaccatcagtcttcttcctgaaaatctccttacataaacccaaagttcatccatgatgaataatgtgttgcccacatgacctcaggtgacaatgttgccaaactttccaacactacgtggaaggtcaccttttcttcaaccatgaatacccatgtcctcactgtccttcagtccctgttcaacagtctccttgaggcccttccagctttcactagtagtgtcatcatgacccttccaacctttgcacacctaaccccgaagccaacgtcaagtgttttggctttagttaacagcagtaccccacttgtaggtaccacattattttatggttattctctgctgtacaagtactccaaaacctagcagtataaaactacaaagattttactctgcttcccattttgtgggcaagtaaatcaggcagataacagcaaggatggcttgaatatgcttcacagttgctaagccttcagctggggtagccaaatggctggagatggctgggatggctcagggggtgctatatgccagaagcctcagttgtggatattggataggttcccgagatcttctccatgttgcttctgccaagtctagaatccccagtgtgattttgttattcacaagtatagctgggctagaatggttaaaataactggaaatgtctggccttctctctttatctatgtaatctcccacctcactagcttagcctttttcacatgacagtctgaatgtagtacaatttttcttacattccccagaatagatgtcccaatgggcttagaaagaagttacaagccttcttatgatccagccataggattttcagtacctcactttttccacatgatattggcataaaaagttaccaaggccagtccagattcaaggagtaggaaattagagtatacctcccagtaagtcaaatggcaaaacatatgtggacattcttaatctaccacagtgaacaagtagttatatcctaggccgaacagattctttgtacaacactgcatacaagtagtgttaccataaagcacagcaactaatgcagtgtaaaacagattgtgaatgattcattatgcaatagtgtcatgttcagccgtaataaaatagagtatatctcaccattggctctagagataaattttaaataccccataatgcaatgcttagtcactataatggaaacaggaaagaataagtaataggaaagaataagtatcagcaagcagaaatgaagagaagctggggatattaaatgtaattcatatggagcattgacattccattccaagtattggcaggtattgtactctagagagaggttgtggattacagggcaggggcagaatcaatgccctggaaggaataaaaggcaaaataatatgcaaattggtcattaatcaatgagaggaggaaagaaatggaagtagaatgaacaggtggagctcttctagttttatgggacttagcatcagcctccctcctctatgagaccagagatcgaaggtgaaaaagaaattgcttttatctgtgagaccaaaccacaaaggaggtacacaaacaaactggcctcattccatgctaattcttagagttccatacaaaaatcaatgaagcacagagtggtctactacaatcccaagattttggatttttcacaataccaggtcaatactcattttaactgatgagtgagatgaagctactcatactctccgtggctgggctctgcttatttcaaggaggagttagaaaacctacaggcaggtatctgagtattcttccacacagccaggaagagaccagatttgtgttaagacactgactattctgcaatgtaaaaatagcagcagaataaaatgtaatttatcctggaagccagtgtaacaaaataatattaatcttaaaagataaattggaaatatgacaaaacaatctctaaattagaataaaaaagatatatcagtaaaatatcaattcatctaaattatgcacttaggttaggaagtaaaatttggccaattctttttccactaaagctgtgttattataaattacacatgactaactgaggacacgtcagttgtgggtcacatattgaaaattttcttgatactagataagtgtcacaataaaagtaaatgatggcatgagcaaatgaactaaatgggtcttgggtgttatcggaaaggtgatactgacatttcatagagctatgcagccttttatgcctagatgcggttgatgaaaacagtcataaaagcatgagcttttcaaataaacctatggttcattgaaataatttctaataatagttttatggtcattactactcaatgaagccattttatattactacacttgccaaatttgaattaactagtgcaagtgaatgaaattacctataggttcaagcaaaacaaggaggggtttcctagatggcacaggagaatagaaggaatacctgatcaaaaatcagatgcccaaagctttactcctgcctccacacttagcttgcccatggacaagttacctaaactcttcagccccattttctcaactgctatgggaattggttaggctacataatttatttatctttccacactaaaatcatttttttctgcaatgactttttgtactattacctatttcaacaaaacacatcacattacagctggttgttacctctaacattgtgttgtgagtttctcaaagccataatttatcttttctctttatcttgtagcatgtgtagatcaagtatgataaaaagatagcatattttatgccagcttcttttaacacagtgacttttatgctagtcactgtgttaagaagaatctattggttgggtcacagtacagccatgcttgctatgataaagaagaacatagttgcaaaagtgtcacatatttgtgattttctgtctagacaaaatgacagtctaccaagttcttgttaaataattacataattgtgcatgtgctataagcatccataaaatgtatagctactgtagaatgttataattctagacctttcctggtggtcatgtattactagctatttacaaagcacaagctaatgcataaatgtacaatttttttctgactagttctatcgcctttgtgtaacttcaatgagaggtattttatggagcatagacttagtgaaagatagtaagattattctattactagacagtgggataattcactgcaagcaaaaatgtgtattgtctgtcacaattgctaaaatcttcttacctaccagcgttgcctcattgagccaacctatggaccagctgttattcagcttagaagatgttattactgaggagatttcaagagaaagttgatccatcatacaaacactagagaggaatttctcataactttaatgatgtgagtttaaatactactcctgcctagaattctcttaaactggtttgccattgtacttacaaaactgccaatttaaaagtgaggttgagagtcccaacatggtcccttctacctctaggactgtaaagtttagaggagtcctcacctccattctttcaactgagatactgtcctctttcctttgtcattaacaaaccagtataaagtgaacaggttgaatctaatgatatgcgtcaatgagctttgtatttgcattggaggtccaagaaaaaagtagaaagaatatttggagaaaataacacataaatataccaacgcctggatagccttacaccaaacattcagtataaaatgtaacatatatcactgtagtttctaacacaagccttaagaagatgtattctatttctgtatttacatatcagcatacgctaaaaaaagacttcaagtcaataaagcataaaagagaaagtataaacattaaagcaggaaaggataagtgttctataatttacaaagagatgcataccagctcctcgatatttatctcaaagaccaatgtttcatagaatgggctaatgtttcagaagaccacaggaaatatcaatgtggattggagtggtgagcaggaccaacctcatgggcatgtaacccactgggcaccatactgagaagggtctcatacttgatatagtgcttgactgttaccattttgaagtcttcattttaaaacaaagaatcctgcattttcttatgcacaggggcccacaaattacgtagccagtcctggtggtctgtgaaacctttctgaaagagataagacttgaacaaggtcttaacatatgagatataatttgtagattttggtggatcactggggaactgcttgaaggttcagagactgcattttccaccatggtgagagacaagataggttgagtctagcctcatatgctagattaagaacgtggaccatcttgtaggcaaaagggaaccagtgatgatttttgaggtggtaaataaaatcagttttaaaggattaacttagcattggcatagcagatggataagcatgtgagacagagagttgatcacaaagaggatataaagacctcatttcaaagctactattaaaaatataaatttaggaatcagtgctcatacaatgattgctaaaactatataaggcacacaaaaagagaaaatacttttctccggactaagcctgagtattgtgctatcaaataacagatccatctctccccatgtctcttcaaagctcagatgtaggtatgaggaaagctggtccacactccctgccaatgtgtcttctgtcaaagctgaattagacaggaaactccttgagcacagattctatgcctgtatccacaaatcttagcacagcacaaatgaataccttttgtaattagtaatatactgaataaacaataaagggagatgagttaaacagtctcatcatcaggtaacacaaacttttgccatcagattgaatggagctacaagtcagcccaggaaaacatgagattgataaattatgtgaccttatctatttcagccctctctttaccttggaagcactagattaatacagaaatgctaccagcccttttgcattactcacttgtgttaatgtcagataaagaacttcccatttaccttgtggctagggaaaacacaattgtttctcctctttaatctatgtcaacaaatagaactgtttctgcatttttcttaggacttaaattattagaatatggattgaaaattaaatatcaagatcccagtcttgggatgttacagccctatttactcattttgagtcttcaatgtgttgttggctatgtttaatacttcatcataatacacataaatgttttgtcaaatattattttgactattttcttcactagtagtgattaatagttttacttctgataacatgttcagttattcaagcatgtaggttaaatatcatctattttctaaaaacaatattaaaacccatatcatccttaaaccctattctatgagtagtaaagaaaaaactataaaaagactgtctatgtattatttccttatcatagtagggtactttaaacaaattaccagctgggcgtggtggctcatgcctgtaatctgagcactttgggaggctgaggtgggtggatcatgaggtcgagagatcgagaccatcctggctaacacagtgaatccctgtctctactaaaaatacaaaaaattagccgggcgtggtggcaggcacctgtggtcccagctactcgggaggctaaggcaggagaatggtgcgaacccgggaggcggagcttgcagtgagccaagattgcaccagtgcactccagcctgggtgacagagcgagactctgtctcaattaaaaaaaaaaaaaattatcctcttggaagaagaaatactgttactaggaaaatattttaactccaagtttttacgtcagtaacattaaacttatctaaaaatctctgtctcatggctgatacccagttatttatgctagataagatttagaaaactaaaaatgcttaatacataaaatgcttaatgcttttctacaataagacagaaaggatgtgaggaatatttatatctaaaataaagctaggtatttccatagcttactctagctatggaaaatattgatacccagtttgctaagagagtgaataccaatttaaaaaccttcctcttggctaagagtgcaattatagtgcccttcaacagataaattttatcagacacttactatatgccagacacactgctatgggctttactcacattatcatattgaaactctgagagaagctctgagcaatggagtgattttcccaaggtgaatatctaataagtggtagagcagggattcacacaattctgtcattctagaacccacatatactcttgaggtgttttttccactgtctttttccatagtctttttctcttttcctaacttactagagaggaaaaggggcagcagggccagaggtattgtcagctacacacaggaaaggaagcaagccttcatgcattcatcatctcgcttaatgatccttggctgcactagtgctagctcagctttgggaatgcccatcgtggaccttgggggagacatctacgaatagcaagtgctgattcagagacatgaacaaagtgacattggagcataaacagagggaaagctaaggaagcctagggagagagagtccagaaaaacctctgagctgtgtctaaaagaatctttccaggaaaagaaaaaagaaagagcacctgcaacagaacaaaaaagctatgcaaacaggctatgggaagtatgcctatgtctaggtgaatgtaaggttggtgttgtagaatgacaggattaagttgcaggaggtagaatcatgctctaaagagctacgtcaaaataagaagtttggactgtattctaaaggcaacaagagccagcagacactttgaacagcaatgctaaatgagctttcattatttaggaatataattggcagtcttacgttggatgagcaggatacttagtcaaaatgcgagctaagaaagaattcgacttgggtggaaagacagcattttcctgttttatttcagtcattagtaaatgtcacagtaatctagcagttgctctaatgaaacgatctgaccaagatatgtaaatgacatacccctgttgctgctctaacagagagtgaacatacatcctgtttcttaaaaagccttcctttatttactcattcaacaaatagttattaagctcccactatgtggcaggtactatgcaaggtttcggcgtgttgtgttaagcactggttgtggcaaaattcatttgaagcaacaagtagcaggatttgttcataaggtcaacgaaagcagaaaaaaaaaagacagaaaataaagcaagtgtcaaagaaagcaagaaaacaaagggtaattcctaagagacaaaaagtgaaaatgaggtttaagtttaagaaagcaagcatctgctttaagtaaccatttcattaaaagtgcactaaattgtggaggttctctctcaggaactgcatactgtgagctgagatttagtataatgggctcccacatgaattcctctcattacttctcttgaaagatcagtaaatctactgaaagggtaatttaggtttagtgttcacaatctattctttttaacttttaatctttcctgtttaggatgttaaaaatatgatgtagatagaatctaaaagagaagaattgggcccaaaatgagacgattttaactcctcaaatggtcttgatattgatagctatgccacaggctgtagagtttttgcttctgatagatggtgatgtaactttggccagtttatagagcactgcacactgttaatttcaagaaccaagtaaaggacaacatagaaaagataatctatatctcgctctcctgaattccttggacatttttgtaattttaattacatctcttctttatctgattaaacttatttttcactgtaattccatggaaacaaacaggtttgaggaattttgtccaggagatatataaataaattatttgggaagacaaaagtctggaaaatgagactatcagttattaattacaggaatgtgattttatgacatttttcaaaaatgtgagcctgaaaaatcacttataatcagtacttttctactaaactgccaccagtatggtttgtgatattaaaaaacaagcaagcaaataaaaaaaaaagccacaaaacaacatcaacaacaaaaggcactatctttcagacagtgctatttccaggaaaaaaaatcaaatcctccctgatttgtgaggcctcaccttagatttacctttagacataggtcctattctgggcctgtagtgtgcacagccattcctgattaactgagtaccccattaaaagacctaagaaatccagagagaaagaagctaaagtgggcccatcttacccacagtggcaaatataaaaaagctcattcatacagtattaaattatattgatttgaaactaaattattgtttattaacatttagagtttgcttttatttccccatttaaaaaaatcaaaggttttaaagttgctttttctgatttgagagaagtaagcacttagtctagtgaagaagagaagatgaattcagttaggatttaaaagtagcaatttatcccaaagaaattagcagtgtaggacatttactggacaaatatcacattccttgaaagaattcttatgacattttaatgcattctcactatgaagcatgtccttgtaaatgactaaaccagaccatgtcttaacaattatttcatgagagaaaacttcaataccctcagaagttcagattataagactaacaggaaggcaaaaagcaaaacacaacagaaattaaataccagaaagaaatgatctaaaacatagtatatagtaattcactgaaataaatatttatgatttgagtgataaaaagttcacaatgactttgcaccctttctatgaaagctaagagaaaaagaaaattcaaaagatatctggaaatttgtctagtttttatgattttcataaaacccattggtctatctcaaaataaaggcaaacaactaaattcttaaataattatcaggatactgactactaagaacaaacacatcactttttaaaggtctgtaatctgggatgcctctctatgactttcattacatattatttcatgtgctcaattactgttagagaaaatttttgagttctttgatgtcatttcaagcagcatgcatcttatcttattccagtcatcgttagattacaaaatggaaactgaagggaatattggagttttgctatgtcattacctgaaaaataaaaacctcctgagttattgtaaatatcaaccagatctttacatgatcacgataaaggaaatccatctttcctgatagagtaaattaaagacaacactaagtaatggaaggtttgtaccagccattttaaagtataggaacatcacctatcccatgaactaaaacatttaaaagatatcctccatggtactcattgatctccctaactgcagtttttcttcaactgtgttctaatcatcttgcccccaacaagaatcaggtatttggagcttcctttgtgttttgtaactgcactgattaacaaagattcaggctgaccctgatccatgatggtagtggttatgggaggaatatgtctttgttaagtaaagacacatggctttgggaccagcactctttcaactgagcactgtctcattctgttgcctacagtgttcttaggaaaagagctattcaataaagtcacgagataatattttgattgctatcttttcacaattcatttcccacaagttgctgttcctttcaatacgattttcttgccacaaaatacacctgtctctgaatagcaaagcaacatttttgctcacggattatttctcctatacttttaaatatatgagtttgtgcatacttaaatatttttaaatatcttagctgctaaatcattatatgcaatattaaatgttcaacccctttattagcaattgttaaaaacaaaacttctatgtgttccttaaaaaagggcatgtttgatttctgaattgttgttagataaactgtaaggccaaaaatgggcccttttactgaatatgcaaagttcccccttaagccaccttgaactaggcagatttgcaacattttaaactggcacttcatccctctttcagcaagcatcctctgcagatttaatgatcaggaacatccttctgatgcatgctgggagatatggctgcagggtacagaccacagcagacagtgtgtcagatgaggcagaacttcttgttaggggtgagtatgctaatagtgcagtctgaagacatgatcaccataaattatcatacaaaggaatttaaatgcatggactttgagcacatcagtactgtgcattttactttcaattttacaatatatgttattttcgcttaaccttttgcctttgaaaaaattacatggaaaactcctccttagtaacagatgaaaaccaccaaactaacttcagagtccaaaacacctttagtagtaagttgtcactaagtgtttaacctaatgccaaggaaataatctaaacagttgagctactaagtcacttggactacagagataaaatttgtgtgtgtgtatatatgttttgcaaatgaaaagctagtggaacccccaggcatttttttcttctactacttctaagttgggcttccaaaaacagaaaaactgcatgtgtaagatggtggcatttgcaattgttaagtgacaaggatttttttaaagtctgaaaatgtcaacatacaacctctctatgcagaaatgacagttaaatggtttccagttatgaaacagtacaccaaattctgcaatcctaggaagctacatcttaagcaaatgactagagcacccatttcctttagcacagtattccacagtatgggaaatagagatcatagcatgcatttccttccttctttccttccttctttcttccctgcctctttctttcctttcctccttccttctttccttttagctttgtttgaagtacaatatttctacattttcaccaatcataagcatacagatgtataacttaatgaacaatgacaaaataaacacaccatataactatcattcaaagtaaaaaccagaacattaccaagatcccaccaagtacctcttcatttttcatcttatacgattatattttgagtagtatgagtattgcatgcttagatcccttgtatggtctgtacagataaaaacattatcatctatagcaagaaactatattttagattaactggtcttttattcatctggactcttacaatttaaatattaaaaatcttgaacagtaaacataaggcatagagtgagcctcatcatctctatgttttagttatatatatcaccgaatgtatatgggttttggtagtgcatccatcattggttcaagtaaaatgttgtttttaaagaagtgtgttattgggtgattggtagtttgttcattttttgtgtgtttctgttcagaaggctacttgatcttttcttcaaatttatatctagcatgtatatctgtgttaccttattataaaacaccaactttttaaagtattcatcctttcaatacattctattccatttagctaaaaatttctctttgtgccttctgaagttacaagactcatggaactgcaaaccctacactcagtcaaattcatagaaatttgctttctcttgctatgatctgttttagattatgtatatttattgtctgcacttgcctagtaatttagaatgaagctcttaaaattggagctttccaaatcaatatcacaatttagagactgataagaaaccaggtatttttactggactatagggggtaaatttaagtggcaaactaacattctgctttgtaagtaaaattaaactcaacagggtttagaatataattcaggttcagctttcatgttctgctcttttagcctttggctttatgcctaggagatgataaaatgcataaattttcggattatacccaatagcaatttcaaacaggttgctattgtctgaatattcatgtaacattcagcccaagctttcacttgaagtgagtttgatcaagtcaccacttttctattatatatttgcattacttttctaaaattagtaaaaatatcttgtcatttcttcctggtgagttttagacagatttaaacactgaactaagagttctggttctcttttaaaaaattttgtaagtttacagctcctggtaattcaacaagctttgatgtttgaatattgctgtttttaatgttggcttgcgaaataaaatttgaaatagttttactctgccagtctcccttctcacactcctccatttgttggtctgtaaactcatggtattctaatagtatatgccacaggaccaaagttgagcattctagatggagcttttctgatgatggctacaattctggcagcagaatacttaaagcacaattattcaaatatgtgtcacagagagatgggaatattaaaaacaatttccccattcatcttttagtagaatactaaaagtagattggctgagcagttcactttgctcaatgtcttcatcacaaggaacgtacttggatggcaaggattatgttcttatgattctatttcagtggaaatttaagggaaaaaatctatgttctctttgatggacgggaacaacttttttattgtcttccttcccatgagagatagtctataaaattattttatacattttaccaaatcctgcaattcttcaaccttgccgctcatgaacactaaattggagcacaggtgtgtagccacatggcctcatcattgcctatttagaatctgagtgtttctgagtagtaatgttccctgatactctccccattcactactttaaggactattttttcctcaactgctcgtttgcactttctcctcattttgcttgtgaatgtcagtgccattattcacctctattccaccatgatcacctttctccaaagattgcttttttcgtaaataattacctgaagcataaagtcacttgctttcccaaatttaatattcagtgaaccagcattatcacagcaccatgcataatctggagaaccataatagaatgaatatgttagaaaaaattattttgctgaaatataaaaggaaattaaagccacacctggacatctgtgcaccattttagtcacttaagtgtgctataacaatagagaaagcatgactaaatactgctatagggaacctttttaaagatgagtagaactcgatcatgctattaaggaaagggaggtagatatgtaagagataatctcactgaggaggatatacaaattgttaagaaccagtattcccagacaatatcagaagtgatcaaacacaaagtaaaagactctggagaaaggaatattagttttttgttattttattttatagaaattaatgttagaagtatgttttctaaagtaattataagggtaggaaactaaagaataatatgtgcttagctaaactagggtaactaggagtgatagcactatctttctattcagaagaagtgataaaaattcactttctcatacaacttctctatttgtattactctgcttcttagtacaaaacagtaggtcaagaaactttgggaatagtcaaagaataatcaataatctctcgagtccttctgaatacacagcctttcctcaaacttgaacaattttcacttcctgaattacaacttacatgatgaatccaaagtgtattaatagttgaatttgaaacgaatgaattaagctcaggatgtcacttgttgggagacatctaactgctttcaaccatccaccttgaaccccaccctatcacttcctattgctaacagatttcaacctgtctttcaattgaacttccttcatctgtccaatcaattcagttccatttattatttccaataattatttatttccttgaatatctaactttactctctcccaactcaaccacttttcactgcaaaagtaaaatcattaaaattttggccgttttgtcaataaaataagtctacaggtatttgcttataatttgctattcatttgttcacccacctattcattcagcacctgctctgtgtcgggcactgaagtcggcactcagagtggagagatgaggaagctgaggtctcagccctcggctggctctacatcctctagtcctccagtgtgagatgcctttggaattagggtgaggtgtaccatggaagttcacctgcgtacattctcagtgtcacagaggaaatagtgagagactaagataaaacataagcagagctgtggggctggatatgtaatctgtgaagaacaatgccaaatggaaacacaggaccccttgttcaaaattattaataatttcaagacagtgacagaaaggcattaatctaagcacagggccccgaacttgcaagttcgcagatcttgaactacacagctcacacaccaaggaagctagcgctaactaattatatattcatctacagaaataaaagcatgttagcaaacagagggggcaaatcacaacaaagtaaggttttttcatctataaaattagaatatcaaagcctacatcagcagtttattagctttttacacacacacacaaaatatttattttaccccatgagtcatatgttgaaagattttgttcgttgtgttgatgtaatcactaatttatgtttctatttgaattccagccaaagccttctatcatcataagatagataatgttaccaaactatataatttaattccagccaacatcaaagctgacttaccttttagctagttgtaaagtattattggtttgtttgtttcaaatggttgaaagtaacctgaagacaccagtttttacctggatagaaactaatttaggaatctttgattaaatatctccaaattctgtccaagtgctaatctttagtgattctcactagcaagagagaaaagtttgacttttctgcctatacccttggaaaagatgcaagtactatcactttcccaaatgcaatgggaaaataaagctcagtgaaaaccttgagcatgtttctaatatattgttagtttatttgagagttaaagcagtattaatgtgctgtatcttcacatctctcactgcactacccttgtgatccaattagattctaaattgatgtaaatgtctatttttagcatatggccacttctgaatgtttccaagctttaaaatgcacaaatactcaacacaaacatctttggagcatagaggttgcgtagttttccttttccaccattgatctaatatgtaagagcctattgtgcttggagagtgcataagccttcacatggttgagtaatgatttgaacgcaagagagtctccagtgaaaaagacaaaatccagtagttatgaaaaacaaagcttgttttgctaatatgctggtatttggagtcaaaaagacaatgacaaatgttttcagtataactttttaatcctagttaatattaatactaaatacatttgcaaataatattttagagaagaataaaatttattcagctaacataattatttttcaatatttttgaaaactataaaacacagctataaaatgtccttcctcttaaagaaaagctaatttcattcacgctatctcttattggaatattctgcactattgtagaaatattagatcactattattgctattattgtatgggattatttaaatagcttataccaatcacttttctatcttagactttctctaattagtgtgattgacacttataaaatttcttttagacactgaaaagcagttgtttcttttctcttatgcttttcatatggttgcttgctaacctgtagaactcttaaactgacaaaaaagtaacatttttttgtcagtcagatgttcagattttctgcaccagctttagtttggctcattgaaataatagttacctgaagtgatctgactggccaaaatgattaaagcagtttgcatgcatgtacatatatatctgcaaatatgaaatgagcaaacagatgaattgtcattgcacacagacaaccaatcaatacaaactaaatctcttgtattttattcccccaaatactgagtgcctgccaaaagccagactcttttaggcactgatatctccgtcaactgactgagacattctcaggtttcttgatgggagtattttgccattttgaaacaaatattctgacttcactcttcaaatttgagaaaagttctaatcaactgagttttatgtaatacacatttggatttataaattgtaagatgaaattgtatttcactatattttgtcccacagacttaacctatgtttcttacacatccatcctaatataaaaatacagtcacttcacatctgtgtaagtttgtggagataaattcttagtgtgtgggcttgtattttaaaatccaatttcattcactatttagtgagtgcttaccacatgccaggacagttctagagtgcgagagggagacacggtgggacaggattggaataaatgctttctgatgctatgggaaggagtttaactcttatgctacaagtgatgcatatccatcaaaggatcacagcaggaaagggacaggataagatgtgtctttaaaaagaccattcaggaaaatgttgagtgttttagaggacactgtgactagtggcttgctaataaagcagatgggacaataacggtaatcttgacaagaaataagaagggtcttataaaaggcaataatagagacaggaaggggtgtgtatatattcaaaagataggaaggaggcaggatctatagaacttgatggcccactggttatgtaaaatgagaacgagaaggcaaagaagattgccaattgcaatgcttgagtggcccatcagagggacaccgtatactctagttagttagactaacagagttccaagttatacttagagtgtcaaagtagttattaatgaggcccctttatcctcaaaattgtcctggtttagaagataaattttgtggtcccctaatagagaatgatcatgcaatcatagtcattcatgatcacgtttatataatcagaaagatgtggagataagtggatttgtagtaaaggaataacatttagggttctccattctattctattctaagcaaatagttgtgtagctgtggagctcaggagagaaacactggccttgacatccagatttgagcattgttcacattttaaagtcgggtgggaattaaattaaagagcctgtgaaggccaggcacagtggctcacacctgtattcccagcattttggaaggcaaggtgggcagatcacttgaggtcaggagatcgagaccagcctggccaacatggggaaaccctgtctttactaaaaatacaaaaattatctgggcatggtggtgcacacctgtagtcccagctcctcagtaggctgaggcagtagaattgcttgaacctgggagggggaggttgcagtgagccgagattgcatcactgcactccagcctggccaacagagtgagactgtctcaaaaaaaacaaaaaacaaaacaaagagtctgtgaagcataggaaggggaaaatgctggaatggaatgctgagaaacattaactttgaagaggaagaggaatttgaaaaggagatgtgaagttgctgtcagagaccaagagctactgtgtgaaaacccaagtaaatataaatcatggggacaaagagacaagagaaatagaggaaggagaaaatggacaacagtgtcaaaaccaagtgaaatacgaaccaattcacatatcagtgaattaagaaacttggaagtaaatgatggccttggcaagggcaagttcagaggaatgatgggtgtaataaccaaattatggtagatggagagatgcaagcaattatgtgtgaaaggtagcgcagaatcttaagaaaatccttggcttttaagtccaacagactgggtcacatacccacaagctcttactagttgtgaaactttgtgtaagtcatttaatgttaaccttgttatcccttcgttcattcagtacttactcatcaaacatttatagagcacatagtatgtggcaggcatcgagctatgatctagctaaacatgaacaactttattttagggaaaaacacatctttttacagcataatgtgagatgtgctgttacccatgtatgagcagcacattttgctctctgaccatcagcttcattactaataataaacatagctaacatttatcaggttcttcctatatgtcgggcactgcactaaaggctccatattataataattatttcactttatttagcatatcacataaaaacaatatgaaaaacgtactatttttagttccattttgaagataaggaagtcatagagaggtttaagaatgtcacttaaacctctctatgttaaaccacaaaatgtttgaatgtcactaacaagtagaagaatagtgagtagactccaggcagaccagcattttaaattactatactgccttccactgtcaattgccagattgtttcaatttcattgatcatgatatcccctagaaccatttagtttctgatacactatagttcctgaaaaataatacatgtttgtggaagggaagaaaaaaaggaaaaagagagaggtagggaaagagtagggtaaaagggaggaagaaagaaaggagtactgtaagaaacaagagaatggcgtgacaaactttgcctaggagtcagagaatttctatcaagatgatatactcaccgcaacttaaggatttgttgtcatttggtagcccaagaaagaatgaagatattctacattagcttgtaaagacagcactttgtcattaccatctatctctaaggataggtctcacattcacaaatcctctaaaagtaactaatctttgaccacatgaccatgagacaatagtattagtaatgactttctatgttacaccttggcctaaatgaccacaaaccttactgaaaagtctgaacttcctctgatggcccatatcttgccatgcatccaaaatagtaaattctactgactacttcctcagaacatcttgtgggacttcttatctaggtgccatgggttttgctagaaaggaagaacttcgttgccattgcttttggtgttttagtcaaaaagtctttgcccatgcccagatgggatctaattaaactaaagagcttctgcaaagcaaaagaaactatcatcagagtgaacagacaacctacagaatgggataaaatttttgcaatctgtccatctgacaaagggctaatatccagaatctacaagaaacttaaacaaatttacaagaaaaaaacaaccccatcaaaaagtgggcaaaggatatggacgcttctcaaaagaagatatttatgcagccaacaaacatgaaaaaaagctcatcgtcactggtcaataaagaaatgcaaatcaaaaccacaatgagataccatctcatgccagttagaatggtggtcattaaaaagtcaggaaacaaaagatgctggagaggatatggagaaacagggacacttttacactgttggtgggagtgtaaattagttcaaccattgtagaagacagtgtggtgattctgcaaggatttagaaccagaaataccgtttgacccagcaatcccatcactgggtatatacccaaaggattataaatcattctactataaagacacatgcacatgtatgtttattgcagcactagtcacaattgcaaagacttggaaccaacccaaatgcccatcgatgatagacttgataaagaaaatgtggcatatatacaccatggaatactatacagccgtaaaaaaagatgagttcatgtctttgcagggacatggatgaagctggaaaccttattctcagctaactaacacaagaacagaaaaccaaacaccacatgttctcactcataagtgggaattgaacaatgagaacacatggacacagggaggggaacattcacacatcagggcctgccagcagggtgggggtggttgggggctaggggagggatagcattaggaaaaatacctaatgtagatgacaggttgacgggtgcagcaaaccaccatggcatgtgtatacctatgtaacaaacctacacattctgcacatgtatcccagaatttaaaaaaaaaaaaaaaaaaaaaaaaagaagaagaaggacttctaaataaaatgccaccaggaaaactgagcaccgatagacttctttctgcataatctcttctcattctctcatttttaaattttttgcaattgccccaattctggggcaaaaccaaaactcccacatgcctgaaaatgtgcctgaccattcccattgctaaaattctttaactctttgatatttgttgtttttgcctacttatctgtaaattataccaagtgtcatgaaaacaaaacaaaatggcctttaatgttaaaaaagatggtcttaaactcacaaatattaagcaaaatattggaagtacattgtatctgttcatttgtttgaattgtttggaaaaatcatcccatttatttatatattttgtacagacacatctaaaatcagacttttttttctgaacgcattctgtttcctgtgactgtcacctagactgctttggcgtgccttttgaatactgagtagtaatttactgtcatgtgatgtaggagatcagtcagagtgatggagaaactatagggaaaggagcaggccttctgaaaggttggaaggctctgcatagcttcagggagaatagctgaaggcagctgttctctgaccctgaggcagagggcgaggagtatgctgagggaggaggaggcggtaaggtagatgatggttcttcctcccctccctttttaggctcttccgtgtagagcagggccaaagcagccctaactaaggcccataatgttaaagatattactgggacccattgcccttgtacattatgtcttttaagatttcttcccacttgttcccagagctctaggtctagtgtgccttcttctgggaaccatgggttatggaaaaacaacagtttgcattaggtcgcttaattgggcttcagagaccaaggctctgctagctttaagcagctgtttcaatacttttatatactgttgtcccatgatgaatgccctcgaacttggaaatccccagtgggtaccaattacttactgcccactcacttcactttcgttttttgagggttccgtcacaatccattgcagcattcctcacatggggcaccacctgccaggtctgtcccacagaccctggcctacgaatgaaatgagtactcagacacaggtatgcagtgtaagagcagctaggtgattgcctgactctagtggccagagaggagccctgagaagctggagctgcttgcttttattcagtgcaggcacaatgccaaaaacctggagtccatataacctgtaggtaattaacatttatttttccctgttcagggaacatcacgtgcacggatgatcaaaggtcaattcctagtcaacataaataaacaaggctgtttaagataaattcccccacactcccttgtacctactccttctttaagcactcactcattggggcagcgttaagtccagtcctgcactcccagagctggctgctctgagagagaggactgtgggccttccatctgaccgaggaaagccgctggcattgccccagtttggaacaggacatggaggctggcccctcatgaagtttcccgcctgactgcttaggggattgccatttttatcaaattttgacttgcagagatttgcccaatgtttcccctttttacattgggggcatataaaagggggttcttttcctgagtgactttggtctttactattggggcattcctgcttcacatgacctggctctcagcatagaaaacaatttgggtttttctcccatttcactttaggaggctttaatgccacagccaatatctggctttgtgtgtttcagtctccactagctgacatgctcctataagttccccgactgtagctgcctttcctctgattgcctgcattgccttcagctattctcccccgaagctatgcagagccttctggcctttcagaaggcctgctcctttccctatagtttctctcacctctctcactgatctcctacaattgtaaagcctggaatgtacagccttttagggaatatacacttcatatggcctgtttttgacaacccaaatgtggtcaccaagaaagaactccgctgggcgcggtggctcacgcctgtaatcccagcactttgggaggccaaggcgggtggatcacgaggtcagaagatggagacaatcctggctaacacagtgaaaccccgtctctactaaaaatacaaaaaattagccaggtgtggtggtgggcgcctctagtcccagctactggggaggctgaggcaggagaatggcgtgaacccgggaggcagagcttgcagtgagccgagatcacagcactgcactccagcctgggcgacagagcaagactccgtctcaaaaaaaaaaaaaaaaaaaagaaaagaaagaattcaagttccaagtagaagttactctgaaaggcaacccactgactgactggtcacatctcctaagaagacaaaagtaaaattggtaagttcactctagtctctattccccaatcgtactttatttcagtctgtgttccaaaatactaaattcttaattattttcttgatttggtgtaacactacatacgatgtagtctggtcccagaatgcttcttcactgaacaatacaaaatccatgcagattgaacagaggaaggactagcgttaattggaagaaacttttgctgacttttactgcagattgaattttgtcctcccaaacacctggcaaaggtaatgtctccgtttcactaagtactccttaatttggaattacaaagacgattagctctctaatgagttacagcaagtgaggtgaaagagtaggggaaaaaaactgaacaccagatgattctttttaatgccaagaaaaaaaaggctttttcttggttaaaaatcttttaaataaatttctctcctctttcattttacaaaactaaaatatataaatattattgcttagtatgtatgggaaaaatctgatttcatagaacattacatgtaaagattggctgtcatgagtacataggtctctactctgtattattgattgagtatatcagtaaatttacctttagaaacttatgaatctgctggggtacctaacaaattaggaagatgggaaaaatagttcctagctttagaaaaaacagttcattatgaaagaaacctctacaagattcaaaatgggtaggcattgtaaagatgagatataaagggtaattctcaggttatttatgggagtggaaaagtaaaggtgcataaattcaaggtgagcaaaaagtagtggagaaaaggtctgcttgtatctttgctgcaaatgtagaatcaaggtctttggattaccagaacatttagcactgggtttagtctattgctgatacttacttagtaaatattagttgaatttcagtagtttaattaaaaaatgactcaaaatttttaaaatgcctgataatctgtttacccaaccaatcagtatagcattagaaaaataacccaggatgggattttattctcactctggcactaactaaataatcaggcaagtcatcctacctcttttggacttaatctcctcacttgtcaaaaaaaaaaaaaaaaaaaaaaggagaaagaagaaggagaaggcgaaagagaagagggaaaaggaggagaagcagaagcagcagcagcaggaggaggagaagggggaagaggaggagggggtagaagaggaggaggaggagggggaagaagaggaggaggaagaaagaggagaggaaaaagaagaagaagaagaggggaaaataatatttaattttctggtttacataaaagaatgaaatgaggttacaaacagtaaattggtttttggtaactggtagatattgttgatattctcaaatctaggaagaatttccatgtcccttatctttaagattaaatagctgaaccattgttctttatggtattcataggagggaaatagtctatatttctccaataggtgatctaagctcattatctattgacagaaatatccaataatattctgattgttgtgtccatcttatttaattacaatttgataatacattctaatggtgatagagtacattttgactacctctccttcctcaggcatttgaatactgaacatgtctcagattggcacgttgataggcttggcataattgggttctctgtcagtttgctgtcattaggatgagctgtgaatcaccattagggccatctcagtatattcagttaactgagctgatgaaatcttgcattcgtttcctgaagttggttgcacatattaacatctatttatattattaaatattccattgtgttgacatccatccttgagcaaaattgtaatggatatcttagtttacagaaggacttttcatgtgtgaagtaaacactgaagagcttcaagtgtagttaaacaaaatcaccaagaagatataattgagtaaaaagaaagttaaatatataaattatatttcattctagataatatgtgtagaccacgtcatatttagaggtcatagttcaagggtactgctttcatatcagtgataatcatcactatatgcctatgtaatagtcatcaggtttatatcacataaaataagaaataaatatttattataaaatggagctaaatcacagtattcaatatttataaaatgtaaatatgcattctgttaatgtttacataggactttgccataccttcagttgacagtaaagcaatgcaaaaattataataaagagtagaaagcctttcaaaacaccaccaatgacactaaaagatttgaaaataattgcaaagtagaataatcaaataaaatagtcagattttttaaacaataaaaccgaatagtgtgaatgactttcaagttattctagaattgtctttaactgtaaaacattctaggacaaacatacaaaatctcaagaaaaggaaatattttgcaagttacatagggtaattatactgaagtgtcagcattctcatttgtcagcactctgatttggttaatttaaatgttcattaatcacaaaaaaagaatggcataaaacaagcctgcttgaattatatgttttgctcaagaggttattgattcatataattatttctttcatactaactcaagaaatagaactgttattagtaaacttcatttgaaatacttaatcactgttgcaaagatgttttatcacctgatctgtatgaatcagtaaatcaaagctcacatatttgtttcaaaacttcagctcacagatgttaagtcaagataataagcagcatcaatcatacctcactgaacaagatagtctgcattacagacactctccctgtaatccatccattatatggaacatctgttacaaattatcaacaccccgccccacaccccccgacccccgccagggactgctctatttaagtgcttctgcaataacccactgtctccatttctccaaatgagttagatggtggcatcgggatagtaccaagttcactgtcaccgtatgacagcagtcatctttcagtctgtgctgaactccaatggcacactgcataatggtaaatgttcttcctacagttgtatagcagaaatcctcagagcataagctagtagccatcaggaaaccactgacagttctttctccactatatatcagtcattgcctaagttaagcacttagtgtgtaatattcattgtttttcaagtccttaggagaatattgatttgctcatttagttaaatataaaattaatgagcccagatacatgtttgtcaactttggcttatttccatgatcatgaaacatgtcttgtagaacatgttggtttccagaaaaatcatgagaatctaaataaataaagcaagtacaaatttatactgcagaagaagaatattttttaaagtgccctagagtttacccatatattgtcaaggttgcacctgtcttaaagagaatgactttataaatgtgttgtcctagtgtgtcattggaaataacaatttcaaatttactctgtgataggtttgtgaaaataagttacaaggatatctattaatcattaataagtgaatagtgagactgaacaaatgtaaaagtccatatagccacactttattttcttgatgttagtctgcattgcagaattctaatgacacatacacagtaaacccaatattggatttatagaaaactttgtacaaacatggtactttccatattttagcacctcatatggtattttcctacaggatttcattagctcatctgttcttagtgtttatgcaatagtagtttaataaataaatttcaggatagcatctaggttgcgtgaagttttaaataaacaagttacctatttgtaattattcgtaccagtttgtaaaaatacatcctaaaatatctgttttccatttcaggatcaccttcgatggatggacagcattacttttatagtggactatataaagtgtctacaagtgtctacaacttcaactcatgtaaaactacattaaatatttatgcctactttactgcctggaaatcttgattaatttacctttcacctgaagtttgtgataactgaccaggaagtgtttgtttttataaaaaggaaaaaacattattaaataaacttttaaacatagtgctctagggagtcttacgttggcaattaaaagcttcagccaaaaatgacacaagtccttttggctcacaactcactagtctgaacctattacagagctacatacaaaatgaaggcatcagagttcaagtcttcaaacgacaatcacatattcacaaattatacttatcaggatcaatgtcattaaatttctttgtataaggcttgtgtggggaaaggatggtttaatttttgcttttgcttacaatgcaaatggaaaaataatcatgctctaagtaagaccgcaagagaccagcatgcaaaggatcctcagaaactatcactgtcattgaaaccatgctgacagaatctactgaaaaagtaactgcctgaagcatcacaatttacatttgttacaaaaccttactgctaagaaaaaatactcatatgtttttaatgatttagattttccccaaaacagtcctacagcctttgagagctttcatcaaatgtttgccttatcgtttcaatggcttctttctttggacttctctcatatgctatccagtggcttctgattcacactcaaaataaaatccaagttccttgctattgccttctaatccctgtataaactggcacttgctaatctttctgacattatcacctccactctcctcttgctttgctatgctccaattgccatactcattaacacttacaaattttgccattgctgttctctgcctggaaaactcttgcccatattgtttatgtggctggctggctccttcttatttatttctcaactccctatcaaatgttgcctacctcttccccatccaattttcaccacttttttttcttcattgcgtttgttactatctgaaattatctttcacttgtttattgactttcttctctttaaaagtcataagcagtcaccttccctatcttgtttactaccttaacctgagaaaagtggtttaattggctcacagttccacaggctgtacaggaagtatggctgaggaggcctcaggaaacttacaatcatggtggaatgcaaaagggaagcaggcacatcttacatggccagagcaggagtaagagagtgatggcggtgctgctacacacttgtaaacaaccagatctcaggagaactcaccaccacgacagcaccaagggggatggtgttaaaccatgagaaattgcctgcatgatccagtcacctcctaccagaccctacgtccaacaatagggattacaatttgacatgagatttgggtgaggacacagatctaaaccagattaactatacaaatgaatgaatatgtaaccccttttccccaaagagactaattacatttttaaaaatcagacaaaggaggaaacatggaaagaacatggagcagtcattgaataaacaataatcataggcatttaatattaaatgtattgtcatgtctgataacttgtcaataagacagaccagcagataccgcgaaataaaagggtaagatacctgagaatggtgtggtaggagagggtttttaggaattccctttgaagcttggcacttccacctctgtaatccttcagaattttctcacgctgcatcctactttccacctcaccctgttctttgtagtgtgcacgtgcgtgtgcacacacagacacacacatatacactcactcccacaagaaacatgatccaaatattaaaaattaaatgcagatagcaaagaacgattcagatgctgaattctggctacagggagtgtatagcaaagaaattagaaaatctaaaccaaaggcttcagtgttcactgacattttatgtgcaagaggggagttgctatactatcagttgatacatcaaccagctgaagaccttaaaatcttgcccaatttgcagctacagtggccctaacttgtggcctagaagccctgccatgtataccttgatctccaccttgggacaggaaacctctgacaacagcttctttaatctacttcatcaggtgctgcttctcatttatggagccttgccctgagtgtcacatagattccatttaatttgtgtggtcaccagctacacctaattaaattcctacctgaaactgctgacttccatgatacctctcatgccaacttttaaactcaattacttctgtttctgcacatgagcaaaccataaggcataaagaatcaaatgaaacagcactgactcagcaccaataaaattgtgtttttcacttcatatagattttgatttctgttcatcaatatctcagttcatgactgattccccatcatgtagtcatcacaatgattcctgaccttttgaaccctcttcagtctccaaattagcatcttctcacccctgtacttcagtatgatcagaatgtatttcaataaaaattaattttattaaattgaaaataaaacttctgagatcctcctccagactctccctttattctgccaatattcttccaatttatccaagtatgaaattttggaataatgtttcattctcattatttacttttcctttattaagcctaatgtctcagtccacctccagttcaaaaaaaaatgtactggtttccactatctacataattaagtaccaactcattgctgtggtgtttaaggtcttcccttaaccaactttcctacacctttatggactcttggttctctgatcaaacttaagccatcagcttctcctctcttcaaaatgccttagatttttcagtcttttggaatatttgtttacttattccctttttctaccaacaaaatagtcatctttttcctctttaactgctagcccagagcaactgttttcttggaatcctcactgaaaaactcatccctccagcctcaatatctaacaaactttttgagtccaagagatatggagtgaattcctaagtcacttagctggaaaatggcaaggcctgaatgaaaacctatgtttcatggtagctactcagccttcatctttcaaaaccttcaagtttaactttttatttctatcttcacatgatagttcctacaatccttttaggccttttttaaaatgaaggtagcagtggggagcacacaaaatattcagtcatgatttgtgaaatggggatgtttttgctctaaaattctttttctggtttccaatactttgttgaactttgtggtcataggaatatattgctataataggatatctgtaatatgtcccaagtgtctatctaaaagtgataatttcattatcctattggaaaattttcaatcatttaagaaattttactgcatattttgtttacctatctggctgtttgtttcggctagcttttctgtcagttttcccagttgatttgtcacttttaaattctaatggatttatctggaataattagataattggagatctttctttcaggttacttatgctaatataaccagtcttagcaaatataagaaattaccacttttaatcctttatcaactaaaggatttctcagttatcctttatatcttagaatgtgtccacttgtagataatataaagcctaactcaaattgacttaaacaataaagaaatccactgattttcatgacaggaagttaagcaggtgtttgattaatctagtggctcaactttttatgcaagggcccacaggtttgttttgtctctccactccatcatctacaattttggccctacactaaggctggtttccactgtaatcacagattgacttccaggaataacagaggctaaatctttcttgttcacatacaacaggagaaggagctagtgtatttctcccaaacttcatacaaacttgcatcgaaccatctggttataccattttagagaatgtgcttactcctgaacaagtctctgtcacaagaagattgccgtgatctgattggcttaggcctagcttcctgaaccaatccttagcaggggcacatgagattggcaggactgatataggctaatcaaggccattcatataatgaggaggaggcagaggggttaagtccttataccacactgagacaagtagagtgaatattagggagtcaaccacaaagtctactttatctttagcaagcagaggtagaaaagctacctcgaaattcattttcaatcaataaaaatattatttgcccctgctcataatttttaatcttctgaaatctacatgtcctgtctgtgctgaactatgtaaagcagttttatgtagtaatgaaaatcatggagttaaagctcatattcatatgcaaataagaatcagaataaaaccccggagccacttaaggaatgttgtttgacattaccttaggtgagttatctgaactttctgaggctttgcttttcatttttggaaaaggggtatcagtaccaaattaactataaaaattagaaaatatataacacttagcacaatgccttctacttgatagatgagcattaagtcattattatttcagtattttcccccattccattataagctccccagatggtagagattattgaatattccaatgatagtacattttttcatttttgaatgtttcacatattttctattttgctaaaatcaaatgtgatacatgcgttcttgttttcattgatttaaaaaaagggagcagtttgagattgatattgtcaaagttacagactagtgagaggcccagtcagtgctaaaatagtatttgtcatttagaaagtactttgtacatacatcaccctatgtatttttcacaataatgatataaggttgacattatcattctctttataaaatgcaaggaaactgagacttaatgaggttcagaaattttcttaaaccttttgcatgaaatagtactgaaataaaattattctgactctttgtccaaatctcttttctttagatcattttttcttgaaatatagagtacataaacattttctaggcatcttgtacaaaatacaaatcctggggctctagtcatagaagttgaaattcagtagctcttgggtacagctcataaaatttacattctttttttaaaacataccagaaattctgttgctcatcacagtttgaaagttactaagagtctattcatttttgtttaggaaaacagcatagaaaggtggatatctaattagtaacatttaacaaatttgagaaagcagcataatataatcctatttttaacataaatttagagtcttctttcagaataatgctgtaattttgtaaagatgtattactttttctcagattttgattggccaaaagtaaaaacatgtataaaaattaagtcaacgactacactaatctgttaagctaataaaaattattaattcaatgacttattataaatctatttcataacatactacgtgccatgcactgtcccctaggacctgagaatacaatagtgagaaaaaaatacaagcacaattctagccttcttgtacctaaaatctaaagaggaaagccaccactagtaaaacagtcacacaaataaatagaaagttttcactgtgatttcaactactgtatgaatgagagggacatggtactatgaatgtatgcaatacaggaattttacttaggcaaggcagtcagagaagtctgctccaagtgaaccctgagcatagattcaaaatgtgaagcctaaataggtgttaaataggcaaagtaaggagggacaggagtttcatgccgaggaatcaggttatgtaggtgatagattagatacaggaatgggcagaaggatagataatgatgatggtaacagatgaatagacagataataaaagttgagctcgatcaaattaattgaaagcaaaattgcttttggaaaaaaaggaaagtataactgtttgtttctcatttccattcttgactacccctggtataaagggttggttactctcatgagactgaaaacagtaggaagaggtcacttagattagattagtaaatagcaaacaaatgtaagaaagccctctaggcttcatgagtaacgtaatggtggtcagaaagtatctgaggagaaggtaaagaaggaatgacccaatcccacgtgaagttgaactctgccagcccgggatgtcaagagtatatcaggagacatcatcttgtataaaaataaatattctatcaataataccatacttcctaaataagggtataccataattcttcataactttattataaaggtgaatacatcagctttgcaggtattaatagctaatgtactatgaaaagtctagtcacattattaaatattattttttattgaaatattttttcatgactatttctacatatccttttccattgagtcaacacaaactggtcctttgtactggatggttcattgtagatgagtaaaccgcatgataaaaataagaattagtcaccatggcctgagtttttcaatttatctctctgcattaatctaatcttccagacagtagctaaacctccttttcacttggtattaggatgtgtttaggacattgcttccatgattgattgccatgcctgcttcccttttctccagagcatattcctgcatgtgtttggaagtgtctgtcctcaaacagtatttatagggttaaaaataaaacaactggataacgagcatatttgggatcaaaattctcactttaattttaaatgatttaaaacaaagacctgtttaatgttttgaataccagcaaatttcacttttcatttaaaactactatatagcagaaacaacaggggtcaggtagggtggctcgtgcctgtaatcccagcactttgagaggccaagtttgggactgcttgaggccaggagtttgagaccacactggttaacatagagagaccccatctctataaaaaaattaaaaaattagctgggcatggtggcatgcgcctgtgtctctagctactcaggtggctgaggcaggaggatcgcttgagtccaggaggtcaaagcaagagtgagctaggatcatgccactgcactccaacctgggcaacagaatgagaccatgtctctaaaaaaagaaaaagaaaaacaaaaaagcaggaaagtccttaaaatcaaataaaaatgaaaacaaacaatagacgtataaagcaaacagtaatgtataacaataggtgtatttgttgaatcagcaagtctcagaatttcacagaaaatatgatgttatctatgtgagaaaaagccagaaaagttgcttggcacggagaattcatcttagcattgtgcagaggctctaagaagcactcctcatgaaggactgaacaatcacaccataaggactctacagcctggcaccactagttgctgtctacaaggagaatgagcaataatttcacaagaagtcaatacacaactttctgtttgttagcacatgaatttatcataattggacaaatttgacccgttatcaagactaaagcctgttcttgcttcaatgattttaccttcaaagcaagaagactctttttgcctctgtttctgagggaggaattttccactttcaagtactacttcctcatctgaaaaataatatggtcaaactagatgactccaattaatttaaaaattctatgactctgtaacactgctaaattagtatatgaaattgtaggtctttatttcatattaccagtattatagtaagagctttaaagattccaaggagatatatatatatgtacacatatacattttattcacttttcagctttaaaagacaattgcttctcgaaggaagattttctaactgaacattaaatcaacagaaagagttgatctggtatcagtctgcaatgctggggaaccctttattgaggctagattgaatccatgagaacatggcttctgctcagggcttttgatttgtcatttgctcagcagtcctccccatgaagaaatgaacacactgtgcccatttttcaaaattgactatttccaaatacagtatttaatttagtgatcctttataatagcattgtccctgaggaggaaaaaacagttgtcagattactggccatttgacactgaatcattataaccaagtataaaatttaatgagatttctactgaatgagtggcatttgtgtatcatctggactgtcacacatttgtcatcactgagacgtttgcttattaatctatcttcaatgatgccttatgtaaattagctgaaaaagccttttaggagaacctttcctccctgatttattttaaaaagtcaaaaaatagcaaaagtagaatcattaacaggccttaaaaaacaaagatactgactatatcaataggttgatgtaattcactcctaaatatatacaagaagcttatgccaggcagcattcagtatatgatgtataaaaatattttttcagaaataaagtatcgataagccaattctaatattataacagtaaatcttgttttcacctttttatggttaaaatttaatgtctcttagaaggtaaatcacgctgccaattattcagaatatctgtacgttaatatgttcataaaagtatttcagatttaccatcatttagaaaagttagctgtccagaggctataacgctctcagtttctaataaggatcatccttattattaaatcatatgaaaggattattttcttcattcatggagcttgtctgtcatttttattaccactctaaacttggatgaaaaaaaaccctgttaacccaaatatagtttgatttaacaaaaatgaaacttaaatcgcatctccgtctaatataattatattttaaaacattcttttacttgttaattgttatacaacattccacactcaaaatataactcctctatcctttcttcctttatttatttttccttctttttttccctttcttcatctttccttctacaaatatttattgagggtctaattgtatgtcaagtaccatgttggacgttcagataagtggaagttacagaaaaataaataggcagtttaatggctgcctaatatttcattataagaatttagaatttaaacattacgtgattattgggcaatttgttgtttacaatggtttataattataaataattacacagccacaatcagtaccttggttatataaatctttgtccctctcactaattattttctaagaaccatatttgggcaaatagacaaatatcaaaaagaataaagaggatttattatgttgtaaattatatcttttgttccagctgaaagtttaaaaattatttaattattacctattatgaaagcaatatacccttctttaagatggctaatttaaacattttcatagaactttaatactcagagaggcaaattattttatttaaattaacaaagagttgtcttccacagtgtctcccactgagccttgcacataggcggttgttaaatgctctttgaagagatgaataaatagaatggagggaatgaaacagaataaatgtaacaacatagaagagcttaataaatgagtttgttggcaattattcctatatggacacgttagctaaatttcaagtctttttcataatatttgagggtcctcctgacagagtttcatactgatgaaaacactctttaggcaagttccagttagccattgctgccccaaaacttattagcttaaaacatcaatctgttattttctgtcatgattttagcagctgacaggccaggcaattcttgctcgattttctcatgtagatgctggctgaagctggagtcatctgaaagcttcttttgtttatttttttaattcacaaataataattgtatgtatcccaggatgtacatagtgatgctttggtacatatactgtacagtgatcagatcaaggtaattagcatattcatcatcttaaacatttatcttttctttgtgttgggaacattcaatatcctcattcttgctatttaaaactatggatattgttaactatagtcatcctacagtggtctatagccctagaacttattccttctgtctagctgtacttttgtatcctttaacaaatctctccctatgctattctccccctttcccttcccagcttctaatgtcctctgtcctttctacttctatgagatccttttttttagctttcacatataagtgagaacatgtggtgtttaactttctcttcctggcttatttcacttaacataatgtcctccatttccatccatgttgccacaaatgacagaattacattctttttatggctgaatagtattccatggtgtatatatatcacattttctttatccattcatctgttgttggactcctaggttgattccatatcttggctattgtgaataatgctgcaataaacataagggtaaagaagtctctgatatactgacttccttttctttggatacatgcataatagtggaattgcgggatcacatggcagttctctttgtagttttttgaggatcctctgtactgttctccatagtggctatactagtttacgttcccaccaatagtgtgtaagacttcctttttctccacattctcaccaacaatcgttatttttgtcctgctgatgatagccgtcctaactggggtgagatgatacctcatggtggttttgatttgcatttccctgattatcagtgatgctgaccatttctttcatatatttgtggtcatttgtgtgtcttcttttgataaatgtcttttcagatgtgactgttttttaatagcgttgtttgtctatttgctgttgaaatgtttgagttcctcatatatgctgcacattaatcccctttcacgtgaatagtctgcaaatattttcttccattctgcgagttgtcctttcattctgttgattatttcttttgctgtgaggagctttttagtttggtataatcctatttgtttatttttgcttttgttgcctgtgcttttgagatcttattcataaaatcttttccaaaaccaaggtcctgaagcacttcctctatatttttttctagtagttttattgtttctggtcttatagttagctctttgatacattttgaattgatttttgtatgaggtgaggggtgagaagtctagtttcattcatctgcatgtgaacatccaatttttccagaaccatttattgaaaagactgttctttccctaatgaggtctgatctgaaggcctcttcactgacatgtctggtgcctggacttggatggctagaatagctggatgcaagttggatctctctctccacagacctctctaaatagctaatttggacttcttcacagaatggcaatttccatgtaattggactgacaactgtcttttcctataaaaagcattccaggaaacctgtggtaaagatgcaaagcttaacctcaactcaaaattcacacacagtcatttctaccattgtctactgagtcaaacagtcacaggccagctcagatttaaggaggtgaaaaaattgactccaccgttcaatggcagaatggcttgcatgttcagggagtaaaggaagtgatagtggccaccttacacacaggcagacacaaagtgattaatgctttcttcaaatgccatctctatctctacaacataaagtgtggctgtatgtgttccctaacacatactttttctctttctttcttcagttgaagatactttctaaattaacagtgaaaacagtaaaggtctctgtactccttgcttccttccacaaattaggatttacaatcacatccaaatttaaatctcagctgtgctgttccctagcagagtgatttgagcaaataacttctcattagaatgaactctctgatacccagtgcctaccataaaacttaacatataataaggttattgactaaataatttattattatttattaactaagtaatctctttgagattctattacctcctctatgaaatggggataacaatgcccacctcccagtgacgaagaagtaaatgaacaatttaatgtttgcaaacacttagtaagcaccttaatacagtacaatacagtgagattatcacagctattagtattattatagttaatattcttctcactattaaatcattataatgtattgtagatgctcctctacattcctgtcaccacagtctaaaaacttgttagacatcttcttcaacacctggatctcatttattttctttaccttatccttagtcgctattttagtggcttcaacattgatattgggtgatgcaatagacatattttttcataaatcctagaccttataaaccctgtaataatattctcaactttgctttagataaacaaaaaccaacttcttactcaaaaccaccctacctctaaaatcacaaatctgtcaattttctcttgcaacacaattcctactcttatattttcctcccataacaatccagtctccttgactccttttttttattctagtctgtcagccccattctggcttcctctgacttgactccatggttacccacagcattgtcatatttgatgataaacaatatcagaattacaaactcccaagcctgaatggaccctactgactgctttcctggtcttggtcctgactttcctatctttactgaattggtcagtttcacttcaaaatgataccgtctaaccaaatttgaactctagtactattctagaatatttgtattttctcttcattgcaccctttcacttttatcatgtgctattccaaaactttcctgttatatcctccagcccccaatctaatttcccgcaatcaccctaactcttgtagacagtattatattcttaagtttaaaaaatgagtaccttccaaaatgagttctctcaacgtttccccttaccatctcgaaaactttaattattttgcttccttcatttatcttagaggaaaaaattgtcatttcttctcaaggttgccctctagacctttgcccacgattccaactttcggtcaccttcctgatagaatagtctctatcttctatatctttagtctcttgcatctgctggtggttcttctcaggtaacaacgacaacaaaaaaagttcgttccttattttctaaaaatgtcatttgccccaatgaggcttttaaactttttctccatcttactgaagctgtattgttgatactctctattcaaaggtcttcaccaactcctccatctgttcagcatgcaaccatttcttagggtttagctcatgtctcttaatcaacaaatccagagagcatttgtacataaagaccaactcagaaaatacttaaaatacttaagtttttgaaattcaaaataaaacattattgtgactttaattgtccatactatggaatggaagaactggcattgctttgtagccactaaaatataaatacctgtgcatttttaaaatactattcaaaatcaccactagaaataaaaacacaatggcacatttctcctcaaatctggttataattcgttcttaaagatgaagtccatatgcacacagattagtcaataatattctataccattctttcataatcaaaagggaattaatcctcctttattcactacctccccactcctaccaaggaaaaaaggaagctaatcatagatcacagtctcctttgaactccctacagaactttatgtatgtctcaggtctggcatatgtccttaccttgtctatactatcattatttcagaaccttttgcacctcccctgttagagtctaagctatgtgtacttgatagtacacatcatagggcttgtacattgtatgttctctgaacatgaacattagctctagccacttgtagtattttagtaaggatgagattttttttttgtctctgtagcactgcctatcattttctgttgctgcctctgtaaactgattgatttcagcagctgcatttgatactggcattcacatctttgtgtttgtttctcattattttttctttttctataaaatataatgctaattggtaactgcctctgggcacaaagtagcagaaagaaatcaaatctacaattaagtttcccccagaaatcctagactccaacttgcatccatgactttttgttgtcaattttaattactaaattcatatttcattaaggtgattacatagttggatgtgctacatattggaaatataatttctcatggctcctgataataatttgtgcttaactttatccattgcctttgacctataggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacaggtaagaggcactaaagcaacatcagatataaccagagtggccttctatctcataagctatatttggctaaggtcttactatgatttttttggattctgaaatctctttgttatttcttacaatattgacaattctttgcttctttttatgaacctgagaagagcaaggtaccttgctttcctcttttcagttcccaaagaggaactatatcatgttggcttatttgtttgttgaaataaccttaaactcacatataagttgcaaaaatagtacagagttcctgtggacccactccccagcttcctgccatgataaaatcttacataaccatagtacaattaccaaatcaggagatgatgttggtgaattgatgttaactaagattcagaccttattaggatctcactagttttgatatgcaattgttttagtgtgtacttatatgagattctatgaaattttattatgtagactcaagtaaccatcaagacaatcaggatatagatcagtttcattagctcagttccttttgctactcctttctagtcatacatctcttttatttataaaaagaaaatctattcagctggcaagatggctgaataggaatagctctggtctgcagttcccaatgagatcaacgcagaaggtgggtgatttctgcatttccaattgaggtactaagctcatctcattgggactggttagacagtgggtgcagcccatggagggcaagctgaagcagcatggggcattgcctcacccaggaagcatagggggtcggagaattccctcccctagccaagggaagctgtgagagactgtgtcatgaggaacagtgcacaccagcccagatactacacttttctcagagtcttcacaacccacagaccaggagattccctcaggtgcctatggcaccagggccctgggtttcaagcagaaaactgggaagccatttgggcagacatccagctagctgcaggagtgttttttcataccctagctgtgcctggaatgccagtgagacagaaccattcactcccctagaaagggggctgaagccagagagccaagtggtctagctcagcagatcccacccccatggagcccagcaagctataagattcacgaaattctcaacagtctgaagttgacctgggatgcttgagcttggtcaggggaggggtgtccaccattactgaggattgagtcggtggtttacccttatagtgtaaacaaagccacctggaagtctgcaatgggcagagcccaccgcagctcagcaaagctgctgtagccagactgcctctctagattcttcctctctgggcagggcatctctgaaagaaagacaacagccccagtcaggagcttatagataaaactcccatctccctgggacagagcaccagggggaaggggcagctgtgggcacagcttcatcagacttaaacgttcccgcctgccagctctgaagagagcagcagatctcccagcgcagcgctcaagccctgctaagggacagactgcctcctcaagtgggtccctgacccccatgcctcctgactgggacacaactcccagcagggagttgtcaccgacacctcataaaggagagctctggctggcatctggtgggtgcacctatgggactaagcttcaaggaggaaacaggcagcaatctttgctgtcctgcaccctctgctggtgatacccaggcaaaatgggtctgaagtggacctccagcaaactccagcagacctgcagcagagggacctgactattagaaggaaaactaacaaacagaaaggaatagcatcaacattaacaaaaagaatgtccacacagaaaccccatccaaaggtcaccaacatcgaagaccaaagatagataaatccacaaagatgaggaaaaaacagcacaaaaaggctgaaaattccaaaaaccagaacacctcttctcctccaaaggatcacaactcctcgccagcaagggaacaaaactggacggagaatgaatatgatgaattgacagaagcaggcatcagaaggtgggtaataactcctccaagctaaaggagcatgttctaacccaatgcaaggaagctaagaaccttgaaaaaaggttagatgaattactaactaaaataaccagtttagagaagaacataaatgacctgatggaactgaaaaacacagcacgaggactttgtgaagcatacagaagtatcaatagccaaatcaatcaagctgaagaaaggatatcagaaattgaagatcaacttaatgaaataaagtgtgaagacaagattagagaaaaaagaatgaaaaggaacaaacaaagcctccagcaaatatggcactatgtgaaaagaccaaatatacgtttgactggtgtacctgaaagtgacagggagatgggaaccaagttgtaaaacactcttagggatattatccaggagaacttccccaacctaggaagacaggccaacattcaaattcaggaaatagagagaacaccacaaagatactcctcaagaagagaaaccccaagacacataatcatcagattcaccaaggttgaaatgaaggaaaaaatgttatgggcagccagagagaaatgtcaggttacccacaaagggaagcccatcagactaacagtggatctctcagcagaaactctacaagccagaagagagtgggggccaacattcaacattcaacattcttaaagacaagaattttcaacccagaatttcatatccagccaaactaagctttataagcaaaggagaagtaaaatcctttacagataagcaaatgctgagagatgttgtcaccaccaggcctgccttacaagagatcctgaaggaagcactcaatatggaaaggaaaaaacccatacagcctctgcaaaaacataccaaattgtaaagaccatcaacactatgaagaagctgcatcaactgacaggcaaaataaccagctagcatcataataacaggatcaaatttacacataacaatattaaccttaaatataaatgggctaaatgccccagttaaaagacacagactggcaaattggataaagagtcaagacccatcagtgtgctgtattcaggagacccatctcacttgcaaagtcacacataggctcaaaataaagggatggagaaagatttaccaagcaaatgaagagcaaaaaaaagcaggggttgcaatcctagtctctgataagacagactttaaaccaacaaagatcaaaaaagacaaagaagggtattacataatggtaaagggatcaatgcaaaaagaagagctaactatcctaaatatatatgcacccaatacaggagcacccatattcataaagcaagtccttagagatctacaaagagacttagactcccacacaataatagtgggagactttaacaccccactatcaatattggacaaaggaacaagacagagaattaacaaggatattcaggacttaaactcagctctggaccaagcagacctaataaacatctacagaactctccaccccaaatcaacaaatgtacatttttctcagcatcacatcacacttattctaaaactgaccacataattggaagtaaaacgctcctcaacaaatgcaaaataatggaagtaataacaaacagtctctcacaccacagtgcaatcaaactagaactcaggattgagaaactcactcgaaaccacacaactacatggaaactgaaaaacctgctcctgaatgactactgggtaaataatgaaattaaggcagaaataaataagttctttgaaatcaatgagaacaaagagacaacatactagaacctctgggacacatttaaagcagtgtttagaaggaaatttatagcactaaatgcccaccggagaaagcgggaaagatctaaattcaacaccataaaatcacaattaaaagaactagagaagtcagagcaaacaaattcaaaagctagcagaagacaagaaataactaagaccacaatagaaatgaaggagatagagaaacaaaaacccttcaaaaaatcaatgaatccaggagctggtgttttgaaaagattaacaaaatagataaaccactagccagactaataaagaagaaaagagagaagaatcaaatagacacaataaaaaatgataaaggggatatcactactgatcccacagaaatacaaactaccaccagagaatactgtaaacacctctttgcaaataaactagaaaatctagaagaaatggataaactccaggacatctataccctcccaagaataaaccaagaagaatttgaatccctgaataaaccaataacaagttctgaaactgaggaagtaattaatagcctaccaaccaaaagaagcccaggaccagacagattcacagccgaattctaccagaggtacaaagaggagatggtaccattccttctgaaactattccaaacattagagaaagagggactcctccctaactcattttaagaggccaacatcatcctgataccaaaacctgacagaggcacaacaaaaaaagaaaatttcaggccaatatccctggtgaatatcactgggagaatcctcaataaaatactggcaattcaaatccagcagcacatcaaaaagcttatccaaaatgatcaagtcagcttcatccctgggattcaaggctggttcaacatatgcagatcaataaacataatccatcacataaacagaatcaatgacaaaaaccacatgattatctcaatatatgcagaaaaggagtttaataaaattcaacaacgcttcatgctaaaaactctcaatgaaataggtactgatggaacatatctcaaaatagtaagagttatttaggataaacacacagctaatatcatactaaatgggcaaaaactggaagcatcccctttgaaaactggcacaagacaaggatgccctccatcaccatttctattaaaaatagtatcggaagttttggccagggcaatcaggcaagagaaagaaataaatggtattcaaataggaagagaggaagtaaaattgtctctgtttgcacatgacatgactgtatatttagaaaaccccattgtctcagcccaaaacctccttaagctgataagcaacttcagcaaagtttcaggatacaaaaatcaatgggcaaaaattacaagcattcatatataccaataatagacaaacagagagccaaatcatgagtgaactcccattcacaattgccacaaacagaataaaatacctaggaatagaacttacaagggatgtgaaggacctcctcaaagagaactacaaactactgctccaggaaataagagaggacacaaacaaatggaaaaacattccatgctcttggataggaagaatcaatatcatgaaaactgccatactgcccaaagtaattaatagattcaatgctctcctcatcaagctgtcattgactttcttcacagaattataaaaaactactttaaatttcatgtggaaccaaaaaagagcccgcatagccaagacaatcctaagcaaaaagaacaaacctggaggcatcacgctacctgaactcaaattctactataaggctacagtaaccaaaacagcatggtactggtaccaaaacagagataccgaccaatggagcagaacagagacctcagaaataacaccacacatgtaaaaccatctgatctttgacaaacctgacaaaaacaagaaatggggaaaggattccctatttaataaatggtattgggaaaactgactagctatatgcagaaaacagcaactggaccccttccttacaccttatacaaaaattaactcaagatggatttaagacttaaacgtaagacctaaaaccataaaaaccctggaagaaaacctaggcaataccattcaggacataggcatgggcaaaaacttcattactaaaacaccaaaagcaatggcaacaaaagccaaaattggaaaatgggatctaattaaactaaagatcttctgcacagtgaaagaaactatcatcatagtgaacagccaacctacagaatgggagaaaatgtttgcaatctatccatctgacaaagggctaatatccagaatctacaaagaacttaaacaaatttacaagaaaaaaacaaccccatcaaaaagtgggcaaaggatatgaacagacacttccccaaaagaagacatttatgcagccaacaaatgtatgaaaaaaagctcatcatcactggtcattagggaaatgtaaatcaaaaccacaaaaccatctcatgccagttagaatggcgatcattaaaagtcaggaaacaacagatgctggagaggatgtggagaaataggaatacttttacactgttgatgggagtgtaaattagttcaacctttgtggaggacagtgtggtgattcctcaaggatatagaactggaaatatcatttaacccagcaatcctattactgggtatatatccagaggattataaatcactgtactataaagacacatgaacatgtatgtttactgcagcactattcacaatagcaaagacttggaaccaacccaaatgcccatcaatgatagcctggatgaagaaaatgtggcacatatatgccatggaatactatgcagccataaaaaaggatgagttcatgtcctttgcagggacatggatgaagctggaaaccatcattctcagcaaactaacacaggaacagaaaccaaacaccacatgttctcactcataagtggaagttgaacaaggaaaacacatggacacagggaggggagcattacacactggggcctgccagggagtggggtcctaggggaggaatagcattaggagaaatacctaatgtagatgacgggttgatgggtgcagcaaaccaccatggcatgtgtattcctatgtaacaaacctgcacgttctacacatgtatcccagaacttaaagtataataaaaaaaagaaaatctgatataaaattacactgcacagcattttaatgcctacttccaagatgtttgcattatagttgcattattttaaaaattttttcatctctaatcattttcttttcattttacaacttcccatctctctccaaatgtggctgtccagcagggatatgtaaaatcacacttactggatagttactagacacttatttaacatactggtatttgaaaagtgtacagtaagtctacagaagagaatctttagaagcaattgtccatactgagtaacaactgtgtttttgttttaaactctaatgacctctattgacctgttttgaaatatagaaatcagtaaaatatttgcacgcagtaaccttaaaactcaaccagaatattatgagggtaaagtggttcattttattgtgtaggtaaatgaaatttgagtttttgtatgaaacactgtaatatcagaaggagaaaatttgtttatctatatgcagaatttaattcagaatttatttgatatttaggctcctgcattgttagacctcagtttgatcattatagtgtctataaacatatttattatgcatatatacatatttattttgtattatagataattgctcatatcagcctcattcctggatccattataaccctgtgatacctttaaagacctcaaaattggagaatttctaggtatggtagttaattcaggaaggacacatttaaaccacatgagcagatttactcaaaaattcttataaccttcaaccctgtgcttcaatcttattcttagtatgacagcttaaatctttggctctgcagccaggagatgacctcaccttcagatctggtgttgtgcactcatctaattcatcctcttgcctacagccatgctccctgtctgctcttgccacactatccatgcagcttacttttggagaggttttccttgtggatacattgcaatacatgtgtgttttactactcatcctatgcccatagcaatccagtacctatcttctacctgctacatccatgcttcgctagttacacttatgttctgattctcacctatggttttctttctcagttcacctgtttttactttttgtttatatatatacatatgtgtgtatatatatatgtatataaaaacatacataatcatgtatgtggaggatttaggcatttgaattatttttgtgtttgttttagaagtccctactgtaaagttgcatctttatctttctaatattatttgaatgctagaaatatttttaaatttttattttactttaagttctgcaatacatgagcagaacgtgcaggtttgttacacaggtatatgggtgccatggtggtttgctgtgcctatcaacctgtcatctaggttttaagccccacatgcattaggtgtttgtcctgatgctctctcctcccctcatcccctgacagaccccagtatgtgttgtttctctccctgtgtccatgtgtcctcatttttcagttcccacttatcagggagaacatgtggcatttggttttctgttcctgtgttagtttgtcgaggatgatggcttccagtttcatccacgtcctggcaaaggatgtgaactcattcttttttcatgactacataatactccgtggtgtatatgtgccacatttcctttatccagtctattatttatgggcatttgggttgcttccatgtctctgctaatgtcaatagtgctgcaataaacatatgtgtacatgtatctttatagtagaatgatttgtattcctttgggtatgtacccagtaatgcgattgctgggtcaaatggtatttctggttctagatccttgagaaatcaccacactgtcttccccaagggtcgagctaatttacattcccaccaacagtataaaagtgttcctatttctccacagcctcaccaacatctgttttttcttgactttttagtaatcgccattctgactggcatgagatggtatctcattgtaattctgatttgcatttctctaatgataagtgatgttgtggggtttttttatatgtttgttggccacataaatgtctttttttgagaagtgtttgctcatatcctttgcccactttttgatggtgatatttttcagagttcttttttaattcaattcagcaagaacaacacttctaaaaacccaagaattgtgctgtacttatacaaaagttttccttcagaaaacgatttctgcaagtgatcaattgtatttacccttcatggtgctagggctatcactagatgtgtcctcttctaactcatttctccaaaacgcaccattaattgcagctattggcagaggcatgctgtcctcagggaaagcctgatgaggagctgtccacaaggtttgcatgctccaaaatagctcttttagatgcttcctggttttagtaccatgctcattctcacaatttctttcatgcctgtgatggggaaataagtctctctggagccacaccagctccactaggtcatgggccttttggtttcatagttgctccctcattctaaattaatttcaatcaaaattaactctaatttaacaatatccattagaaaaaaaatgaatctggagtttaaactcgctgacacagttaatgcaattgataatctactacttgaaaagcatttaaaatataccaaaatgagcataaaaaataatgtctcatttttggcaaatgaagtgagaggttccacatgaaccctctagctgagcacatcttggatttaacgtatgaataccgcctcctgcaaatgagactaaaatgtaaatgggaataacttgtttattttgaaaaaagtatgcaaacagccataacatctcacttgcagacctcttttccactcaagcaaatggcttttgacttagaaacctgactttcttttttatattactgagaagcattagctgacatagtttttgattatgtctacttaggaatataaaattgcctataatcatagaattcattggtctttgtttacttaactcagatatgcttcttaaatattctatcagtggatatgtcttctatctgtggatatgttttgcacagattggttacatttttcaactgaacagatttatttggtattttattaattaaattggtggctggatttgggtggctcatacttgtggtctcagcactttgggacatcctgaggtgggaggatcacttagggccaggagattgagacgagcctggacaacagaaggagatcttgtctcaaaataaacagtcttagatgtgattcttttgcttggaaaggcagttcaaaaagatgctttccctgagtcactataaggtcttccactgtctttcgttgctgtcatgttctctctgatgcacaatgttttctttgaaaccaagttgtccctaaagttctggaaataataactttataaaaagatgctgcaagacttttaaaatacttactttggtataaatcctccattatccttaatctccataatattgcatttcaaatcaaaaccctaattgtataaaagagaaagtttttactttctttcatattgcattatatttcaccaaaaataataataccttcaattaatacttataattattttatatctcttacaagcaacagggaatttagaatttccaaatctttttttttttttttcactttaaagagaggaatgaagggtggtggaaaggatatggacttggaaagggagtctttaaaatctctagttatgaccaagaggatataaatatgcataactttggaaggaagattatttttatatgtattttacataaagcttataataattacatcaagattcaagcagaattaattaatattgccaattctgatcacactaggcaatttgaactctcattcatttaataaaagtttaccaagcgccttttaggaagtgttctaggcacatgcagtgtatcaatgaacaacaccaaataaataaatccttgcccttgtgaagactgtattcttacaggtgaagacaaacaataaacagagaacataataagaaagtaaattatatagtatcttagaagttgatgagtactatgggggaaaataaattaaatggagtaagaggaatcagaagtactatggcagggtcagtgtatcagtcaactcaggctgctataacaaaattccatggactgagtggattaaacaacagaaatttactttattacagttctagaggttgggagttccaacatcaagtggccttctttgttttcacatgaatcaaccacacacacacacacacacacacacacagagagagagagaaagagagagtgagcaagctcaagtgtcccatcctataaggacactaagatcacagccccactcttatgacatcatttaactttaattacttccttagaagctctatcaccaaatgcaaccacattaggggttaggactttaatagatgaatttcaggaggacacattagtccatagcaggaaggttgtaatttgaaatagagtggtcagggtatgccttaccgagaaggtatatttgcatgaattttataagaggtatgaacttagctatcccaatatctaggggaaggcagcccaggtataaggagcaactagagcaaaagtattaggaacatgatatgcaagagcattagaggatcagtgaggcaggagcagaatgaggtttagggagaaatgtagatgagttttgagagatattggcaagaccagatcatacagtacttgggttttcaccgtcagagaaataagacgtcggaggattgcttttctaagtcttatgttttaatacagtcattcaagctatgtgaaaaaatagacttatgggaggggtaagtgaagagtgactaaactatttaggaagctgttattatgattgagagatgatggtgcttcaatgtgacagaagcttggtgacgcaggtcactgatgcttttatgacagaggtcataaaaatggtcagaatttgaaactatttgggtggtaaaaccaacagcatttgctgaaaaactggatgtaaacagtatgagagaaaaagaattcaaggatgactgtaagatttttgacctaaccaacttaagaatggagttactgttaagtgacatggagaagcctgagaaaccttcataattggaacagattgggtaggaatgagataaagagttccatttgagacacattaagttgatgtatctgttagacatccaaatgggatttcaggtaggcatttggatatataagtatggtgtttaagtgagaggtttagcgtaaagttattggcatataaataatttaaaatatgagactgtatgtcaactccaagaaagtaagtataaaataaagaataaaaattatgaaaataacaccctggagcattgtaacagtaagaagttgtggagaagagaaccagccaaaggcggcagaatgaaagcaatcattgaggtaaaaggaaaaccaaaataatgtcatgccatggaaaataaaggaataaagcctatcaaagaaaagggcctaatgagctgtgtcaaatgctactgagatgtcaagtaaaatgaagactgagaattgatcattagttttagctatatggaggtcattggtaaccttgacaatagcagtttttatgtaatggtaggcatcagcatcaaagtccatcaagaatgagttccagagacaataggagaaaaattaatatagacaactcttccaagaaatctttctgccaagataagtggagatatcaacatagtttgaagtcatagatgccataattttctaatggattggagtgagacaggggagaaagaaaggagtccaggacggcccgaagatttgggatacaacatctgtaagaaagcaattgtcattccccgtataagaataccgcagaaatctattcaaatagtaatgtctattaataatatgccactgaacatatgagtctgaaatctagggaagaggttcattaaaaatattagttaacagcatagagagtatctaaaaccatgaggctggataaatcaccatggaataagaaaatggaaaacagtagagccatttgcatcaggaagacaaaacgaaatcagcaatggagactgataaggcgtagtcaggtgggagagaaacagaagttaagttttgaaaagtgtttcaaaggatgatcaactgtgtcaaaggatgatgatagttcaagtgagatgagtaatagagatctggccttaaggtttcagtaacagagaccattcactggtaatcttgacagaagccagtatgatggaaaactggaggtaagagtctgaatagcatgggttcaaaagagaatggaagaaaaataattgcagacagtaagtaatagcacaaacagttctcaaaagagtcagagaaactgagcgaaggctggaaggagaggaaatgttaagagaccttagttttgtttttcagagaaaaacacctgcatgcttgtatgctgatgggaaacatccattagagatgtgggagagagaggaaaaaagggctggttctttttctccgtgatatcttaagaggtccaccccttaataagggtaaaatttctttagtttctattggagtaaaaagttgtaggaatgcccagagaggagattaagtatataggggattttgctaatgacagatcataaattccaactgtcacagtggaagaacttcaagaatgagggagagatatgtgctgggcagaagaggaaattggcagaattctcaggaggttagaataaaagggctgagcatggtccagatgtctggagttacttgagatgacttatataagtaaatgaaacagtgatgttaagtcctggtgctcccaatgcaagtgttggtgatacagtgtaggttctgggctagagaaggctgagcatgatctgggaatgccttcttctcttttgtatgtttgtcaagcatagctcggcatttcaccaagctgtggtctgacagtggcctttccctcacccacctcttagactccaagcgtactgctcagttgccagtgcagcaagagggaacagagttgttttttgtttgtttgtttttttccatgtcttcatgtcactgctttaaaaaaacacatcagccctgcagtgctgtgagatttgtcgggcagctcacactgcctatgctctgagcattcacctttcacagagctacttatttggtaacattcttttggtacctttcagaagagattttcatggaaaatccaaggcgatttcattccaccttgctgtggtaaaaacagaattgagtcctcaaatcaaaatccccaactcccaccccggctctactgccatgcctacaaagaaatccaagaatgatataaatccagaggatctttgcatgctgtaagggagattctccacattctgccttttcactcctgtaacaaatgtttagaaacatttcctagacagcagagatgagtgaacaagaaaagcagtcccaaataaagcatgcatgccatgtaaaaatacttcactaatggtaattgtattgacaaacaatgttatgccctgacaaaaatttaaatgtagtacaaaaatgtaaaggtagtacaaaaatcactctaagaattcaatgtttctactcagatatcacaaactgtgtttttaaattagagagatatattcttaatttgctgcttggaattaccaagtgactaaacatgtttgccagaactgggagagcaaactgctcaagaaatttcctagaaaatgaaagaaaactgtttaaattatagttctaattggccccttatctggggctgagggattgatgaaataattattagtgtacataatggtgaggtttgtgtaaagataaaatgaaagagtcctaattaactccaacaaactttgacatatgtaagtgcttactccctgaagattgattttcattttactaatgacactggaggtgacaccatgaccacgtgtcgtgaggaaatatgcattagccttctgattctgtcagtagcattaatattcttgattgccatttgtagcatttttctagtcctcataatgacatgaaatttccttcctttctatagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcaggtaaaaatttggaagagtcagattggatttggtatgcttctaatcgtcttgaaagtgagttgaattaaccatgattgctccattgcttgctttagcataatttgtcctgattcatttacctaaacatcataaaattattttctttaaaataattatttcattttatttgttctcagaactttttctccctgtttccacaaatacagtcatctaaatgcttcaattttctcccaatccttgtactcatcttcaggttaccatgaaattaaagcagttcatttattcttctaataatatactcattcaatatagcatacacttaagatttagaataaatcggttcaccttctttttttccagtgatactttacttgaattacagtgtacttccttagaactcttttatgttacccttcaccacaaaacccatataaattacactttgcaaatagtaaacattgcccttccttgacctactgccttcctgaagtctatatgtaaaataaataccaatctgctccttgactttgaaaacattacattattctcagcttttagaaaaagcatatctgataaaaggtttctaatgactgaggaattaacagctctatttgaattttaagatatcttgcctatcacctggaaggtgcagaaaaataaagaaataaggaatacagaaattttctgagtagatttttatgactttggacaaagtctcattgaggtcttttatgtccctctaatgttgtatattaagaaagtatctggttagacatttacttaggggaacacaaacatgaatgttgataagaacaatatgaaaacaatagaaagaggaggatcagggataggtatagggaggaagaaataacaaatgctaatgtttttatgctcaatgataatatatgagtctcaaataaaagtgcactgaaaatgaaggtttgtcatatatgttcactgccctatactgaaacctagaacagtgtttggtactggtactcagcatgtcatatttttaaagggaacaattttttcctttatgtccccctacacacaccagtacataggtcagatacacatatacatacaagactaagaattaactgtgtccattgtgtattatagttatagaactgaaccaaaaatatgacttttgacctctaacaaattaaacaaagcttataatcattaaaataaactctcaaaacagttgactttttctctaaaacatattatggccctctcagaaggaaggaaggaaggaaggagaatggaggaagggagggagggaaaagaaagaaaaaaaaatcccaagatggcccactagactcaagacaaatggaacagctcctactgagggacccagaggactagagtgctcctaacagatcttcacagggaaggcactgagagtggacagagggaaaacacagaggttgggctgattgggggaaaacgttgggacccctacgcggggctacagcacacccggatttatttctggcccccaacagctctgggggaattggtgagttgaactggcaaggagcaacccactcttgccacaggcctctggaaccccagcagaaggagaccccctagaccaccacggactctggacttggcagggagagctgcatacagaagtggtaggagctgcaagccagctgatgtggagcccagagggtttggtgcaagagcatctgtagtgaagcatggtcagggatggccatccccctaggttcgatttgctccataggagactttagccctaggggaactttctgtctgtcctgaactctgtaaggcagttttgcccatcagatggggccagtcccacctaagcaacaccttagtctgctggcctctccccgagcctcagtatggccacacctgcttgcagggcgccctcgggagccttgagaggcctcacaatagcttctcctctggcagaccctgactgaaaggcagagagcttaagcagggcggctcctatggccactcaccagcctgcacagtctttccccacactgcagccgcagcgtccccgacatccctccatgggacaactcccacatgagtttgctgggcgtgtctgcttaggggtaggggtggggatttgggtttgctttccttgccctgacagcgcctggtagtacagtctgctccccttcccctgccaaccaccgttgcagacagagtcttagtgggtacagagccagcaagccctgtcccaacaagtaccccacccttgctttaagaatgcgcagatgacagcggatcctcccccaccttgagtgacccctccagcttgcagagcagagaaggcacccagacctgcacctgtcagtgccctgcccccagccaacaccacctccagtgcaagcaggcacacagttgtcatcaggcacccgctaccaccaccatcgctccaggcccaacctcaactgcattgcctccgccactgtggtgaatgtccccagggagacaggcacccaggaacccgctagcactcaaaaatagaaagattcaatatcattaaaatgaacatactgcccaaagcaatttatagagttcatggtatttctattaaactaccattgacattcttcactgaactactaaaactattttaaaattcatatgaaccaaaaaagagtcaaaatagagaaggcaatgctaagcaaaaagaagaaagctggaggcaacatgttacccaacttcaaactatactacagcgctacagtaaccaaaacagcatggtactggtactaaaacagacatacagatgagcggaacagaatagagagtgcagaaatatgaactaactcctacaaccatctgattttcgacaaatctgacaaaaacaagcactggggaaaggataccctattcaataaatggtgctgagataactggctagccatatgcagaagattgaaactggaccacttcctttcactgtatacaaaaattaactcaagatggattaaagacttaaatgtaagatacaaaactatcaaaatgctagaaaacaacctaggtaatactgttctggtcataggaacaggcaaagatttcatgatgaagatgacaaaagcaattacaacaaaaacaaaaattgacaaatgggttctaattaaacttaagagcttctgcacagtgaaagaaactgtcaacagagtaaacagataacccacagaatatgataaaatttttgcaaactctatatctgataaaggtctaatatccagcatctataaggaacttaaacaaatttacaagaaaaaaacaaacagccccattaaaaagtgagcaaaggacatgtgtagacacttttcaaaagaagacatacacgtggccaacaatcatgtgagaaaaagctcaacatcactgatcctcagagaaatacaaaatgcaataacattaaaaccgcaaatgagataccatctcatgcctgtcacaatggctattactaaaaagtcaaaaaataacagatgctggcaaggttgcagagaaaaaagaacacttatacactgttggtgggagtataaattaggtcaaccattgtggaagaaagtgtgacgacaactcaaagacctaaaaacagaaaaaacattcgacccgatactcccattactgggtatgtgctcaaaggcttaatacctgggtgatgaaataatctgtacaacaaacccccatgtcacaagtttacctatgtaacaaacctgcacatgtacccgtgaacttaaaagtttaattgccaaaaaaatccacatgatcaaattatcacattaaaagtaaataacaatacaaaagatgttcagtttttttccatataaaaattaaacaaccaaaaaaaaaaggtaaaatggcttaaatatgttggaaaaggttcatccacagaaaatccaacttctccacttttgtgatttgcctattataagttgtttttttctgctaccttttcaatagcatgaattttaaattaaacattaattgcctggttagattttcatgcatccataaaaccagccatgctttcattgtgtacaggtgttcattaattaagagcataacaggttagttgttcttcattttatgtactcactgtgcagctactgaaatgactgccaatagtagtacttatgctcacatattttctaaaaagcgctgccttactttgcatattgttaattgtgtttaaacaaaggcaaagattactgactaattcagaggctctctataaatattcatttcaaaaataaataatccatttgggatgaataatccttttcaactttttatggtatgaatctccttgtgctattaaaaagcattttagcaagatcacttttacatttcaagctaaagtgtattcagattgtgcattttaaaagaatttctatttctgcagctacctcaatcatgtattgcctgtctctattttatcatgagttctatatacatgacatactttagtccattaaaatcttatggaagagaagtagcatgaaaaatgcacgaagtactctcctttgaaagtgagttgaggaaggtttgtattgcatcctttatgcttcctgtactgtggtactacatagggttagagctactaatggtgttgagccaagtgttgagttatgtgcctgttttgtcaggcagcacagatttaaagagacaccaatgtctggagacatcctctcaaatgatgcactctgcctctattaagtacatatccagtattttaaaagataatgctgctctaaagagccaactaaactttgaaaatagagctgcttgggagaaaaaaggtctcacattagggatgttgaattgaaagtggtatgcctctttaaggttcacttatttaatagaatattctaaattccaaagcagtgcagtgaactattctgtcatagaattgccccttttctgcatgccaaaaaacagaatttttctttacaatttttctgaagagtatattttgaattttccggtcatcaagaaatactcggtcaggcacggtggctcatgcctataatctcagcactttgggacgctgaagcataggtatcatctgagcccaggaattcaagaccagcctggccaacatggcaaaaaccatctctgctaaacatataaaaatcagccaggcatggtggcacacacctgtaattttagctattcagatgactgaggcatgagaacccgggaggcagaggttgcactgagcagacattgcaccactgcactccagcctgggtgacagagtgagactctctcaaaaaaaaaaaaaaaaaaaaaaaaaggaaagaaacactcttgatagtcagcaaagctaagataaattggttcagtccaatttcttagtattaggatgtcaaaatcataatacaaatatatatttttatgcacacatttcacttttaatttatgtgggtatacagtaggtatatatattttggggttacatgagatattttgatacaggcatacaatgcttagtaatcatatcaggataaatagggtattcatcccctcaagcatctatcctttgtgtttcaaacaatccaataatacacttctggtcagtttaaaatgtacaattaattttttttttttactatagtcaccctgttatgctagcaaatactaggtcttatttattctttctaatttttttttatatccattaaccatcttcccttccccccaacccccactaccaactacacttcccagcctctggtaaccaaccttctactctctatttacatgagttcgattgttttaatttttagctcttaccaatgagtgagaacatgtgatgtttgtctttctgtgcctggcttatttcacttaacatgatgatctccagatccatccatgttgttgcaaatgacaggatttcattcttttgtatggctcaataatactacgttgtgtacaagtaccacattttctttatccattcatctgctgatggacatttaagttgcttccagatattggctatggtgaatattactgcaataaatgtgggagtgcagatatcacttcaataaactaatttcctttctttggatatatacctaggagtgggattgctagatcatatggtagctctatttttagttttctgagaaacctccaaactgttctccgtagtgttgtactaatttatgttcccaccaacagtgtatgagtgtttccttttctctagatcctcactagcatttgttattgcctgtcttttgaatataagccatgtaaactggggtgaaattacatcttattgaagttttgatttgcattcccctgatgatcaattatgctgagcacattttcatatgctcagacttatatgtcttcttttgagaaatgtcttttcaaatcttttgcccattttatgaattgggttttttttattttttttcctacataattgacttctttatatattctgtttatcaatcctttggcagacaggtagtttgcaaatattttctcccattctgtgggttgtctcttcacttgtttactgtttcctttgctgtgtagaagctttttaaattatcctatttgtctatttttgctttagttttctgtgcttgtggtatattgctcaagaagtctttgcctactccgttgtcttgcacagtttccccaatgttttcctgtagtagtttcatattttgaggtcttagatttgaatctttaatacattttgatttgatttttatatggcaaggtataagagtctagtttcacttttctacatgtagctatccagttttcccagaactatttagtgaagagactgtcctttctttgatgtatgttctgagaatttttattggaaataagttcattgcagatgtatggatttatgttggaggtcctctattctgttccattggtcaatgtgtctgtttttatgccagggccatgctgtttttatcactgtagctctcaagtataatttaaagtctggtaatgtgattccaccagttttgttctttttgcttaggatagttttggctattctagctcttttgtgatctgatataaacttaagaattgttttttctatttctgtgaagaatatcattgttattttgatagggattgcattaaatctctagattgctttggatagtatggacattttaacaatattgtttcttacaattcatgaacagggaatatctttctattattttgtgtccttttcaatgtattgcatcagttttacagttttcattatagagatatttcatttatttggttaattcctaagtgttgtattttatttgtagctattgtaaataagataagtttcttgatttctttttcagattgttcacagtttgcatataaaaatgctactgatttttgtatgttgattttgtatcctgaaaatttactaaatttgttcatcagttctaattgttttttgatggggtctttagattttcccaaacataagattatatcatctgcaaacaagaaaaagttgatgtcttcctttccaatttggatgccttttatatatttctcctgtctgattgctctagctaggacttccagtactatgctgaaaaatagtggtgaaactgggcattcttgtcatgttccagatctaggaggaaagactttcagtctttccccatttaatataatactagctgtgagttcatcatatgatttttatgatgttgagttatattccttctatacccagtttgttgagaatttttatcatgaagagatgctaaattttatcaaatgctttttcaacatcaattgaaatggtcataggtgttttgtccttcattctgttggtataatgtatcacattgacttatttgtgtatgttgaatttgccttgcatcccagggataaattccacttggtcatgatgaatgaactttttaatgtgttattgaattcagtttgctggtattttgttgagaaattttgcattgatacttaccagtgataccagtctataggttttttttttcttttttgatacgtctttgtctatttttggtaccaggataatactggcctcatagaatgaatttggaagtgttccctccttctctattttttgaaatagtttgagtaggattggttttagttcttctttaaatgtttggcagaattcagcagtgaagccattgagtctgaggcttctttttttttccctctggatgcccatttattacagcttcaatcacacattatcgatctgcttaagttttgaatttattcatagttcaatcttgataggttgtatgtgtctagaaatttgtccatttcttctagatattccaatttattggcacatagttgctcatagtagcctctaatgatcctttgaatttctgcagtgtgagatgtaatgtctcctttttatgtctgattttgcttatttgtgtactctctttttttcttagtctggctaaagatttgttcattttaactttaaaaaaacctttttgttctattgatcttttgtattgttttcttcatttcatttatttctgctctgatctttattgtatttttcttctactaattttgggtttggtttactcttgcttttctagttccttaggatgcctcattaggttgtttatttgaagtttttctttttcttttttttttttttttaatgatttaggcacttatagctatgaagtttcctcttaggattgcttttgctgtatcccataggtcttggtatgctgtgattccattatcatttgtttcaagaaatttttcaattcccttcttaatttcttcattgacccatgggtcattcaggagcattttttttgtgacctaacatatggcctatccttgagaataacctatgtgctgaggaaaagaatgtgtattcagtcattggataaaatgttttgaaaatattaggtcgatttggtccacattgtaaattaaatccagtgtttctttgttgattttctgtctggaaggtctgtctagtgctgaaagtgaggtgttaaagtctccagctattattgcagtgaggcgtatctctctttccttacctctcataatatttcctgtgtatatctgggtactcaagcattgagtgcacatgtatttcaaattgttatatcctcttgctgaattcacccctttatctttatatggtgaacttctttatgtcttcttatagtttttgtcttaaaatttatttttttctcatatgaatatagctactactgctcttttgtgatttccactggcatgaaatatgtttttctatccctgtgttttcaatctatgagtgtctttataggtgaagtgtgttgcttgtaggaaacaggttattgcgtattatttttttgaccattcagccactctgtcttttgattagagaggttagtccatttacatgcagtgttactattgataagtaaggacttactcctgccattttattatttgttttctggttgttttgtggtctattcttccttctttcctttcttcctgccttcctattagtgaaggtgtttttctctagtgatatggtgtaattttcattttttgtgtatcccttgtaagttttttgctttgaggttaccacgaggtttgcaaatactggcttataaccaattattttaagccggtaataacttatcactgtttgcaaacaaaacaaacaagtaaaaagaaaactagtaaaaaatctacatcttaaatttaatcacctcctttttaactttctgctgtttctatttatatcttattgtactgtctatgtatttgaatgttgttgtagttattattttttattggttcatcatttagtctttctgcttaggataagagtagtttatactccacagttacagtgttataatattctgtgttttcctgtgtacttactattaccaatgagttttttacattcaaatgattatttattcctcattaatgtccttttctttctgattgaagtattctctttagcatttcttgtgggacaggtctggtgttgatgaaatccctcagctttctttgtctgggaagcctttatttctccttatgtttgaaggatattttcaccagatataatactctatggtaaaagttttttttcattagcactttaaatatgtcataccgctctctcctggcctgtaaagtttccactgaaaagtctgctgccagacatattggagctcctttgtatgttatttgtttctttctcttactgtttttaggatcttttctttatccttgagctttggaagtttgattattaactgtcttgaggcattgttctttgggttgaatctgcttggtgttctataaccttcttgtacttaaatgttaatatttttctctaggtttgggaagttctctgatattatccatttgaataaacttcatacccctatctctttctaccttgtctttaaggccaaaactcttagatttgcccttttgaggctattttctaaatcttgtaggtgtgcttcattattcttttttcttttgtctagtctgacgtatattttcaaatagcctatcttaaagtttactaattctttcttctgctagatcaattctactattaaaagactcatgctttctccactgtgtcagttgcatttttcagctccagagtttgtgttggattctctttattatttcaatctctttgttaaatttgtctgatagaattctgaattctttcttggcattctatttttttttttttttttttactttcctcataacagctattttgatttatctgtctgaaaggtcacatatctccgtttctccaggattggtccccggtggcatatttggttcatttgctgaagtcgtgttttcctggatggtcttgatacttgtggatatttatctgtgtctggccattgaagagttaggcatttattgtagtttttgcaggctgggcttgtttgtaacctgcctttcgtgggcaggcttttccaggtatttgaaaggacttgcgtattgttatctagctgtatctgctttaggggacaccccaagcccagtaatgtagttcttggagactagtagaggtactgccttgataatcttgaagaaggtctgaaagaattctctggattaccaggcagagactcttgttctctttccttactttctcccaaacaaatggagtctctctgttctgagccacctggagctggggatgaagtgacataagtaccctggtggccaccaccactggaactgtgctgggtcagacctgaagccagtccagcagtcgatctcacctatggcctgctataaccacttgctggtgactgcctatgtttgctcaaggccctggggctctacaattagcatgtggcaaagtgagccaggccagtgtccttcctttcagggtggtgagttcccctagggcctaggcggatccagaggtgccattcaggagccagggactacagtcaaaatccttagaagtctacttggtgttctattgtactgcagctgagttgacactcaaaccacaaggcacagtccttcccattcttccctctcctttccaaaggcagaggagcctcaccacgtggccactgccaccacaagcccacaggtagtactgccagtctactgccagtgttcccttaaggcccaaggtctcttaagttagcttttggcgaatggtgcctggcctagaactcacccttcagggcaatgggctcccttctgtccctgggcaggtccagaaatgctgtcaaagagtcaactcctgggatcagggaccccaagagccctcttagttctctacacctctgtggctgagctggtacctaaggttcaagacaaagtctcctttacttttcatagcagatgattaatcctgccaagactgggtctttcccttcaaggtagtgggttcctttcttgcccaggatgtgtctagaaatgtcatacaggagctagggtctgaaaagagggcttcacaactatgaccagtgccctattctcctgtggctgagctggtatccaagaagcaagaaaaagttctccccactcttcctccttctctcctaaagtgggaggaaggtatctcttatggatctgcaagctgtgcagcctggacttaggaaaggggtggcatcaacactcccctagcactctaccccagctcacattttagatgccacatattctccaagtccactatctctgagcccagttcaacacaggacttgcctaggagttacagtccttgtggcctagactacctttcaagtttatttagggccccagagcacttgagcctgtggtggtgaggctttcaggaattcaagttctgaccactgatatggaagatttccctctggctagggatggtttaaatattccctccgggccgggcgctgtggctcacacctgtaatcccagcactttgggaggccgaggtgggtgaataacctgaggtcaggagttcgagaccagcctgaccaacatggtgaaacatcgtctctactgaaaatacaaaaattagccgggcgcggtagcgggcacctgtaatcccagctactcgagaggctgaggcacaagaatcacttgaacccaggaggcagagattgcagtgagccaagatcgggccattgcactccatcctgggtgacatagcgagactctgtctcaaaaaaataaaaaatttaaataaataaataaataaattccctctgtgggtgggcatcagctgaatttggtctggttttgctttcttctataaccaagcgacactgaatttaatgtctcacaattgttgcactctccctctcccaagcaaacagattttctcttctgtgttgtggggccactgctggggaatggaggagcggtggtctcagtgattcaagactgtttttcctacctcttcagtgcatctttcagcaatatgaagtttaaaccaaatactgtgagtgctcacctgatttttggttcttacaaaagtgagttttatgtgtagcagtgtccttgccaaggggacaatcagtggagccttctattctgccatcttgctctgccaccatctcctatatttaagctatattttcttacaagttttagttagagattagatagattgataaataaagatagacagccctgtgtttaatttttgaaatctgttaatatcatcaaaccaatatataaatttgggatagcataatgtaaatactttctctattatttaaaaagatgacactcaggacaaaaaaaatcacatttggggaaatgaatctgaaatacacactgtgggtgaaatggaaaaatacataaagtaaatacagcattgtcaattttgtcatttaattgaattttaatattctatacgttacatgttcttaatacggttgaaaaataaatgaaagggagaaaagatatagttaactacgtaacttgtcattcagaaaggtctgatcttctctgtagtataaaatttcaattatcttcaaagctactggtataaatctcaatatttgcagtttatttcaaattttaatgaattatatatacacacatgaataaatatacatatatgcttatgtgtgtatgtatcttttaaagaaaaagaaattgcacctataatgaaaggttggagtttcaacctggattaacgttctactgtgccacttaatagcagggtggacataggcaggaagtatgtcatttaaggcttgaatttctcactcataaaatggggataccacaacctactccttttgaccattctattaaataagattttttaaatgcatgtaaagagcttagcatagtgcctggcacatgataaatgctcaatattattggaagatattttattgtatcacctccatcattaatttaaatgagttattactttattaaatggaaatttacaaactagtaatcatgaaaaagtatattttttcatattgagaaaacattttcagagttaaacacgtttgttgatacagtaagaaccctacggtctcttgacttgcagctctgcagtcaacttcccaagataccctcactgtgagaagtctccactgcagacagccagcgttccatcatgccctatcatccagcccactagaacaacaggagagtcaagagaatgttttagcacatggcacactccacagagcatgcatgccttctaaatcatccttgcaaacccgtggctggccttcccatgatgccttttcatcttatctaattagtactatttctcaatatgtagccattttctttggttcttgtagcacagacaaggcgaaaggagtagaggaaaagaagtgttgaatgaaagactatgctaacacatttttccacacattcaaatgtctttgctttctagttatttttttcctacactgtattccgtcccttcattctcttctgactcaaatggaaaattatacacatatttctggccacaaaaggaaaaatactgaggagccaagatggccgaataggaacagctccggtctacagctcccagcgtgagcgacgcagaagacgggtgatttctgcatttccatctgaggtaccgggttcatctcactagggagtgccagacagtgggcgcaggtcagtgggtgcgcgcaccgtgcgcgagccgaagcagggcgaggcgttgcctcacttgggaagcgcaaggggtcagggagctccctttccgagtcaaagaaaggggtgacagacgcacctggaaaatcgggtcactcccaccctaatactgcgcttttccgataggcttaaaaaacggcccaacacgagattatatcccgcacctggctgggagggtcctacgcccacggagtctcgctgattgctagcacagcagtctgagatcaaactgcaaggtggcagccaggctgggggaggggcgcccgccattgcccaggcttgcttaggtaaacaaagcagcagggaagctccaactgggtggagcccaccacagctcaaggaggccagcctgcctctgtaggctccacctctgggggcagggcacagacaaacaaaaagacagcaggaacctctgcagacttaaatgtccctgtctgacagctttgaagagagcagtggttctcccagcacgcagctggagatctgagaacgggcagactgcctcctcaagtgggtccctgacccctgacccccaagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacacaacagaaaaactggaaactctaaaaagcagagtgcctctcctcctccaaaggaacgcagttcctcaccagcaacggaacaaagctggatggagaatgactttgatgagctgagagaagaaggcttcagatgatcaaattactctgagctacgggaggacattcaaaccaaaggcaaggaagttgaaaactttgaaaaaaatttagaagaatgtataactagaataaccaatacagagaagtgcttaaaggagctgatggagctgaaaaccaaagctcgagaactacgtgaagaatgcagaagcctcaggagccgatgtgatcaactggaagaaagggtatcagcaatggaagatgaaatgaatgaaatgaagcgagaagggaagtttagagaaaaaagaataaaaagaaatgagcaaagcctccaagaaaatatgggactatgtgaaaagaccaaatctacgtctgattggtgtacctgaaagtgttggggagaatggaaccaagttggaaaacactctgcagaatattatccaggagaacttccccaatctagcaaggcaggccaacattcaaattcaggaaatacagagaatgccataaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaaggaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccttcgagactaggaagaaactgcatcaactaatgagcaaaataaccagctaacatcataatgacaggatcaaattcacacataacaatattaactttagatgtaaatggactaaatgctccaatttaaagacacagactggcaaattagataaagagtcaagacccatcagtgtgctatattcaggaaacccatctcacgtgcagaaacacacacaggctcaaaataaaaggatggaggaagatctaccaagcaaatggaaaacaaaaaaaggcaggggttgcaatcccagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtgcttagtgacctacaaagagacttagactcccacacattaataatgggagactttaacaacccactgtcaacattagacagatcaacgagacagaaagtcaacaaggatacccaggaattgaactcagctctgtaccaagtggacctaatagacatctacagaactctccaccccaaatcaacagaatatacattttttttcagcaccacaccacacctattcgaaaattgaccacatacttggaagtaaagctctcctcagcaaatgtgaaagaacagaaattataacaaactatctctcagaccacagtgcaatcaaactagaactcaggattaagaacctcacccaaaccgctcaactacatggaaactgaacaacctgctcctgaatgactactgggtacacaaagaaatgaaggcagaaataaagatgttctttgaaaccaacgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttccaaaaattaatgaatccaggagctggttttttgaaaggatcaacaaaattgatagaccgctagcaagactaataaagaaaaaaagagagaagaatcaaatagacacaataaaaaatgataaaggagatatcaccaccgatcccacagaaatacaaactaccatcagagaatactacaaacacctctacgcaaataaactagaaaatctagaagaaatggataaattcctcgaaacatacactctccaaagactaagccagggagaggttgaatctctgaacagaccaataacaggatctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgagggcagcatcatcctgataccaaagccgggcagagacacaacgaacaaagagaattttagaccaatatccttgatgaacattgatacaaaaatcctcaataaaatactggcaaaccgaatccagcagcacatcaaaaagcttatccaccatgatcacgtgggcttcacccctgggatgcaaggctggttcaatatacgcaaatcaataaatgtaatccagcatataaacagagccaaagacaaaaaccacatgattatctcaatagcagcagaaaaagcctttgacaaaattcaacaacgcttcatgctaaaaactctcaataaattaggtgttgatgggacgtatctcaaaataataagagctatctatgacaaacccacagccaatatcataccgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaacaacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacagacaaatggaagaacattccatgctcctgggtaggaagaatctttatcgtgaaaatggccatactgcccaaggtaatttacagattcaatgccatccccatcaagctaccaatgcctttcttcacagaattggaaaaaactactttcaagttcatatggaaccaaaaaagagcctgcattgctaagtcaatcctaagccaaaagaacaaagctagaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctataacaccaaaagcaatggcaacaaaagccaaaattgacaaatgggatctaattaaactaaagagcttctgcacagcaaaagaaactaccatcagagtgaacaagcaacctacaaaatgggagaaaattttcacaacctactcatctgacaaagggctaatatccagaatctacaatgaactcaaacaaatttacaagaaaaaaacaaacaaccccatcaaacagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggaatgtaaactagttcaaccattgtggaagtcagtgtggcgattcctcagggatctagaactagaaataccatttgacccagccatcccattactgggtatatacccaatggactataaatcatgctgctataaagacacatgcacacgtatgtttattgcagcactattcacaatagcgaagacttggaaccaacccaaatgtccaacaatgatagactggattaagaaaatgtggcacatatacaccatggaatactatgcagccataaaatatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggaagggggagggatagcattgggagatatacctaatgctagatgacgagttagtgggtgcagcgcaccagcatggcacatgtatacatatgtaactaacctgcacaatgtgcacatgtaccctaaaacgtaaagtataataataaataaataaataaataaataaataaataaataaaaaatataaataaataaaaaattaaaaaaaggaaaaatattttttctacatttgaaaactcaaacgccaataaatagctgtagaggttaaaacaaacaaacaaacaacaacaaaaaaaaggttttttcttctcccgccattgctctccactatgctcaatgtgatcccaaacctcagcctcaaataaatcctaagcacttttacgtactagagcagtcgcattttcaggtatttaaaaattccagtttaatttaattaaaaaaatttaatctcacatctaattccatggtctctcattccttcccagcacagacctgacccaacagctatgatctgtcttttctttcttctttccactttattttgtactttccagcggtgctctggtactttccaggtcagacaagaaggagaaaagcttccacttagatggtacaatttgtggttctcacatgggtgttaaatgttcaacatgatggcgtttatccacatactgctgctttctctcatggggtgcattgagttctttgaagacatcttgccccctagcaggcagccttattgggtgtgatcctaacaaccctattcaaacctatcttcatgaccacttggttcacagtaaccatttcacattcctgggctgccaaaatctagaattataggatattctcaggaactattatttattgttcttcatttgaagtttcctcaagtagctcagtatgaaattgaggtattctagaaaactccgaaactcagtacaaggtgtgataggtaagcatctgaacttctctatagtggttgtcttgctcctgtccttatttaccttgatgaagaaataatatccccacttctctattgacagctggggttggagggagatgccatagcaaatccatcttctaaactgacaaccttgttttaagacagcattacttgtgcatgtatgtatatgagttggaggcaggcaatgagaaagagtcataaaattggtttccctaattcgtagcgagactagttttcttcagccactctcaattcagcatctgagattacatgtgactcattccaagttcagaaaacagtcgtttaatgtcctcttacaatttcttaagttgtacattaccttctgacacctacaaaggatcctgctctgttgacatttgtattttcacagttcttgtccatgatggtgacttagaaaattcccttgagttcaaaaattatggaagagacacaatggaatattattataagatgggctggattagttttatctgggggtatgtgaataggctttgtatatatttcttcttgccttttctttctcccctttttagcaacaaatcttatacaaagattattttacctattctttgcatttagttcattgtggatccatataaacaaagggaatatgagttgagataaataccattcattttgtacactcacctcctatcttcttgactattgccacttacaaggaggtttataaatcagaaaattcttacatttcctgaaatatcctagcaatctctttcagaaattcaaataggtattttgcctagatttccagattgaaacaaactatggcaaaactgaaagcataattcctttggtactaccaaaacaatattattggaatatccaagaaggatattctgtttcaagattgcgtgtgtatagactcacgatgaactttcagcacttctcatagaagacttcaccactttctctttttcgaatctaaacagaaaataatattaagtaatatttattgattataattccgggtactgtgatgaataatcatgaaaataaccttaagaaacaggtataattagtatctccatgagacaatggaaatacacgttaaaaaatattttcagccaagcaattagaggggtagaactaggattcaaacccagatctttcttactcccacttctcactcccacaagaaaacctttaccgtttgtacataccactttatctaccctaataagaataaaagcattatgtaaactcttaaggaaataacactggtttttctgggcgggttgggggatggtgggcaaggggaactccttcaatttaactctttctgtaaactaagcctgagttagaatcaattaattgaaattttcctgtgctacatacttcaatttgagtagaaaaaaaaattattttttaaatgttcctcttgacttctacctttgctatataaactccctcccttccctcttttcattcttcagcacctttctttccaaaccaattgccagataaccattaagctccaaaattgtatggcctgtcccaggtctcgaaaagagctgtattttttaatgagtggggtaagcgcttactgtaatataaattggaaatttttcaggtaaaaaaagattggtaaatgatttcattacattttattttagttaaacgctaattaaagcatattattagtgtgactcactttgttcaacctactgagaagtcctttgatattctgccgtggctaaactaaggtagtacactatatttttttcattctgtgtttacaagaatgctttcaatgtttaagaggaaaagagacatgagtttatatttcaacatgccaggtaagacttaaaacagctaggcatttgtagcttgtggataaagtatcaattacattatccactaatggatgagctttgctcagaaagaaattcagaagaatcagacttaaacctgctaaccatatgtataaacttgattctctaagctaatatgctcaagacatttatcagtagttgactgaggaagaagagtctagctgcttaatcctggattcaaattttattaattatatttaaaatatattttgttttaaagtaaatatgtatttctctggactcagcaaaagcatttattagatatttgattatattaattttgtgcttctagcaagaattatagaacttttacaccataagcgctccgaaagattaagtcaaatcccttcagatcaggaatatgttgttttataaagggatataattaaaaccagtggactccatcagtgcagagataataactgtgtgccaccaacttgaaaagaaaatgaatgtacatgggtttcgctgattagctgcatgtaattaggaaatttaagccaattggaattagagtacccaattcaaacactgtgcccatgacaacaaaacactgcgtgagctgcagctattacagcctaaagttttccattagtgaatccgattatatctagtaaactttttttaaaatttgagtagctgttacttatacacatatgctattaaaacatggtgagccataatgcctctcttgtcagttattgttcattaaaattggaggtaaggtaagagaaggatgatcttatttctttacattaagttgaagatgggctatcttgtcttgaaaataaattagcagcagtaagaaaacctcacggagctgatttcaagtagtaaaacaaatgtttttaaaacttagatcattagttgaaatttgaaatcacatactttcaaaaaatgaattaaatagaagtgaatcaaatcatagaagaaagccctcttttgctttcttagtttctcaaaatggaaattttccccaaaatgttcacttgtttttttttaattttttactcacaaagttaaaacttttaaaaatctaaattggtaaattgtttttttaaaaataaaagtatcaatggatgtgaaacaatactaccaaagcttcaacagttttgatttcaaatagttactttgttttattctattaatatcttttaaataggcttctagatgttgactagagagcctagagcctactctaaaactgtaatctagagtttctgagcatcctttttttttagatgatgttttagggttgaacaaagtagaaaaggatcttcaatgcctagtctttccacagaaacttatgatcataggaatgatgtcctcaaagaagaggattcaaagccctaaatttagagtacagatttagtccaatttaatagacaaagtactgggtctggtatacattacccataatgttatttaaatgtgagttttcagagataaatgtgaggagtgtatgtgtgtatgtatgtgtgtgtatatacatttaaaaaaacaaaaatactaagagaagcagtaatggcatgatatcactaaattattaatatattttatccactatttatttgactatgctttgatggtcacaatattcagaagtctgagattagcaaaaaaggcaatgtttgaaaatttggatccctgtccttttacatatacagttaaactagctccattcttgtgtgtcttacccgtaacattgagcagaaaataaatttagactaatactacataacagtggtttttcagacatggttataaggcatactgatatctcacagtctgttacatgtggcaacaactatgactactaatacgtaactcaataaatgatttgtttgctgttcatataaattaggtcatatttacagttattgctctaattgcatcatttttctcagttgaattccatgtgatttcttgaatgagagaaaaaaagggtatccaattccatgcaattctgagggaatccgtgagatgaactccacatatgaataatcctcagtatgtatgtaacagtgaaagaataaagattggtaactgctgctgcataatcctatattggtagcagctgcatgtgcctgagcaagagaattgtgttcatggagaaaagggccaaacgatactgaaacgtagaccctgacaaaggaaggttatttatttcaatggagccaattatatattcacaggttttgctcaccctcttttctggcccaaggagaatttgttttcttcctttccaggagtatataaattccacttcagtttttctggtgtataaaaggctgtgtgaatacctaccagtaattaatagcctttcattccaagtaagtaatatataggagtgaatttattgtttatgagtatatcaatatcgtttaaaaatgatatgccggaatagaaaggcaacactgaagtgtaaaattgttaatgcaggctcatagcctgtaaaatgatttcttttaatagttttcttcatttaaaagttcttcatttgaaaatgttccctttcaactgcagatttcatggtttggtgcaatgaaggggaaatttattcctttgacacatttattcttttaatagttattcatttgaaaaagtttcactggttgcctataaattttgcagtttgcagagagattcattcttgacagattttttaaaatgtttattcatttaagtagtttctcactccatggaattgttgctaaggtttaacaacaacaaaagaaatgtactgaagcttcctgggggttctggtaaggcagtaatgctaatcttgacctgtggatttttcagtggctctgcaagccccgggataacaaaaaagagtcacgtcattagcaaagaggataacagtgagcaattttaaggacaaaatttacctaatcattattagatgttcttagctatagtgttaattattatttagaaatcactaccacagagcattttcaagaggcatggtgcaataagtggtcatgaaaaaaaaagtgtatcaaaatctgccacatagatttgaaagcagggtgtttctgtcaccaatattttgttttaatctttaatatgaccattctgacttcaaacaaacttctgacttatctcaggattttatccaacgtaggttgggagtttttttctcctcactctccacccatttttatccacagttccgaagacagcacccaccaatgtaagcggaagaagtggaagaaggcatgagttagtcattgcctgggaggtaagaaaaacacatcctctcacaaattactccacgtgtttgtttggcttagtgtgatatttaattattttatgattaagcagtccacttgattcatttagaggctaaaaacagtgggaggaaggaatgaaccactgctgaataaatgccacgttaccctggttatctcatttaacccatacaacaatcttatcagttggaatgattttcttcattttacaaatcatgaaactgaggcactgttacatattttcctaataaacagaattgtgactttgattacaaaatttgtgtcattttatctatctcatcatatgcctccaaagtatcatttgtcaaggaaaaagagtggagatgaagggggagggggtgtgaagaatacatttattttccatgaagccaccttccttttttgatgttaaataaccttattattaaatgtaaatagctcacagagatcttagaatatatagaaatggaaatgcctgttagagtaaatagagcaactccttgacaatctctaagaacaatgagaaagtatacagagatctctttttccagtaagaattattccatgagcacataatctgtcctattttttttgtccattcccccttttcttcgataaaacttcatatatttttttgatgtctacagaggtattaactttccaatagctgaccttcactgagaccagatctctctaaatggaattgcctttccatgtaagctttaatataacgggctttgtttctttgccaccactcaatacatggcttttcttcatatcaaaattcaaggaaaaaaactacttagcaaatatttattgagtatctagtgtgtgtgaagcactgtgctagacagtggctggtaacttttccacattgactggtcaatcacaattactcctttctatggtgtgcagttgaagcccatgtaaccaatttaaatctaagccatatagcacaagaagcttcttgaataccatagtccaactttttcatgtcagtaaccataaaagcaattgcaaagcacactacaaaaaaggttttaacatcattatatcttacttttgtggtctaaagggttctgcagagcattaccagtgacaagatattcccgaccaccagaccataggacaattttccccaacatgttaatccaaagatcttcatttcatatacatgactaattggagcaaatttgtttcacttcaaaagttttcaattctcttgagagtttttgtacatttcaactgatacaatttttcttcttttacctttaaagctttttaactttcaaagaagtgccaaagtgattgtactattttggcttccaatgtagtataaagatttgagattctccctttctctagctatctataattttttttaattaagaatttggagaaagtggatttttaatcaatcattttgctgataattaattatatttttcttctttagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggaggtcagtttttttattcctattatttttatttaacattttactttgttatacaaataatcagacacctttgtacacatattagaaaatacaaataaggcaaaataaactcattcataatctcactaaactttttggatatatatttcccaaactttttttaattttttaaattaaaagttgattattccacatatgttgctttaagtttttcacatcctaacaatatatggcaaacatatatccatgaaaacaacaatatcagtaatccctgcagtgtattcctttctctgggtggacattaagccaatcctctttggtttgaaatttagatacttttatatttttcaatatatatgtaaagtagatttaaataaatgcttcatttatgtgacaaataaatatttatttctaaccctatgcataaagcactgtactaataaggaagtttcagacagggctttttcttggaaccttttcaaacacatcattaaatcctatggaaatcttatgaaatagacattattgcctccgttatgtagaaagagaaattgactttcggaaaagttaaagaacgtgctaaaggttacactgcttgtaactgagaattaaatccaggtttgtctaaccactaactccttgatttttgtataacttgctgccttcatatgcatgaccatgtttaattcacaagatagaactcataggtaggcagtaccgagtagacaatatacctattttacagatgagtaaactgtaaagtggttatactcaatacatgatagagctacagtggaaaccctgcttcctacatcaaagatactgaattatttcaagttttaatataaaaatgcaattttctgggtgaaagtataataatagatctagccccctaaagttagcttttcctcttagtccttcttttattcaaattcaggatttcagttaaccttacaagtgggggaaaaaaatgagaaaaggaaaagacagccttatgtttcttaaatttacaaatgactgagaaaatgttctaccaaaggcagcattcactttccccataccaataagtgtggtaaatataaactaacccttatacttcctctgtgcccacatgtaggacttgaacagctcaagagtattattcataattaattattatatccccccatgaagctatgagcttcacgggggatataaatatagtcatgtgaatatttaaaaacaaagataatgtttgatttaaggaagatgtagtttttcaatagtaagctgcctcatatttttataatatagagccaaattttaaagcagaatcagaaagtttatcttagcataagaataaccagggaagtgaaaaatcaagtaatggcaaggaactagaggtattctgatgagataccaattgcacttagcatctcagatttctgatgtgttttcagataaagtccatataccatgttacttatgttatctaatgtaaaggttaaaaccaaatatgaaattggaatctcaaaccttaatctacatttcaggaaactgagtctcagagaggttaagtaacatgctcaaattcacaccagtaagtgacagttacaagaaatgatagtaagtgacagagctaggattttaaccaggtctatatgactggaaagcacattttttaactactacactatactgcctcatcaggaatgtacacaatagtgatattttctattatttattgctcaaaagatctattttgaagtatatgtgttattcagaaagtacatattctttttccttttaaaatgttggaaactaattatcaattacatagcaccaaaggtcgcatgagagattaattggagaagtttttgaacacgctttgtatagtaacaacagtgctgcctttaagaaattcagctttgtaatttctttgtcaatctttgctttgaaattaatttatagcagccaccatgggtttttttacattgtgttttcttaaacttgaaatggcttgcctttggaaatttctctttcaagctagatagaaaatatgcatattttcttttaaagacactgaggttattcctgtaacatatttcatagtaatgtaacacttcatttattttaatcaactgaaatatgaaatatattaggcaaattaaatctggatagagtcctttgttctgacactgaaattcaagcatatatttggcattcgcttactaattaagtttacaaatgtggaactttatatgtaaatatgagtaaagtgttagcatcattagagtgtgtcaaccaagaaaggcaggacaagggaaaagaaaagcattaacctgagctcaaatctgatcacactaactagaccatcttgggcagtttattcacctctctgaggcttagcttcctccactttaaaaatgaaggtctcaaaatagaacatctctggaatcctatacaaatctaaaattaaaaccctgtcaatttattctatattctaaaacattattttagctggagcagtggcttatgcctataatcccaacacattgggaggttgaggcaggaggattgcttgagcccaggaatttgaggctgcagtgggctatggcaatgatggcttcactacattgcaaactgagtgaaagagtgagaccttgtctcaaaaaataataataataataagtggattaaaataaaacattctttgtaacaattgtcctaacatagatagcaataatagatcaacttttgctatacaataaaaagggaaaatcaacattcttttttagtcacttcgcaatttgctttacttaaaaaggagtgagcatttcaaaaattaaaccattttaaaaaagagtaaaggcctgaaataaacttgtaaaataatatattatactcttgccagtgcaggtttctcccctcagtgtctatggatgttcatacagcttcacagtgtgtcttttatcattatactcttgcccaaagcccaactaatctgagcgaaattgtatttctccaaaagacaaatcctgcttccttattcttccattaacccaatccacttgtttatcaccttgaaattcctccacattcttagatacagtaaagaacaagaggagtgagactgccttactatttctgtttatgggcttagttcctcctcttcctttcaagcttaccagatacatgccttaagcactgtgaaaaagccaccttttcacagccgacaccaagctgggaagaaaaatgtcaaatgcagctaccagaatttatgttattgggagggaagcagagaacagaaaaacttacaaggcacaccttacagtactacttctcaacctatttcccaatggaacatggataatagatgacattcatacccagaacatgcttttataagtgtgtatgtgcattctccactctatccctttcttttcctcccaataaagcgtatcagaatgcaaataaaattaattattttagagaaaaccttgaattgacatgtttttcaaagaaaaaatcatttgcaaatgttgatgcttgatcaataaatcacttgggatatgaccttaactctcacaactctgaggtttactattgccctagagtactgtcagaaaaagtttcaaatggtttttctgctaacacccgtaagcctttgaaacctttcaatgttgccacaagagaagcaaaccttaatgactctgtcagtgccaagcagcatctgacataagccctggaaaaagagatatttgcctgccaagatatccatgtaccctgtacatgtgtcaaatatctttgtcctttaaaccgagcaaggtttatgtgcattcctaatcctgacttcagacctctagggtatgatataattctatacaacacgctaattttggaaacaattccatttttaaaaaaaaagaatagtgaagtttcaaaataagttctcaaaatgcatggtaaaactgataaaaattaatttttttccaagataaaaaattaaattggctttttcttccacatttcaagaaataatgaatactcaaacataccattttccacttagttcttctcaccataacttcggaaatgaaaagaactggagcattcaattaaacctaatagaaaaacagaagaaaaattgatacagttaattataggttgaaagatttatttacttgtgatgcgctttatcctttatcctttatcctttctagttttcttggcttttgccttatctgtaaaaaaatgtcctgctcatatatttattaaacctaaaaagcctgtcctcatttgcagaatataatagacaattatctcattgcaagtggagctaccacagctcaaattaaaacctaatattcctaaggtgttattctccagatccatccttagctgaaactgagctcactgggatttatgtgaacttgaaaattaataaattgacatgttagttgtaaaatacaagaaataatttcctgtcttttccagatgatctatttggattagtgcctataaaagttcaactacagctgtcttcactgaatttttaaataatgaaaccataccctttctctcaaggagtttattaaagtctcttttgattaatgctgttgctctaagggtctcttgggaagggatctcttggaaagtcagatgtataatcaatattacaagcacatacccccatattacatgaagaactccagctgctaggtcacttaatacaaatgtatcatcgaaattcatgaacacggtaatgctgttcaacatttttaatctatcagaaacaaacgtatcaatcaacctgtccactacatatcccaagattacagtgaaggagttagccatggcctaattaatatcatcacaagtaacagaaaaaaaaagaggtttccctctaagtctttgattccactagatataatgctagtacagtctcagaaataagtttctaaacttttattaaattaccccagtgtaatagatgggagtgagagtggcagaaaacatactgtgatttagagatcagaagagttttagagatgcctgaatgtgacatgactgagaaggagctgtgcagctatggttcaaaattaccaaggagtcagtgaaacaggaatcaaaggagttaatagtgagcctgtggcagggttaagtgggtgatgacgggggtctagatggtttctggcaagatctagaaatagcccaaatggggagcccaacacaaacattcttgagagaagttagatgtggagtggcaaggggaaagagagaaatagaaaaggaaaaagcatcaggtaagtgtaacatagacataggcacagaagcagaacagtgtagtgctcagggcctgactacctgtattcaaatcctccctccacatttaagcagctgtgggatcttgagtaagtagcttaacctctcttctgcttgatttcttcatctgaaaaatgctagtagtagtaatatggttgttgggaagactaagacatggaaagaattaagaacagggtttggaacacagcagagcctcaataaatggcaattattagtatttcgagttatccccacatctattttgcctcttttttgtttacttctaatcttattctatccattcctctgtcagttatttggaagcaaccaggcaacaaaagagggaactatctatgttttctgtaaaacttattctgtgacttaaaatggaccctaggagatgaagaatgagccagcctctttctttatgccaatttaaaaacagaggaaagagcatttgagacccaagttctagctttttcacagctgaaagtagagtctggataaattaacctctgtacgttttacttttctaatctgcaaaatgagagcatggatttaaaacaggtccattactccaaagcacataggagtgaggtaagaaataaaaacaataaagtactccttgtgtgagacaattgtgagtgggaggaactctggcatatgtagaagcacatgcccagactgagggagtccaccactaaccctcatcggccaacactcaagaattcaggcttcatactgtctccttttatcccccaaaagaagccagaaattcttattttcaaatgttggcttaaattaatctaacacatgatgtagacaaacaaaatatgactaaagacccactgcccctgcatttgtgactttggagccaagtgacttctagagtcctttccatttgcaactttccatcattcagttacaatgggatgcccaaagcgaatggccagtttcaatgcaagccagatgttctgtgatccagttagctacttgtgtctgcagaccaatttttgacccagttgaaaatgttcacttgggtataaatagtacatactaaaatttctgggaaaatctgacagaggtcactatttttacatgctgaaatgtctaattcaggtcaacatagatcaacttctgataccattcagggatgttcaatctttggcttccctgggccacactggaagaagaagaattgttttggaccacacataaaatacactaatactaacgatagctgattagctaaaaaaaaaaaaaaaaattacaaaaaaaatctcgtaacgctttaagaagttcacaaattttggggggggcacattcaaagctgtcctgggccaaggctggacacacttgattagattaagagggtgaaaaaaaattaaaatgattcttcagttcttgtttgattgattcactgtcattcagttatatgaaattataacatgcagctccccaaaatgcaaatgtgaaatgtaggtgtggtatgaccctgatttaaaatccttagagcttttaaataaaagttaaggtgcttgtttgagaggcaggttcctgaacatttttatttactttaacatttttttaaactttctatttgagaaatacttaaacttgtacagtactactgaaagttgatagagaaataattcctttctttggagataaagagatatggaaaggttgctaccccaccacatgttttgtgcttctgaaattatttatccccctgcaatcttctttgacaaagatgtaattgcttcagcaatataaaagctgaaagaaggcatttggcacacaaatctctgtaatgcatttattctgaagagaagtaaaactgctacggaatagcaaacgatattcaaagtgtggtttcctttcaaataaactgtatcctaaatcccagagatcaagttgtacacacctcagaaacatcaacattctttcatttacttgcaaaatcaagaattttaactcccactaaatagcatggggaaaatgtccattgcaagtctggtaatcagaattctagaataagatagaagatttttccagaatgcatgttttaaattggacagatgcacaaataatagggagttggaaagtgagatgagggaaaccacggagcaaaagaaaataataaaaaatattcaaaaggtgacagaatgagaaatttcaacttataccatggcaggaattaatgtcagcttctgtgtaaaaattaatgtgaatttgccaaagcactttgagatgacacaattatagcaagtgtttttaacaaaggtttggccaaaagaaaatcattgcttggtgcaaaggtggaccaaccaagtcttttgcaggctccttttgcagtaacagggtagatatttttgactgatatatttcaattaataatatataaaagcgttccagacacatgtatgactagcttctttcagaaaaggaaagacctcagaaaatgattatgtcttcaatgttcgcctcttaacatttttatttagaactcaatctttgctatatggttccataaattgaaaaaaaaaattcatagatgaagctcaactctaatcagtgataaagggttagtaccaaaatctgtaccatttttatggggtagaattttaatagactttgtacagaactgtttgaactaatgtatggcctttattctgccatttcatttaacttgtgtttgtgacacagtatttatgattcagccatgtcaacactagaaatattttgttcctcacatcaagtgcagcctcgaataaagtacaccttttgatggatgccagtcagaaattgtgtatttcaaaaaaaaaaaatagtgtgaaaggtcactgaatgtagaaacaaatgaaaaggtggttttgagccacggcactgaacccttcggggacttttctttcccacctgcacctgtcttaaaagtcaatgcatgccttttaaatatcatgattcataacatattccttatataatcatgaaaatgtagtcttgtggttggaacaacaaaaagtatctaatgaaatttagatacacagaataaaaatttagatgcacagaataaaaaataaaataataataatatggtattttgtgaatgaacatttttaacgccaagcacagtactaaatattttatatatacattctaattaaagccaacctttaaatctatgagataaatactctcattatagtcatgttatagatgagggaactagggcttagaaagagataaaacaacttacccaaaggtaaataaatagctaaataaatgttttaaggccaaaagcaacagcagtgcaacaacaaaaaaaagcaaacactgactccatagtccatttttataggaattatgctagactggcagaaaatttaagttccccagaaatgtcttagctaatccaaggattaatgtctttgcctgtcttgctagatttgtcatttgtcattggtaaggtattgatgagatttgacccaagtatagaaatccaaaaggatcacctttatattttgttgtgttttttataactaccacagcacttcatttcaaaaataaggtaagaggaatttaacacctgacagactcaggcgcaatactttgatggacataaactttttataattgtggtttattttccttcatacagaacccagtgctgctcccacagatgtcaaggcgacaagtgtgtctgtgtcagagattcttgttgcatggaaacacattaaagagagtctaggaagaccacagggatttgaggtatgaacagaatgattgaaaataagccttattgtttcttctgacatcacattctcctaaagagaggttttggtgacacctcagaatttcaacagaatttcttagaaattttgctctatgttaaagaaactaagaaatactattttactgggatgtgttatgttgctcattaactggtttatttttcagtacagtagcttccgtagcactatgcaaagatgtttttaaaagatgaaatagagttttagacaaaagcaggagctacaggtagatatttaattgtatccaatttactggtcattttaaaagtttttgtgtcttcctttctaataatttaatgtataaatacaagttttccttttgtactttattggtatctcttaccctcagtgctgaattatcaaattttgcttggaatttaatgatctgtattgtatctatgtattcagatagtttttttggtcccttaaatgttgctatttttaaacatagttattccagccttataatggtgaacatttcatatcaaatgaataacatcaatgaaattttagcctccgcagagaatagcagattgtgagtagtctgtgaacatgaatattttatgataacaaggtttggcttctcacacagctcttgttcttgttcttgccttgcttggccagtcatggagaggaattagggggataatgtctaaaagaaaaaaagaattagcatctgacccaagactttagttgcatttaaaaaaatttattcttacttttcctctgcttcagttcccattaagagaaaatcatcttgtgtcttgaacaatgatcaagtataggacttgtatactaacatggtttccaggctgaaacatatttttaattctatttgagttttcaaataatgcccaacaattatttgattaacatacagctggcattaaataatgatttctatgataaaaaaatttatacaatctttctaagagttacagcaagaacaatttatgggaaaccattacctacttatacaatatcatggacttatttctacaatcttgcttcaattaattatttggaatgataatttagtatctcattatgattgcatgtttaatgtgatgaatatttctgtttctcccaatccatgcttcagggaccatgtttgttcatcattaaatctcagcaaatgataatatatatatttggcccataactgaccacaataaatatgttgaatgaataa

SEQ ID NO: 2393 - DNA, 1337912 bp, Homo sapiens
tacttcccaatataaccaactacggcgtgggggagcggaactgcgagaaggcggcagccaaagtgccattaaagctcggggcggagaggatgcgttacctgggtcccgtctgctgcgagaggcagggcaagctggaggattccctctgaatgattaagaactccgcaattcgcctctgccacaggctgcaaaggacccgaggaaccgctctctctgaactgtgctgatgggcaggaggatgggagacaggaattgagagtcacagaggaaggacagtggagtctggcatcttattggtaagtggctgacattcctttgccagtgactgcgttctgtgattgtgcacttcatctcccagccacttaggatttttgacacactctgttctgcaaagccatcctttcttgccatgttgccagaatgtaaaaactgtaagatgaagcttttttaaataaaggaaacaaaacacgactttatttcctgctgggattttatggcaaaaagttgaaacaagagtaaatataacctatttgtatatctcctaatgccacccaaaataagagtaagcaattcctacacgcaaattgcaaattgtaaggcaataaatgccaggataaagtgaggatgtttctacaaaagaaactaaatgtttggaaaataggatgccgttctcaggtactgaatgtatgccttatgtttgagcaatgagtttccgagactaaataattgggcatctggcattgcaataacttgttaaaattcagtagggatgctctataagtggagttctacaaagttcgtgagactgagaaaaactgtatcttggattatgctgagcttttttctaaaggttgtataggattgtgatagattaaaaaattatgttcagacatccttaccatgttttgtagggagatatacggaagagaatatcaatttgcacatacacaaacctgagaattactctgatgacctgaacaataagttgtttcaactatatttatttgcgaaagaaccagaatccactaaatattttagaattatattacttttaaatcttagaactgttctcccaagaaaaatacaatttcatgtggtaatttaaatgcaggtgagaagcaaaaaacttttaaactgttgtatgttcaatgccttacctacatttcattcatttgtttcttaatttaaaagagaaaatcatttagagggtcaatacttctactttgattctcaattacgactgtggaaataaggatgaaagaagtagatgttcattagaatactagcatttaaaattatagacaaatagtcaaatttaaaaattaatgcagatatcatcgattactgttgaattgcaacagaattacagaagtacttatgaccattacagggagcttaaaggagttcattatgattaatattgtgactctcagtattttaaaaaataatgattaggtcattaactgtttttgaaaatgcctgtagtcaattttgagcaattctcatggttgcttgcatattctcctatttcatgctcaaattattctaagttaagtggggactagtatgctgagtcttaaacttaacaggcataagtttactctgactctaatcgaaaagaggtatgagtaagaatatgtcatataaaactaatgataacaaattaaagatattacataaaaagatcatctaagtccattaaagggaaaaaggcaaaaaaaatcagagttaaagttataaaaagggaaattcaatataaagaatagaatttgacaaatagctggagtgtgagggaatgatattaaagcctatctgaaaatagaaagtcagtgaaatgattattacaagtgccagtgtttttgcttaggaattggtgtatcctttaaattatttaaaacttctgaaaattgagaaaggaggagaaaaactgctaattttaatttctttctgattccatagacaactgaacagaaagttagattcttaaaagttatataaaaatataatcccatagattaactaaatgccggactttgtctataagttgtgaggcacatgcacaccaaggtgcttttggaaatacatccaaaaagctacagttgtggaatttttaaatgaatagctgaaatacctgaatgtttctcaaggtgagcagttagtacttcaagtattaggtggtctgaaacaattcttagtcagggagccaacctgaaatcaaatcatgaatctatacatagaatatgtttatgtaagatgaatcattaaaattagtagcatgtaaaaatttacttcaatcttatgtgtccaattaagtagcgctatctgttagaaatgtaccaggtttggctgatatgtatttctttaaatgtctcttttacttcacagtttagaaaatcttgaccactttcagggtagaggtaggagtgtgattgtctgtcacagctgacttagcaatatggaccagagggtgccagtaaagggcaaagggcccgcataggctggccaaagcattttggagtttgtcttacttctagacaaaataaaggcataatttgtgaagattaaaataaaaatgatgaaaacttctctagatggctgtaatactgtgaagatgatttgactgtagagagtttgattggctaaaacaaagttgtagcagagtttagtgtctccttcatcagtcaaaaactaatccagaattttatgaggctcagatatttacaatattgtaatttgccgaatccattctttctcatgtatcttgattacctattgtctttgaactttcttttaaaatacgggtttttaaatttttaccaagtcgttggaaatttatttctcttactttaaataataaactcatacattcatgtagtttgttttcttgaaattctgactccaggagttgattttatctctctttcttctttctgacaatccaagcataaagtaagagagtaatatgtttctcacaagatgttaagaaccgtgttgtaaggctgtgctaacatgttacatgaacttcttaacactttatagcaggaaagagactggtcggaagctcaaagcggtagaatcactgcagaggtctattttctgagcatttgtgatcaataactccacattagaggctggtacattttaaaaagtaatgaagtatataaaactcctaatgcttaagatttaagattaaaaactattatgaactatattccatctccctacccactcaagtaagaaatcctgttttatgatttttggagattcaaatgtgtattgttagaagtgttctaataaactgaatattattagtttatgttttttccagacacttaaacagtgttttagttaattattttatttaaattgaatgacacaaaatatagtgttttaatacagtggctataaaagcaatttttaaagggaaacatgaatttgctttttaagaaaactggttttacaatggatttctttcatcaaaattattttgaagtattgaattgaatcccaagaaattgacacaacactgtataacttcagttatgttttgcctattataaatatttgcataagctaattgtagataattttatgtctattaatccccataaattaaaacacacgtctttagttttatatcccagagtagtgcatgttatatttttgacattataccctcctcaaacataagctcatacgtgttacaaagctattcaaagtatggtagtttctcttttctccagtgcagggaactgggaactttccagagaggccacaaagtaattgtgaaaaataaatcaagattgtctgttttatggaaataaaaaaaagaatctcatttttaatctaatataaaatagtgtgagatctatcattcatgagaatcttaagaaattacagtcatattcatttcctgtgtatttcttaagctagaatttcttgtgatcactgccatttttaaacgtttcagaaaatgtttcattagatacattttaaaacacgggtgtaaagttgttttttctctttttctaagtggttcttaaaaactcataatgatctaaataacttgttgcccaatggccactttttatttatttatttattttcacaaatgaccttctcataacagatccgacaggactcacctatttcctcttatgccagtcatgtttccaaatatttctcacactcaatttgcatagagcggagatctagataaaaagcaagaagccaatacattttatgagttttctatgaaaaatattgttacagttagtatctttactagaaaatatggagccaattaaagggaaagtgactaaactgaacagaatccaaataagcaattgcattttaggcaaggaatatttcatttatctgaatgatcaaaaattctctttcataaccattgactggaaaagtataattatatatttaaacattttatgaagggcgtagagatgttcttcataggattcttatagctgctaacaacccagaaaggagaacatctcatcttccattactatccagtagtaaacgtagcatatgtttaggaagagaaatgttgctgattatataggtgataaaaagttgattgaaattctcttccttttgtgagttataatattggcagaagcattcatcatgaggctaaaaatactgagatgctctcatcgagagatattataatgatagtaataaagtatctggagctgcaaccaggtctattaatgtatttttacaaatatttcattagttgcaggagtttgtatttatcatataaatagtagagaaatgggatgttgattttgtgagaaatttacttttaagtatataaagttttatctttattttcttaaataattaatgttatacttagaagtattaaggatttttttctgaaattaaacgaaatataaaggcaatactcaagaatttagaacaactattctaattcacctaggttctcccatttcagttacatgcaagaacttactttcaattatgcaatatttgttgagatactattgttcttgagcctttaagtgtactaaactagacaaaatccctgatgattaaaagtaatattattggaagttacaggtgagtgacaacaggaatttttaaaagaattttattgttttctaaaaatacatttttatttaattggcagtttcatgatcattaaatatgataggaattcctgggcactggaacagattgaccccaaatatatctgaaaacactgtgaaaagtctcatgtttaatctgttaggtattgtattttgccttattttgttattttaaaaccttcttcttcatattcttttctaaaagatatagactggcttaatattatctcccatatagcaaaaattattaaaacaacttgttagtgaccactatttcttttctaattttgtattttcaatgataagaatttcaaaagttatggcattgataagagaattgaaactctaagcttcataattctatttaatactctcttcctccttctgtgatgctgttattctaatgtgtgagctggtgaatgagagttcatgctaaaataaccgtatcattcaaattcagcacaaatctcatgatttattgatgattaattgtggaacccttaggaaaaagtgacagaataaataccatttaatattggaaggggccatgcgagctcatatttttacctactcataataaacaaagtttcttcactaataagcaagggtataaaaaggtgaagtgatgtgttcaacattgcaagtaatgcaaaagatggaattagaacccacatctcttaaatttgaagatcagagctttttatggcttatacttcattttagactgtggacatcttgattatttttgtatctattcaaatcaaatccttatattagaatataaatatatgtaatttccttgttgccactgattatacataaaacattgtcttttaagattagaaatttaagatccaattatattaactcagtggaaactgctatacccgcattctcttaaccaacaactacagaacttaattgctagatgtgaactttttcacaatgaacttggtatgcactcaccagctacatcaaatgacagaaggggttttttttttgacagttttaattatgaaacttgggaatcttttagagtattataatgaagtagaaaaaaggatttaagtgattttattccatggcatatatgtaagggaacatccatttgccctataatacttcttaatttttcccagactggcaggttttctttttttcctagtaataaatgtttaatggaagccctaaatcaaacagaaactcagcaagaaatgtagatgagagtatatttctgtgtttgacaaattttgggtaaactttaattcatgggctttttaaaggtagtagcgattttagagcatttgataataaagcagagaatatatctcttgaaatatgcactacttttctgtgttttaaaattcaaatgtcaacttgtatataaattctagtttttctgttacaatattaaaggaggttaatagacaacaaatttgaaaccgtaatagtatttaatcgtcattgtatctgaaccaaagtttacttatgcttaattttaataatgtcatataaattgttttagaatgaatatatacactaaaaattcctcagtagaactgaatatgataaaacataaaattaccatagtgcaattgagtggaaggcagtttaaatattgctgaatttctggtattacattgcttgtacagatgccttctcctgatgctttaattgacaaattatgacaagcaatttatgtgtttgggggaatgaattcaagttttaagactttttctttaaacactgaatatttaaagatggcgcgataagtgtagcagagatgaggtaaaagacggtgactaaaaaggttaatattttatctgaagtcttttatatcctaagtatataaccccagtttgcaaataaaataaagaaaatataaaacatgtccttgaagcccaatgaatagtcattttagttctttgaatttttactttccttagttatttattttcctaaaacttacattcaattctttaacattttcaaataacagtaatcttagtaagaaggagtagttatctgagattgaagttaagtgatccagaattgattttatgaaaattatacatattaactgttttaaaaatatatgactgtgtttgtttgtttctcattctttaacgtggtcttgttagtaagtgccacagtgagtaatttaatgcaatttcaacattaatttactcacataaatggtctactgtggacagtggcagtacaaaggaagaatataaaagagaataaatagttcaaacctggtggaggaaatacacccatagggtgaatataattcaatgtgaaatgtgcagtcatagaggtatatgtgactaagatacagattttcaatatttctccttctggagacttctgttacttttctcctaatgagtctttccagcttggacaatttcatgctaacattagttctctaactgctgcatttacttttcagtgcctaagttattttaaagtgactttggttccaagattcacctaaccactttaaatgaatgtgatgttttttgacatctcattatgttgctaactttaatatctcagagccatctaatctctcatggtatagccaaactcaaggtaaaaatgaatgtggctgagatgctgtggaaaaaaatgccatttctatatgttataaataagactgatttctttcatttatgtagtatgatatattaatgctgctgataaaacttattttgcaggagtggattaactatgaagccaatgaagctttgcttatatggccgtttccaaatagtaatagtagtaatagtggcagaagtcatagtaaacattattttaataattataataatatagctaacatagggagtcatatggattaaaggatgtggtatttgaattttaggttcagttttgactttaaaacttattagctgtataattttggacaagtaaaatctttctttacgtacaaaatacctgtcataatattatatacaagaaaaaatatctacttttcaatggtaaaaaaattatagtattaaaatcattaaaggtttgagtctaggaagaaatttttattttacttcaattttcattctaagcttatctgtctacccaaatattctattttttttttaatgagacacaatcctgttctaattgtggaaggggatattgagatctttagaacatcagcatttaaagattattctgtgtatctcatcttttattcaaagaattttcttgaatgtatacttctaataaatctggtatgtttgataccatatgcttttggggattcaaaggaagtgagaagtttgaccactgacattgaaaagatggaaaatcgttcagtcaggacacagcttaataagaaacttaaggaaaaaatacctgtaaaagactgtagaaacactggaggaacagaaatggtcattgtggtgatggattaaactgacttcttagacaaactcttttcagttggtgggaagagaggcagaaacaaaacaaatgtgtaggaaaacagtaggaaagctaattaatgtacagaaagaatgcttttaatgcaaagagagaggttaaaaattataaaatgaggaaatttggaggattctaagataaactgaaaaaattgggattttgttccaaagcaagagaataatatttatctcaagattagatgatatttgagtttcttctcagtttttccctttactgtgacttgtacaggtcaccttgcttctctccctagtttattaatttctcaatcaaaagaattataatcaatgaatttaaagcatattcttcaggttttgatccactgttactctatgactgtgtgagttaggaggttttgacaaagagaagaatggaatgaaatgaaaatctagggattgacaactgcatctagaatgaactccacagaagagagagaagagagaagaaaccacattcatggcatatggtgaggtcacaaaaagagcatgggcttcttagactcaggtttaacccaggtgtttccctgagcaacaccataacctttctatgttttcatttctttccctgtaaaagatgatattgactactaactcatagtttttttttgcgagaaggaaatgagactgtagatttaggaatcaaaattacttccttcatatctttagctatagatgcttacaaaatttctttttatccttagactttttaaggtataaaattatttaaattttgtataaatatatgtggatacaatgactctagtattctaaatatgcagaaaatcactattttcttggctggatgctgtgtattcatgtatgtttgctgatggtgacatgttttattttaatgaccttattttatttgctcattttgacagtgattacctcttctggacattttactttaattttgttttgttgggctagaaaagggatgtccttcatttccctttacaaaattatttagagcatagattctattttgtaagtagaggaagatatttcacataatgtcttttgaatcctgtgtgataacaaaatagtacagaatacattcatttgaaattaataatgttccccaattatattattttttcacttttattgtctgttttgctacttcaaaaaagtgatcttatgaaacagacttgtgctataaatgtggcgtctaatgctaactctcttttttttttttttttttgagatggaatctcgctctgtcgcccaggctggagtgcagtggcgcgatctcggttcactgcaacctccgcctcccgggttcacgccattctgctgcctcagcctcccgagtagctgcgactggaggcgctcgccaccacgcctggctaatttttatttttatttttatttttgtatttttagtagagactgggtttcaccgtgttagccaggatggtcttgatctcctgacctcgtgatccgcccgtctcggcctcccaaagtgctgggattacaggcgtgagccaccacgcctggcctaatgctaactctttaaaacaaactgaaactgaaatcttttaaattgtgaattgtaattgtattttacagcaaaaatacaatgatttaagcttgcaaacattttacaattttttttccaaaaatgacatctagatatattactatggtagcttttttggattggctactatgtcaatgagttattataaaataaaaacacattttattatatgtgtggtaaatcatataatattttaagtatgtatgtcctttatacccgtgcaataagtaaacctcttcctgaaacatttactgattattctactgttgcagaagatataatatagtagaaagaaatggaagaaagaaatctcagataagaatattttctttcaaaaaggtatgagaaaaatttattgggtctggaactattggatagagaggaaaaaaaggtgaagaaagccaccaagcagacaggagagggagctgatagaaagcaattttgtactgttcactgaggaagtcattaaataaatattcataccatgagctatttgaaaaaaaaaccaaacaaacctggaattgatatttcacctgaaacaaaggtgtcttttaatctttgctccatgtatttttcttataagataatagttcttaagatctaaattcatggcttagtttttctttctttttttttttattattatactttaagttttagggtacatgtgcacaatgtgcaggttagttacatatgtatacatgtgccatgctggtgcgctgcacccattaactcgtcatctagcattaggtatatctcccaatgctatccctcccccctccccccaccccacaacagtccccagagtgtgatgttccctttcctgtgtccatgtgttctcattgttcaattcccacctatgagtgagaatatgcggtgtttggttttttgttcttgcgatagtttactgagaatgatgacttccaatttcatccacgtccctaaaaaggacatgaactcatccttttttatggctgcatattattccatggtgtatatgtgccacattttcttaatccagtctatcattgttggacatttgggttggttccaactctttgctattgtgaataatgccgcaataagcatacgtgtgcatgtgtctttatagcagcatgatttatagtcctttgggtatatagccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgcctgttcatgtccttcacccactttttgatggggttgtttgtttttttcttgtaaatctgtttgagttcactgtagattctggatattagccctttgtcagatgagtaggttgcgaaaattttctcccattttgtaggttgcctgttcactctgatggtagtttcttttgctgtgcagaagctctttagtttaattagatcccatatgtcaattttggcttttgttgccattgcttttggtgttttagacatgaagtccttgtccatgcctatgtcctgaatggtattgcctaggttttcttctagggtttttatggttttaggtctaacgtttaagtctttaatccatcttgaattgatttttgtataaggtgtaaggaagggatccagtttcagctttctgcatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttagttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatgggagtggcattgaatctgtaaattaccttgggcagtatggccattttcacgatattgattcttcctacccatgagcatggaatgttcttccatttgtttgtgtcctcttttatttcactgagcagtggtttgtagttctccttgaagaggtccttcacatccgttgtaagttggattcctaggtattttattctctttgaagcaattgtgaatgggagttcactcatgaattggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttcacctgcctaattgccctggccagaacttccaacactatggtgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgttgaattttgtcaaaggccttttctgcatctattgagataatcatgtggtttttgtctttggttctgtttatatgctggattatatttattgatctgtatatattcaaccagccttgcatcccaaggatgaagcccacttgatcatggtggataagctttttgatgtgctgctggattcggtttgccagtattttattgaggatttttgcatcaatgttcatcaaggatattggtctaaaactctcttttttgtttgcgtttctgcccggctttggtatcaggatgatgctggcctcatacaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagaccctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgataacccctttatcattttttattgcgtctatttgattcttctctctttttttctttattagtcttgctagcagtttatcaattttgttgatcctttcaaaaaaccagctcctggattcattaattttttgaagggttttttgcatctctatttccttcagttctgctctgattttagttatttcttgccttctgctagcttttgaatgtgtttgctcttgcttttctagttcttttaattgtgatgttagggtgtcagttttagatctttcctgctttctcttgtgggcatttagtgctataaatttccctgtacacactgctttgaatgtgtcccagagattctggtatgttgtgtctttgttctcgttggtttcaaagaacatctttatttctgccttcatttcattatgtacccagtagtcattcaggagcaggttgttcagtttccatgtagttgagcggttttgagtgagattcttaatcctgagttctagtttgattgcactgtggtctgagagatagtttgttataatttctgttcttttacatttgccgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgctgacagtggggtgttaaagtctcccactgttaatgcgtgggagtctaagtctctttgtaggtcactcaggacttgctttatgaatctgggtgctcctgtattgggtgcatatatatttaggatggttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcaagtgagatgggtttactgaatacagcacactgatgggtcttgactctttatccaatttgccagtctgtgtcttttaattggagaatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccagttgttcctttccatgtttagcacttccttctggagctcttttagggcaggcctggtggtgacaaaatctctcagcatttgcttgtctgtaaagtattttatttctccttcacttatgaagcttagtttggctggatatgaaattctgggttgaaaattcttttctttgagaatgttgaatattggcccccactctcttttggcttgtagagtttctgcccatggcttattttttcacgttgcgtatcgaaatgccagctattcagaaatgccatacagttgcttggataaatattaatttagaaggaagaaatgacctagtgttctcatttataattcttataacttgtccggtttagacattatatatggtccaatatctcctacacatcagatttttttttcccaagatggagtttcactccctcagaagtagtcatcattttatacatgtatcattctatttatagataatgttgtttcaatttttcttaatataattttgggtagctacataacaaaaatgtatctaatttttaatagagtacttttgataaagttatacatgatttatatgaatagttcctcacctaaaattatctatcaatttatttctcatatgaaaacaaataaatatgaaattaaaattcttagttatgaattttatatgagtggatcttgaagtagtattgctaggtcattgagaaggtacacttaaaattttgcttttactgccaagttttcctccatagcgatgatactaatactcccactattagtgtattacagtgtctgtctcgtcccactgtagccaacacactgtgctaccaaactgcttgttctatgcctaacagaatggttctaaaagaaagtatgtttttattttaatttatgtttaatatttgaacatccctttatgtttataacacattttttatttgacctatggttcctacccattcgccagtgatgttctgagttgatctttttcctagtccctttacatattaacagaaacaaacccatagcagcaagaggtcaatctaaaatgctttgaggcattgccagattttataagaaataaaatgcatatctgtgaaaacatagagatgtttgtacaaataccattgtcttcttttctccctccactgtaagcaaaagatccagtggagatccaatgaagagaagataattttatcttcttcaatcacataaaataatccagataaatgagcctgttttctcatattcaaagtagccttctgaatatcactcactcaacactgcttcagggaatctcactgggaatttttttcaccagactggtttctctccctctattctccaacatgtcaataattctgatgggataatctttcagagactcaagcttgtcatgtcatttctttgctctaaaagctttaatcgtttctactgcttaaagaatacatttcagatttggcagtgttccattaaggagttctataactgtccttcagcaactcttttctaggctcctttgcagctacaacaatgcatatattttaaattgagtcacagtactaccaaaacctatcattagttgtcccatctctatacttttgctgacatcattttctgccaaaattaatgctctgggacatatttttccttcttttttcttttcttttttttttttttttttttttaacatggagtctcgctctcttacccagggtggattgcagtgatgcgatctcggttcacagcaacctccatctctcaggttcaagcaattctctgcctcagcgtcccaagtagctgggattacaagcacgccccaccacgcacagctaatttttgtatttttagtagagacggggtttcaccatcttggccaggctggtcttgaactcctgacctcatgatccaaaagtgctgggattacaggtgtgagccactgtgcctggccaggacatctctttacaaaaattacttttcctatcaggagattgcaagctgctttaaggataagaaagtgttttgataattttgataaactgctttgcctaacataaacacgggggtatttatttaattaattttttattaatttagagcataatttaatttaattaatttaatacattctgctctaaataatataatgctttaaagaggccaacattgaaaaatacttcataaagaacaattacctttagtgaggtataacacagagtgagctctcagttaagttgttataggttcatttctggtccttgacctaataacatcaataagactaattatttgtccaagctgtagttccctaattggaatcaagatataaaacttgtatattcttaaagaaattatgataaaagtttttttacttttaattgacaaataatagttgtgaatatttataagatacacattgatgttttgataacatcattgatgttacatatactgtagagtgatcagatcagcgtaattagcatatctatcatctcaaatatttatcatttctttgtgttggtaaagatcagtattctccttctagctattataaactatacattcctgttaactgtagtcatcagtggtgtataacaatgctagaactgattcctcctgtctagctgtaaaatttaaaatccattgactcaatgaattttacaacgccttcattgcttgttacaaagcatgtaacattgcttattacaaaaacaagggcagtagaccaacgcttcttttagctctgctgaaacatgaacaaatacttttcattttttacatcatttataattgtccataacttctacaaagttaatacttaacacaaaaagaaggatatatattattttacaatctcttatatagtacatatatagtatatataatacatctttcattataaaatgtaagatgtattattcattttataatgaaagatgtattatacattatatttggacttcaccactgaaccaaagcacaagtagctctgataagtaaaatttcccatctgtaattgaaataaatcttaaacctaattgttgtattgattatataatgctttttcaattcaacaaattcacaactagctaaaatgtcatatttctgtatcagataataaagtcataagaggagtaaataattgaaaactgaaaagacttgttttcaaattaatattaaacgattgaaaattttgaaaactgaattaagaatagagtccattaattcaatttcataaattcatgtagaaacatcagcaataaaaaagaaacaaatatgttgtagaccaaaatgaagatcttaaagaggaattgatttcaacaaaccacaaagcacttctcagcttttcagatcattggctatatttaagaatgggagcagactattacctcttttattcctcttctgcttctatcatctttatcttgagatgccattcttcagaccaatcccttctccacaagagtactgtgtcattaataggaaatactgttgaactgcgtaaaggttccacattcttattttttctatcactagacaaactcagaaaagccatgctgctcttcattgtattcactttgcctcaatagaaaacactaaaagtaaaaatgaaatggaagaccaagacttccccttgagatgagaggaaaagagagagtgtgcaagtgtcaaacacaaagaatgctagctggagtcacgtacatttcagagtcacacaattaaaattaccttcttacctctgtgattttacagaatggtggacagttgcttaacaagggaaagaatgaatgtgtgtgtgtacttgctcctgagcattggatccaaaaacaaagaaaccatttgttgccttagcttgtatggcccttgtgttgagaaatagatggcctgaaagaatcaggagtaccctatctaacatttaaaaggaatgttacttagtatttataaacttctaagaaaaaatgtcagaggtttttacactttaaaatgtgtaggagctcagagtattaagaaaaaactcaaactttctatatttgtttttaatttgttcagtaattttaggcaatagattattgtttcatgcagagaagagatttactgacggttcagtttcatgaaatttatgacactctgataaaaacaattacctagcaaatatttgctcagcagcagatgaatggcatgggaatacagacatgttggactattttgccaaggtacctccaagaagagggaaaaatgatgcaggaagtggaaaaacatgataatctatgatacaaatacatgcaaactttgagataaagataggaaaaatataaaatataattgaatgattagaaccaaaagcattttgtcactgtatttgtgtgtgtgtgttttaaagacaaataccatgaaaactctcaaaaactgaatgtgtagcttaagtaagtcacagagaaagctcttttagcttgtttcaccataaaatttagtatatgtagtaaatacattttataagatatgagataaatattgcatcagcctgattaccataatatggatacttgagaatatttgttgcacattatactaaactttacagttaccagttaatttcatttcttttcacatagcttcactttgaaaaacatgagatataaattcaaagaaaagatgagaaatcaaagaaatgttgagtttatgcaaaagtaaaagtgaaaaaatgagaacaattctattcaacttaggtttatttgatgtttactatgtgcaaggcaagctgacatctgatgacatcaacccatttttaaatattagtagtgtttcaaccttactctgaatgatttattcaaggaacaaaatcttgcaatatcaatttttaaatgttttgttgatgaatatatagagttgcatatttgtgtatgctttcagctaccttttacggtgaaagaagagaaagagttgtcataaatctgaagtatttagcattaacatttctttagtcacaattttagggctcattattaaacttttgaaaactgcaaagtgtaattaatgccattccaatcatcagcatcatcatcaacttaggaggaactaaaccaaatgtattaagagaaagaagtgtaaagtttgttttaattttgaactaatctcctcaaaccttatttctcatttgttcaatgagaacacaaaactgagcctggcctggcctttaattttcagtacattaacttatgtttcatggagtaggtatttaccaccaggagccaactccaataacttttctctttattttaaaatttgcctgtaacatttatttgtgcaaacactttctttccacatctgcttttgttcaatcatttattctctcctcaaggcctctatccttctgatttttgccatatctttaatatcttcagtctctccatttctatcaccttctttcttttagcctaacacatatgcaaagtggtacagtcttaaaaataaaagtaagcctgtttctcctcttgcctctacttaagtaaccactctcacacttcactcatttgtatgcatgccttactttcctcctctgtgttcactgaaaacaatttaactcatctttttatcctcatcacctagtagttacttgcaagtagacaccacatgcttattgaaggaatacatgactgtatgaatcctatcatgttcttttatctcaaattgattgccctcattaagtatagtttttgagatctatgaatgtcacttaaatttactacaataataagtagcataatagcaataaagagcatgccccaatcttttagttcaacacagaaaggtgtcagtgatagtttatgaaggatgtgcaaatggatatctattatatgaataagagctcataatttagttgtaatggctctgagtcaatgataattatttaaatatttttgttgactgataagccctaatctggccatggcactagcctaatttggcaaatgatttcatagaaacaatacaaaagtatatatgccaatgtgtttccaatctctatgactttgcacctgttgctccattggcctgaaacattacttcctctctcttctcctgaataatttctacttatatttcatgtcgagaatatcatttctctagaaatgttgccatcaaatttgtgtctctcattattttctctttcagcaaaatcattgcatacatagcatagcatgtatcattatatataattatttgaacacatactgagtatgtcccttccacagcatacctcccttctttatttttttaggagaacattttatttatttttaaaagtttttctttattatactttaaattctggtgtacatgtgcagaaatacctaacgtagatgacgggttgatgggtgcagcaaaccatcatggcacatgtatacctatgcaacaaacctgcacgttctgcacatgtacctcccttcttcttcttctttttttttttttttttttttttttttgagacagagtctctctctgtcaccccaggctggagtgcagtggcgcaatctcggctcactgcaagctccgcctcctgggttcacaccattctcctgcctcagcctcccgagtagctgggactacaggcgcccgccaccacacccggctaattttttgtattttcagtagagacggggtttcactgtgttagccaggatggtctcgaccttctgaccttgtgatctgcctgtctcggcctctcaaattgttgggattacaggcgtgagccaccgcgcccggccacctcccttctttaaactctaagaattcaactcttatttcatgtatttagcaagcagtacaatgcctggaattcagtgggcactcgataaatacttattgaatgaatgaatgaatgtggatgagcatagacgcagtctgggacaggtgtttaacgtacagctccagtaactgaagaattcacgttttcattgatctctgtagcatgctactttaactcctagggactgcaatccttctcatacatttacattttaatttaaatttctcaagatctatagctctctttgttgtcaggctcaaattatcttgaccattcaccttccattcttttatagagatatcccctggaccttggattaattctgctaaagccgttcctatccttataagaaaataaagagtaaatattaggaaaggagttgcaggaagaaaatatgttttttaaacaacattcgcaaagctcattttttagaattttgttaagaattagaggtttaaaacaaaagtgccataaaaattaacttctaaatttcattagtttatcatattagaataattagaactcgtcatctagcattaggtatatctcccaatgctatccctcccccctccccccaccccaccacagtccccagagtgtgatattccccttcctgtgtccatgtgagttagtgggtgcagcgcaccagcatggcacatgtatacatatgtaactaacctgcacaatgtgcacatgtaccctaaaacttaaagtataataaaaaaaaagaataattagaacttgcacaatcaaagatctggtgggatatacttaaccgaataacagtagaatatataatgccttataattgaggaatggctatttgccattaatgaaaatagactacagggagcttcctattcgaaaaagtggcttatgtgttagcatttacttctgtagtgccattaacttaaaaaatgctaaacttcctttatagatattgagtgaatcatcataatttgctaatattaagtattattcacattcaaatttttctactcataccactctgacacataacaaaattaagacagtctcagtttaaagacatagaggatataatttaggatattagacggcattaactaaatatctcagaatctagaaattctgccagcattgattcagaatgccacctgtagtagcctggcctctgtaatatactatttcatgtgaccatttcagctccgtggatgttcgatgttaaatgagacagtgtgagagaattatgttaatatgcctaaatgtagtccactggttattcagtcaacaaaatgaactaaatccccattatgttctatggtctctcttaaagtgttaatttaacaatatgcactgcagaggggaaaaaataggctttcttagacctagtaggtaaagaacatgaagtaacaatcaaattctattatgagatattgcacataaaagattattacatgcatgaaaaccaggccttcctctaacatttgtggggtctgggacaagaatatatatagtagcctgcaaatcatatctaagtattaaaaaattataaactaagctaacaaaattctattctccaactttggtaactatccctttataagtcccaaaaagccagttgtgaatttggaattttctaactccttttattttggtacgaaaatgtgaaatctggaagaagctggctccaggtccctgtctctaatctgcagcccgcccatcttatttacaacaccaaaaagggctttgtgcacaaaaatgagcagtctagtcctcatttccaagctccattcacctcttccacatcttctttaccactccaacctacaagtatacacagcagtccagccacagagatggaccaagtaaagaggcctacctatgcaggccctgttgacaggccttggatcattttgccacagaattctgagatccaagtgttctacatatgttctagagcagacttggcatggataattctcgttggctgtcaaaatccttttcccgaggggtggggcgtggctagagaaaagccaaagcagggtcctctgtaaagtgtcgggtcctctataaagtgtcaggtcctgataggatgataataatgcaaatataaggaaactcttatggggaaattttacacggtctctctactatcaatgttattaggagagacagcacaacatagtgaacaaacaagttgcctgagtacaaaacccaactttaccacttactctcctggtgtagttattccacctttctgtacctcagtctcctcatgtataaaatgataatactacttattgcatgatgttattgtgaagattaggtgctatgcaaagcccatgaaatacctggcatatagaaaacactaaataagtattagtaatgattattttgaagtgctaaagaatgattgatacagtcaggatgcatcccatgtagggtgtgaacaagttagtatgccacatctaagaaggaagataaaatcattttaatcccagagtgatacttcctttatattatgtgattttaaatcttttgatttcaattacaagtaaagcatttattaaacattaggtgaaataattatacatatatcaaacagcacacaaataatacttattgactgcatgcctgatagcatgctaaaaacattttatgcaacatcacatttaattctcaaagctaacttaaaattatgcactcttttctaatctgtgtgcaaatgagcatctacgaaagcatgtttttcatctggtcccataaaatacattacctgagcaaattaatatagttgtatctgtatgtacaaactttattggcaaatgagaactgcaataaattacaaaagattttactttagctttctacatgagaagttctaaaagccatttcagaactgaggacaattttttgaagtatgctatgcattttcatcatatatctcaggattattgccagatagaagtatcattactcctaatcttaatagattgcaaaactttaagcatcggggtgttcaataacaggattgactaatgtaaaggaagtaatacttagtaaacaagctgattacatttaacataatttaaagaaatctcactgggcaaataacccattgaaaaccagtggtaacatggatgtaaaactactctgccgtaggtgagtaggtctcacctaataaacacttcaaaaccaaggtagagtcttgagtagcaggtgagaataaatcaagctgctgtcagtcaagttattattccaggatagcctacagccagtagtggacataaatggaatatgtacccaggtaaataactctgtgtatagagacctgtaacttgcaaaagtctaaggagtgagacctggtgcggtggctcacgcctgtaattccagcactttgagaggccaaggtgggtggattgcttgggcccaggggtgcgagaccagactgggcgacatggcaaaaccccatctctactaaaaatacaaaaaaaaatctgggtgtggtggtgcacacctgtaatcccagctacttgggaggctgatgcctgagaatcgcttgaacccaggaggtggaggttgcggtgagccaagattgagccactgcactccagcctgggtgacacagcgagacccagtctcaaaaaagaaaagtctaagaaatacacatttagggactgtaagtgttcactgtgggatgctagaaaaatactataaatataggatattagaaaaatagtgtacattataaataaaacttgtctgcagtccttttcttgaaaaatatatagtatttatagattttgttacctgtttcataaaactcctttatgatacattgtttataaattatttaccagtttactcactgggtggtacaagagagtcattttctcagcactctagctaggaatttaagccgagaaaggtataatatcttcatgaggtttttgtttatttattttagttttttcatcaattcaagaaaatatcttacacaggcaggatatgtactagaaaagtagtaatactacataatacaaataaggaaactcaaatgtcttactaataatgcaatattgcaaataagaatactcaaacatcttactaataatgcaataaatataacttgcccattgctatattataaattgtcaggcttaactggagtttagcattttaagataaagtctcatgtataattgacgaagtcccttattttatctcagaaatgatttcataaaattgaagtgaattaggaaaaagaaacatttttaaaagttacttcgtgttaaagtttattcattatatttataatatacattttttattaaaacagtataattctgctgtgtccatctatctttttaacatgttggtaagagagagagaaagtatgaattttgtcattttaaacatggcaatgattatccatttttaagtgattaaccaaaacaagaagaatatgagtaaatatcaaaatgtttttcagtatatttgaaaccaaaaagtaacaaaatcaataacagccaatatttacatattaagaacttactatcttcatagccttttatattctagtcttctactctaacttctttctgcacatgtgaaatagatgtgttataaaattatcagtattgagaaatggtaatatgcaacactgatcttattgaattttggcaaaaaaaaaaaaaaaccaaaaaagtgtatgtgtatggcgtgtgtctttcaaaataagggcatttaaattgaaattataaaatataaattgtaactaacattgtatgtaaaataaatagataatttaacagtcttctaagagctccaaaagtaagtatataacattttgttacaataatcatgtggacatcagtttccagcaattaatctggtaaaagttcatcgataaattcagccatctgagcactgaaaataactcgttattaatggaatcaactggtctacttttcagtatatgagattttactctattaatcagaacagatcttcaaaatgcctaaattaacacctccacaaatgatagcacggactgacattttcacagctcatatacaaattaaacaagtatcctgtgactcctgtgtcaaatatggcagcatttacatatatttttatacaattattttaactttcaatagttgtgcaaattgacttgtactcttgaaggagtacagtttatgggacttttacatgatttgtgcagttatgttaaatgtatctaacatattttcaaaatgtgtatggaaagttaattcttttttcatttcttttcatgaaaaaaagcagtatattttatttttttccaaaatataattggaaataaaatgagctgattcacagacgtatatactctaaagcttaaaaaaaaatcatggcatcctatttaaagcattttggaataactttttctttttgtttagatgagttcacagtcaatgcacaaagtctttaaatgatagtaaatcagactgtgacatcagcttataggtaaagtccaaggtgacccaaaatactaactcaatggagtaactttaagatctgcactaaataggtttaggaactaatgtgcaacctaagacagaacaagggtatctcagtacaatggtgatgtcacattaaaatgctatggcatcaatcactgcaaacaaaacaaaaagcacattaatcaaccttaagggaaaaaatcaatatccaaatgattcattttcccccagtatttctctattttcagaaattacttcatataaattttcacatagcaaaaatattacccagtatcttcatttaaatgttttcacattaattagttataaaataaattattggctagggaattgatacatattgattattcatacttttcacctgaagtgtatttttctggtgcctttctaagtcatagtgcatcatgtgaaacttttagtttttcaactattaccaaactacattatgctacagtttcagtttggcaaagccagtttctgactaatgaggggtacaccacgaaattctgtattgtttagacaagaaattcaagaggaccttaatccagtgaaatgaatactgccattttggcatttcttacatcttaagcccacatcttaggtaaaaatggtttctattctgctgaaatgcaccagaaatggcttcgccttcaattttccttagtgtgttttcatggacaaagttggattaacaatccatgactacagccttgaaaatactgttaatttcatataaacttatagttaatttaaattttggttgctgcttctgctgctgtgtcgttcaatccctctacccttcctgggagagaattgggaaacatggtatagtatatgccatgcctgttctaagtagtaaaacatatgggttaagaatattaatactggagccaaatcacctgggttcaaaattcagtgcttccatttgtacaatttatattctttgcacctgactttccttatctataatgacctgcattacttaataaattgaagttgacttgtgaaattaatttaacttgagcaattgacgtaattgtagcaattgacttaacttcatttgcatatttacctgagttaggtagataaaacagaaaagtaaatatacaaatttcagattttcatagaaattctgctactttttgaaacaggactgaaactaatatattcttctttattaactacagtccatggttaccctaattccttcatgtgctagttactccagacatataacaaaaatctattcatcattgcaggatgggaagctacatgaaataaataaacgtttaaaaaattctccagataaagaacagaaagtgagagaacagaagcaaagtaataataatttttttcaaatcccagtcatctctaggtatccatggaagattgcttccaggaccctccccagcaatggaaaccaaactcaggagaagttcaagtactccagtcagcctttcacatccatggtttctgcatccacagttgggtgaatccacagatgtgtaacccgtagctaccactggctgactgcacttgacttatatatatttgggctcctgtatatccctattgtcaattgtctatacagcactggtaaaaaaaggactgaaaatcaaatattttatatttttattttgttacagccttacatgactctgatcatctctattttccatgttttccaatttaaaaaggaaagaataaagtcttgcttgttctatttctaattttatttccaaagagtgggtgatgttgtgaatctagttgatggtgagagtattatgcaatgaattagtttctatgataactactttttgttttatagcaaacagccattaatttaaaacttgtaaattggaaatccggaacccattgcagtacagctagtagaaacacattctttcagactgtgattacttccataaattcttgagtatcgagaattactgccaaacaaaacatcttcctgatgaaatgtattgactgacacttcagtagaaagaaaagtagaaaatgagactatgagaagaatgtctattttacataatataatttgaaaggcaaactaaagtgatttgtggatttgtttatgttttagggtaaagaaaaaagaagtgcaaaagaaatttataactggtttatcatttgaaatatatgaacttttaaaatttggtagagaatgtcatattctttatttacattaactattaatattagtatttgtcagaaaaaaattctccaatatcaaagtaaatatttcaaatagaaaaaaacctggagaacaaaaagccatactttaaggaaataaagatttctttttaaattgaaagactaaatccaaaagtaatatacaagtgtacacattcaggttaaggtatttaccatgtttgttgaaaaaataaactctttaatggtaaccgaatatatttctaagagttactcacatagttactattgtttatgcattacatatatttagcaacttacaatttttaggggcttcttagagtttcagaattttcatttttttcctcaacaaataaacacataattgaaaaattgaatatatgttttcatatacaataatacttttccgatttaagatgttaatcacagcatgtttttaactacagcttgctcttttaaattcagctcagtctataacaattattatgtatgttactattatgtatgcatatgtatacattaatgtcctacatatgtatttgcgtattaatgtgtatattaatatcatcataagcatacatgtatattacataatacttgcattatttgagttgtatcagcctcaagttcagaatagcatcaattaacatggccaaattacttataggaagaggaagtaaaagaatccctataatttagcaaattaataatttgctgacttcaaccacattactagaagctgtttcaggagatgtgtacttttctccctcatcatattatcctttctaattataaggtggatcttctttttataatgtatttcaagaaaggcatttctaattttacaacttagtttaattcaatgtaatggcatcagtttagttggtcccaaaggaaaagaagcaaataactgaatcgttaatgccatccaaaattttctcccctttgagacctgcttaattttcattatctataacgactgcagccaatggtgcttatgtctgaaagtacagcatttatttgggatactcagcatatcattcataaatttttctgcggtgatttcattttacatgacaaaaatcaccaaggggacttccattactagaaacaagcttggtttatttttgtaaatttattttacttcaacagtcaacagcaggtattgattacccactgcgttgagagcattgtactgtgtattgtaaggaaaccattacataagaagtaaaatatttgctgagagaatcactgacttatcatctaatgaaggagagaaggaaaactttacacaaatgattaggtatcagtcaatccatccgtttgctcttgattcattaattcatcgaagtgtactaagaagtagtctcttttttcagggattgtagtttatataaagacataaggaagtgtttattctttcagaactcgtagtggacaggcaagccatgatagaagtagtcccacaataatagggaaacaatatattatcactaggagtgttagagaagcataatgggaatagttagctctgactattcttaaaggatgaattacattttaatgttgaagattaaagaaagtgtagttcagtagagaaaatacaataaacaaaggcacagaatttggcaagagtagttatgctaaggcagttgtgaagttgtaaatagtggtttagcatggcagaacaaagtgtatgatattgactgggagatgtatggttatatgtaaggatattgtatgcatgttacatattaatggtataaatgtgtgtgtatatgtaacatatgtttacatatatatacacacagagagataacatacatggtataaatgcatgaactttgctgagcaaaatggtaaaaaatcttgaaaagtacagctatgctccatgtaacatttcagccaatgacagaccacatatatatggtcatcccataagattataacgtgctatttttattgtgctttttctatgtctaggtatattttattataatacaaatacttaatgtgttataactgtctacagtattcggtacagtaacatgctgttcagttttgtggcccaggagcaataggctatatagcgcaggtacataatagtgtataagatttaggtttgtgcatacaacactgaaattgcttaatgcatttctaagaacatatccctatcatttcgtgaaacatgactgtatttttaggagttttaatttcattaaagtgctaataaattgggaacatttttgaaagagtagttaatgtggccaaactctcacctctgaaagacatctagtggttacatgttggatgggttgacttggatgaagagtggaaagtattgatacatgtaatagacatgatgataatttagggggaatgttcctgagtcatgttgattctatgtgttctgtgagcctagtctcagactttttcaatctgtctgtaatgctataataaaagaaacttttctaattcttatatctaatgatatcttacataccacaattgcagcaactacaaattaaactttattaaaatttgactctagtacacagtgaaatctcagctccagagcttgacatacagggcccgtcatcctacttttagactaatattcctctatgaccccacctctactccctcttatgtgccaatacatttagtcaatgtacaataatctttctatttgtgtgacaaaaagtttaggaccaatttgctatgctttgaagcctctatttgtggcatatggtcattctaaaaaagtaatgacagagctgagattatttctgtttagaatctactcctatatgtcaaaagtttttgaagagcctactcctaaattctccagtgaactaattttttgctgatagcctgaaatcaagttcaatcgactttcataggaaagaaaaaaataacaactaaacagtcatgccaaatgtacattctttttctaaattcttctggggtcttatgcaactttgggtcttttaagtcatcttctggatcttcttattctgtcttttcaatatatatgtttttttctttttttgcattcacatctgaggtttcttggaacatatgagctgattgatacagctgtgggatccctggtctatagattctttgaattattccaaattgttttctctacttctctttgttgtctttgattttgtaaagtttttgccacaaggatatttcccttttctgaagggtgtttaagatgtaattgaactttgggagtttctgaatggtcacaatagaagtaaaacaggtcagaaagaggagcaagggcagcaggtaatagaggatgatataatgagggcagaagcctaacaagataaaaccattaggcttaagttgtgatttgggagcacctaagtgagagttttaagttttgaaatttttttatttgccttatccaaggaatattttaagaaagtaattttggatcctatatttctgttggaaacttcctcattccctccaaaataatatatcaatcaaataagcagatattggatgtttgttccatcttattctaatgtactttttagatgaataattttgctgtatctgaagttcctcaagtggccgctgtaattctgttatccttggaaagcatgccatttagaaaataaataaatacaaatatttggatattaatataaatacatgtaagatgcaggagtttagtcttcaggatgcaagaactaggactgggacaaacccttgagagtctggaatcacaacttattgcttgtgcaacttgtctttagccctcaacctaatggctggctgttcatgacaaacctggtaatctggtgtttcctgaagggctgggtggctgtttgaagagaagatttctctcaaaccagactttcacagagagaaaaaaaaagctctcaaggtttttgatatgagatgtaacacaacatttgtcttatgaagaggctgattcagcgggccttactttgaactcattggccattcgaagctgactcaaaaacaaacttataggaacctatgtctgccctcttctctatatggacttacacttgtaggaaacgaagaacataggcagagttaaatagtactattgttggcaataaagcagtattccacaaagatgaaggctttccaaagtgttccttaaaacttttccaaagcgttccttaatccttagcttggattagtacaagctaatccaagtattccttaaaaacttatcttctttcctagaagcattgggaaatttgacaaaaaaagtataagctcaaatccaatggaagacttacctcatcaccatggtcagagatccccaagtagaaggctcaaggggtagggtattcataggtgtattgaaaggcaccttaaatcattgataagtcgacttgaataatatgtttttctaaaaaagataatacaattcatattaggatttaagtgctcagtttattgttcagatgagtgttaggaagttcgttaaacaaaaattatttgcaaattcatcttcctaagctaaaaattttctggaatgtgagtcatgctaattctaatgtagaccagtaattctagaactttaaatcgtaattacctagaaggcttattaaaacacatatttctatgccctattcccagaattcaaaatatctgggctaggtccctagaatttccatttacgtgatgctaatgttactgatctgtgaagacactttgagggctactgataaaacatagttttagtcagttttagtcagtaatcccattatgctctatagccagtgaaagcttcacagagaacaaatataactatgagtggcaatgaaattgttttaatacagctcacatttgtcagtttgtaatatctgagatgtttattacttaagaggatattggaatcttactattatgcctgactaatttaagatatccaaattttatgttattcctctaaacaagaaagagatttctctaatgtcaatgaccaactcaatataattaactgagtacaatttactcttatttcctagaatttttttacactatgaaaatagtcaggtcagtcaataagtcttaatataaactgattgaggagacgtgcccattggctttggctgacaatgctacactcagtgcaggttttatcagtatgtgctgacccctgacaatcccattttctccttttctctttcaatatctaattttctcataagctgtatggtgtacattttaatgcttgccatatcccagctcttaccaatcatattcataatcattttataaaaaaagtacactgcctctagatatctgcttatttttcccaaatgcatgctgcccctaagcttagtccattctaacttattgtcagaaccagaatgagtcttgccctgaagggaccctttcaaactcactgttggttctgaatgcatttttgccttcaggctccctctattccttcagaccgatcatccaggctccagtgaatgttgcctttgggttgtctccttcggtttcaatttcaaggcttgcatgctttttaccctcaggttttcccttttcagtttctgtatgagattttaagggcctcgtggctttaaacactttctcattgcagtattttcctgtttcacgctccagtaacatggatatgggcggctgtttcattgatctgatgttccctcttaaaaatttcaatattctcttttcttatttattttttatattatactttatttcaaactataaacttattcactggtaagccatgtagtatatatataaaatgaagtgtctcaccaaatacgtattttctacaggaggaaatgatttccacacctacgcaatcataaccagtggaaatattggtactaaacaaaagatgtgtacttgttttaatttaagcataaatggttttattggaagctagttatgtagctcacagaaataacacagaacttagaaccatgctccaaaaaactaagggtgggtcaaggaggctaaatggaaactagacagctggaaacacagccatgtacatatcaatagaacagtttggttagggcaccaccagtaaagatgctggatactgatgctacccccagaactgctgccagtagatgctggatgccaccagcatcatattttaataatttttagaaatgcctctatttgaatcaccaatatgatgttctaggtccctaggtcccagatgggaacataagattggctgaactaagttcatgcctctaggtctgggtgccagacttcaagctgaagttcaacaagttcccagcttcattgacttggggaatacaagacagggtcctgctgcaattcatggtaagcatgatagtaatgcccagacactgaagtggttcatatgttatgtccaagaaaacattagaaatgtagaaaatatttacaagatcattaccttttacttgtaaatggtatcttacatgtgcttgtactaattttcatttttgaatgtaacttttcttttatttggactgatatttttttcccttactggctgcccaacaccacttttctctttgttctcaactcacctggaatacaaggtaaattatggacactacctgtaggccaaattccagcttatcactaaattgacaagcatgagcagcctcaagaagcacaatttaatctggttacagataacttaaattatgctgtctcttgggatagatggttggattacctttgaaatgcctgaagaattccatgcacctctgtatgttctcatgttgccttcagtgagccagatctgtttatcctgaagattttctagaaaagccatttatctcttcttccaatgtcttgcctttcatgtgtttctgaactctgtctactataaagttcgtatctaaccagtacaaagcaggtttgtattgctcacaaacatattaaaagtttggccttataataaataatgcccttggcttatttcaggatgggaagcgtctgattctttctggtcctttctaagtgtgtttttaacaacactaggacaatgttgccagatggaaaagaaaactgctttatcctacaagtatgtctaggtgactgaaacctatccagaggatggatcgtttgtttcaattatacataaatcaattatgtcttttattgaacatgattttaaagtaaaacttttaattatgatcttttttttagattcaataaaaattagagtgcctactttgtgctaggcactgttctcagggctaagaataaaatactgaaaaaaagaagtggaaaaaaagtgcccactgtaatagagcttatatcctagtagggctgtcagtcatatatgtaataagtaagtgaaacatgaaacataagtgtgtgtgtgtgtgtgtgtgtgtgtgtgtgtatggtcataaatgctgaagtagggaaggatgttggtagtattgaaataggtagaaaagacattgttgaaattttatctagagttgccatagaaggttgtatttaaacagacagtgagggaaaaatccatgtggatataaggaaaataatattctaggtagaggaaacagggttaaaaaactatctgaggcagggacctccctagttttttcctagaaatatagaggaggcaggtttagtttaataagagtgagtattgtggtttggggtaattgaagggatgacgacagaaagaaaattcggaagttactataaagactatgtattttatcctgagtgagttgggaagccctgaagagttttgagcatagtaggctttcttctgactgagtagctcaaccctttggaaagaatgttcaggagctcagtttttatacatcaagtttgtgttagctattaggcagctaagaggctatgtcacataagtggtggtaaaataaacaagtctgacattcagtgaagaggtggaggctggagatatataaatatgacagccataaacacacaaatagtagagaaagctgtatgctattgctgcataactaaatacctcaaaaatcactgtttacatttatatatatgtgtatatatatatattttctcacaatattagagttagggagctataacttgcagagctaagcagctttaccacacatacatagaaagttacatgccaggatttaatttcagagatctttgcttctggagagccagttcaatccattacaagccctgcattctcagctcctcctggagctgtctgctcttcccacagttcctcaccagtctgctgtgtgtcctatgcttgcttctccaatttggccaggttcctttttctgcccaaagtcttccttcattgtcattaatcaaagactggcactcttctggtcatctgagcaggaggcgaggaaaaatgaaaaatgggcaaggtcccacagagctcagaaagataatgagttcaagactctgtagacagcactaaatgatgaggattgaatggaggttggggagaaagggaaactgatggtgggcagttatatatattatataatttataattatacattatatatagttataatttatatatacacatacatacatatataataatgtatatataacttgattaataaaggaaagcatattatccctccctccctccctccttccttccttctctccccttgcctccctccctccccacctctctccctcctttcatcttgtctttttctttttttcagagacatgatgcttatactggtcattggttttaagtatctgggcaagacatccattttataatttgaaaatttattgcaatgaggattcatggtatttatttactaaatggatgggtaggccttgccaattaattttttcttagactttcttgtccttcattatcatggaaacaatatgtagactattcttttacaaaaagcctgaaccattgcttggcagagagggaactttacttcattttacttctgctgtgctctatgaccctcctagtggaagatgcttcattggtttctattaccagcatgcaaacagatttttaaaagtttctcagagctaaatgcacacagaatatggcaaatacttccctttagtcatttatgggtctgaatgaacaataggttttcttctctgaaaacatttgtagagccctttcatcccattcagaattatcctgtggaattcacacaccttctcattgaaagagtccttgctgccaagtgttattaacattcctgtaatatcctatttacaatctgtattttgagtttccagtctctctattaatagttctattaatattcctatactgtttcatcttctctcattagtaataatgccatatatacagactccagtgtggttattttctcttcttattaagggattctacatatccccaaggtttcttttgtacatatgtgatgggtaaagtttaattccagtaatattattgctagttatataaatgccacttgtgattgtaataattgctcataaagtcatctaactgtagaaatcagtggttcataaaacatgatagtaatctcacatatataattcaaatgcaatttcatagtaagatacatatttagtatatattgttcatttgctgatttgaatatattaaaatattgatatttaacatgacaacatagccttctagactggttattttaaagttaattaaactcaggaatgtgaaagagaggagatcagtttacatattataccagtaaatgtgggtatgtatgggcctgtaaataagctgttggttaggaaatatggaattttattttgttaactacaaccaagacaacaataacagtaagtctaatactaggctataatatcagaaaatctcaataccgggcttttgaagaaaaatacaataaaaagaatggaaatattcaagctaagaaatatacagaattttaaatgtgcatatgcatgcaaaatgtatattatctgagaaagtttttattttaaaaatttagatttatacgggttgtagaaagtccacaaattgcagaactgaaaaacaattacactaaagctatcatagttgaaaacatggtcatattctcattaataattaactagcttattatcaggttgatcatttgtactaagatgatgtggaaatagaaaatttgattagtatcagacaggaagaaaagaaatgagcttaaaatatggatttttttttcattatagagaagctatgcaagaaatttgctcatagacctatagggcacaaaaagaaaaaagaactcagacaatgcatcattttgcattgaatttgaatattttattgttgttaaaagcatgtaaccaaaataaacttagtcttctgtccccacattaagatctattcccaaatagtagtatattaaaaataaacaaaaatctgactcaaaagctcttcaaagtgatatgtcttcagtgaaggcttttgaagaggcagcaaaagaagtatcctatgagagagtgcaagtaaggcatcctgactcatgtcttcccaatacctcacacagtattcctactattctaatctccctgcgtctcttcctccaaactccaacccctctggatttccctccttccacaatgttgtaacttcaccacaatttctgagatttttttttctttaagtagcattgtgtaaatacaaatcactttaaattctttgggaattgtccaatccaccactagcccatgatgcttctctgaacaacagatacctgtgatccaacaggttgtaagaaatgacttttcctttgatggccggagggagagggaaacactttgcatatctacattttgtctctttctgaataccactgcatatgaaaatttgtttcaagaaaagaattcatgaaatatgcctcttcatatttcatgcaaagactgagtgtgtggggagagggacagagaggggactgggatggcagtatgtggaaagctgtatcagcagcagtggtagtgaaaatctgattccgcccaactgagtttgcaaagacaccagaagtttctggggtgtgccctcaaccaccaggaaggccagagaggtgaacgtggaatatggacagaccttggcttctacctattgctgctgtaaccactctgatctacttcaggctctcaagaaaagttcttagccaagataaaaaataacacacactccagataagatctacaggcaaagcaaaatcttcataaaagaagatggtatagacttcgatgtgaggacaattttcagttggatttgacttagaaggggagacaatctctgtgaacttgcggtcaggtgcagtggccccacggctgttatcccagcactttgggagactgaggctagaggactgcttgaagctaagagtttgagaccagtctgggcaacatagtgagaccctgtctcaacaacaacaaagaaaaataggcgggcatggtgtcacacatctgtagtcctagatacctgggaggtggaggtgggaggatcacttgagcccaggagttcgaggttacagtgagctacggttgcactacctcactccagtgtgggcaacagagtaagatcctgtctcaaaaaaaaaaaaagtctctgtgaatttataaattgcagattcaataattaaagccagtgcctcttgattaaattgggctcagttggagaacttaggaagttgtagtggagttattcaagatgaagaaaaaaacccaagacaattttgaagcaaattatcttttcaaaaatgagaccatgaaccagattcagactgtgctgatggcttcagcagacctaactaaatctaaagaattcaagacaacaagcaatgttggagcacaacaggcaagatggtctaatgaaagaaatccaaaagggacaattataattgggtagcatatgagaaccaacatgtataccagtcttttagatatagcggcctacctgggcaagggattgggaagcatttctatgtatcagcaaatattttgaccatttaactagtagcattctgacagagaacttaagcagagatgtttgccactggtatgatgtatagaggaacactaacataacagccagtataccactctctacatataggtcacaaaaacttctctaccagaagtattgtgagaaacatttataactctagaaattgactaggataataagggtagagtgaaggggataggacagagatacccaggagaggactcaggataacactatcagtctaccctgcatgcaagcattgaagggggtacattatctgtaatggattttataaacaataataaaatcacttaaagtctgtctgcttttacatcaccacacactagctattctaaacaatgccattgataaaatgccaggaagaatttttctatttaccctcctcccactcttgatacattactagaagaggtcaaaaccagaatccaagaaattgttaaattcagtattttaaggaatcacttggcaaggaagttgacaagaagtagtagtgaaagatacggagattaagaacatagtcatctttactgatgaaataaaagaaagaaaagaataaaagtctaggaaaagaattacacgtcaacatcacaatgacaaccaagggaagtagaagctaatagtctagttatccaagtaaaggtattattgaattgctaaccaagagatgaacagggattttagcaaggacaatttcaggcagagaagttgaagccagatttgctgtcctgggatgaaaactgaaaatttatcacagccagtaaaaggagctttcaagaactatttatttaataatgggaagatgacgataaatacatggcatcattagttcgaggacatgcttctctttcagctggcaagagatttaggctgtatgtaaagccaggtggattccagaggatttcagagaggagattgaggaggagcatcaaagaaccaggatgaaataagagctacagttcaagtaacaaaattgtattgcttactttgtgagtgttaagaatcatataaaagaagaaaacttattgagaaatgtgtaaattggaagaatacaagtttaaaagagaatttactgaaaactcataaataaataaataaataaataaataaataaataaataaataaacgcatgagcatatgtgtgcctgcatgtgtacagaaacattttaggaaaccatacacattaaaggagtcataattcattatatgttcaactacaaaagcaaacatgtctcctcctcttgacactttagcctctttgagaaaatactcttttagactacagtatacatttcttacttaaaattaaataattagccttctttttgaaattttaagaagttgcaaaggggttttgttaagaaaaataaatttgctgcttaatttcatatctctctagaccccatccagtaaaaatggagtaaactgagaaagtaacctctactggcaacatattacaatttgtgtacacatgtacatgactaaataagtgtgcagtttttacctattcaactctcatatcacataaatttatgtgtgcctgagtgtgtgtgacttgctactgcctttcactgtctaattgattcattcatccagaatacattgattaagtagtactggataatgttaattgctgggtcaaatttaccacaacctagattatcatcaactcaaaggaaaacctctttatttaaaatgagtcatgagtcaccccatttgtttagttggttagttttcatgcccttgttgctttgcagctctccacaaccaagttacatcattttcactcttctgtcaatatgttcttactacttttcttctgtcttgtctctttaggggcacttaacttcacttgttagcatagtagctgcatgggcatgatttgccaattcattctgtgtacacatttataattctattggcatcaaatcctaaatattagaatccttaatgagcagcatgtagggaaagagcaacctgaaccagaaaaatgtacagaaaactaaagaaaagattttcattatgaagaagagcagaggttttatcagagaacagtcaaaaggcatctgttagtccagaagtaattgaataccagcaaaagaagacttttttatatttaaagaaatgtgagaaatgactgatgactgtgaatgcctccatccctttatttaccatctgaatcatgagtaaggttcttatagtctttctagcattgaactaaacttgaacccaaatgtttcaaaatgaaatttgtataaaatatcacaatctctaataatacattttatttccttttgatatatcaagattattttcatgctatccacaaagtatgttgtgtcaaaattagaacagcaaatttgcacttacttaaaatattcttgtaaaaaccagtactttggaaggggatagtattatttttattaaaaattaccttacaattttgggaagtctcatatttctaaagttttattcaaattaaatcatgtataaatgttaatttagtaatattaaaatgtatatttcatataaaataaaaagtattcttttttaacttttaataaaattatctaatctaacacttaaaacttaatggtaatttcctattttaaaaaagtttgctttttaatttgctctttataatgaaaacattagcactgattttcataaaataaaaagcaagatgataccaatgtaaaagcatttcagttttttaattaaatgcctgttagagtctgtgtttcccattatagatgaaaatataattgcaaagtaggatacacataacacagtaagaaacacacaagttaatgggaaatattcagattcaccatgaccatgtgcaaatctgaccatattaggagcatgctgttctctccagggctgtgcaaagtaaaatggcatattttcagtagtaaatcatagtcagttgtcctaaaaagaatgaaggaaacagaattccaaaagtcagaaaggaatgtataagcacagaagtcttgagattagaaacaaatagcctccaaacaccagtgaatcttaaaaccatcaataaattgtagaacacaaacatatctcctctactgtcaccatctttatctgcaataaaaggaaatgaattatttcatagtgttgccatctctttatgttgtgttccattaataatagcaatatttacatgtaagtaacttttgaaatctagaggtgattattaactcagaagtaattttaccaaaaagttttaaaggctacatgcacttttgaaaccataccacctacacatgtggacagatatacaaacacagaggcctcattagagttgattcatgctttatgtgacaaaaaggaaaagaagaaaaaaaaaaagcttgattctttttataaagttaaagttgaactataaatacagtgaatgttggacacattttaaaacatacgtgtttggcatattattttgatttcatagttttaactcaatagaagtgtttttaaaattaccttgactctgttgtgaaaacctgataaagcattttattatcattacattctcatctgctcattagtgactgtggaattttttataaattagcatacacataaaatgataaaggaagttatatgttgtttattaaatatagatacacgcatatgccatatattcaaataacttttttgctagtatttatcctttttgtttagagacagagtcttcctctgtcgcccaggctggagttcaatagcacaatctcagctcactgcaaccttcgcctcctgggttcatgcgattctcctgcctcagcctcctgagtagctgggactacaggtgtgtggtaccacgcccagctaattttttgtattttactggagatggggtttcaccatgttgcccagggtggtctcaaactcctgagctcaggcagtctgcctgccttgacctcccaaagtgctaggattacaggcatgagccaccacgcccagcaagctaatatttattctaatggccattactgctgattgtaagtacctataatgttagtgagggtatggccaaacagacaaaattaagatcaacaaatttttctctgttaaatacatgtggaaattgtccatcctttaaaaacagtagctacaactgtttttaaaaagtcttcagtagataaaatcaatacccaacatggatgagatgtgaattagtgttacatcaaggttattccccagtgacctaagccatgtatgtaaagtaaattgtgaccaccatgcctccaagatctgactatgggaacctaattgatcagtggccccagctcttacattgtgaaatccagcactgcatttatgctgaggctacacttcctactcactgccgccaactaattactgagcacagcaggaatactaagttccacagcaggaactaagccagttcctgggaggcatagatctcttttgatggtgactgcgattcaagggcttctcactggccccactaaattttcttagaactagatctaggaccaatccaggggctttcatccaaaatcacttacttccctctcttctgcacaaagatcaaaccttttatttccatgagctagctcccttagccttcttcccacttattttcccttttctatcattagcagttccccagtaaatcacttgcacatcagattccttcttggcatttacttcaccaaggacactgactaatacacaaacatattggtatctttggaatttaatggaggaaactgcttagaaatctcctatagatttctaatatagcaccaaaaagcattcttttagtttttgaaatactcttggcatatgtagtcagaaaatgtggcaatattatcatggtaaccagatcctaatgcagctcaaagcagcctcacatttttattttccttctctttaaaacgctattgttctcctaaaataaatattggcagttctgccaatggagacatgtgcaagggaagcagacaatcaatgttgactaaaaaaaaaaaaaaaaggtgaaatcttccatagaagtctgagagtaggaagaatggctgaagtgtcatctttgtcattgaaatgcaagaatatatgtgtggcacgaagagatatgtaggaaagtgccatgtacagtaagaataaatggtatgggaaggagatattttagagtattcagaagaggagaagtaaagtaaaaattaaaaagctttagaattcaagggaaacttcattagatcactttgtaaaactaaattaatttcaaaagttcaatttctgcctctgtagaagcagaatatattagataatttataatgttgtaatatgaagtctagctctaatattctatgactcatttattaatttattaagtaattaatgcaaaggtgatacagtttggctgtgcccccacccaaaatctcatcttgaattgtaatcctcacaatcctcagaatccccatgcagcaagagagagaccaggtggaggtaattgaatcataggggtggttttccccatgctgttctcgtgatagtgagtgagttatcaggagagctgatggttttataagggtttggtagcttctcctgcattattctccttcttgccaccttgtgaagaaggtgccttgcttccccttcaccttctgccatgattttaaacttcctgtggcttccccagccatgctgaactgtgagtcaattgaacctcttttctttatgaattacctagtctccagcagttctttatagcagtgtaaaaatggtctaattcaacagtagatgcctactttattctagggactaagctacaaatctcctacaagaaacaaagacaagtaatcaacaattgcaattataatgtgatacattctctgaaaaaatatgcctggagtgtcatgggatataggataggagtatttaattcctccctgtgagaagtgtcaagaaagacattttagatgaaagcggagtgcacaggtagactaagatatgggttcaattcctagatggtctagagtagagaaagatagcatctaaaacagcagcttgtttaaaggtattagaatgttaggggatacaatctattggagatattaataccatgccttgagcaaaggatgcccgtgagaagcaggctgggttaggctggagaaatacactggccagttcttaaagcccttaggaaaccaggcatttcattctcaaagctgcgaagagccccagagaaattttactaaaagaagttacacagttaattttggctagaagctcactttgaatgtagtaaatcgttaagtatgtgaagacaaggcagagaaacattaaaattctatacaaaataaactagttcacaatatgggtgactgagtatattttgtttgagtaaatagaaagtaattgtgaaaaaaggcagagagcattagatttctagaagtttgaaaataattttaaaaataatcagatctcctttagaacatgtgaccttaagtgaataaatggaagaggaaatctccctgactctttttctagattcttaccttgtgttagccacagttccaggagagatttccccaccttgtctggcatcattcatggtggttggcgatgactcatccttaccctaatttgaaagcaaaaataggaagccgacaaggttgagcattactggcagactttgaaaatatcagtgtggaatcatttgatagaaaactgacttttccagagttgatcctctggaaaatgaggtgtttttttccccaaattgattcttagattataaatacaaccctcctttcagataattccttaaagtatattactctgaaatttttgctgtaactctttatagcttagaaatgaaccaggccaggcgagggtaatggggccaatgagggtcaggtgaactttaagtggaggtcagaaaaaaagcatgggtgaaggatgattgaaaaagagagtttgtaaatcaaggtaaaaaatataccctgcttcaatttttcctcgaagttgccagtggagaggtcagattgctggatgtcttgacatcatgtatttgtttatgtctctcccatgctgcattgtaatcatctctgttatggcgaatgcattgcaatgtgattattagtttataggtcagtccttcccattgaaataagcttctagagggcaagtactgtgtgttttatgtattcattctcaggaccttacatcagtaccagacatttttcaggtacttaataaatatttgttttagaatacaaaacttgattagtactatttttaaaaagaatttagatagcttgaaaatggcctgttgcttttacataccgggtctttatcctttagctttacttctcttccaggaattaccctactaaacatataaacctcatgagcatccttggctttctgcaaacccctgttcacaccagtgctactgcttattgcagtgcaatagggttaaagcccagccctcaggcttgttttctggcttcagcagggaaggatttaattagccatttaacttcctcaggtgtaggggacagagctccctcttccgataatgaggtctgcgttgccagccagccacactggtttctctcttcaggctgcctctctccagcacagctggtgagctggcttcctgacgaccacttagtccgcactggtatgaaaatggttccgtcaagaactgtcctggccgtgctctgggcagtatcttccccctccctaataacttcaaactggttgtgactccagaatctatctcctgtctctgactattctgctttactgagtgacgagagaagatcatctcatcttctctttttgcacaggtctcaccctttcttccctcaaggagattttgcgtgcaaagggagttttggtttcatttttggtctctctttaaaaattggtatctgtgttcagaaataatgtttcttttcctgaaaataattttaaatggtttctattaataaaaatgcaagcaatacagaaaagtaaggagaagaaaatgaagagaaacagcctgagcccctatatccaggcagaatcatttctagtatttggcaagctacctccatttccatatgcatgcagataaaaaaaaaaagatagatggaccaagagatagacaaatatacttttacaataaatgagatctttatatacatgcttctaattaagtaaaaacaagtattatatttatatgatcttttttgtaccacaccatgctggccatttttaaaccttaaatatattttacagatcaaggtatacccatggttttaaaataacttttttttttttcaaatccactctagtggacctcactcagataatatgtgtacttctccctgttaaacttcaacattaatataattagactagagaacatcaaaaagaagttgctctaatagagcactgtgagtaaaaactaagaagtacaagtagcagtactaatagtaatatagaagctgactctcaacctggaatgaacatgcaaatcatctgtaaatctttctaaaaatgcagatacagactcaataagtctgtgaccggtcctgatattctacaagcttacatggccctgcttgttgctgttgctgaccttgaaatactctttaagcagcaaggcttagagtatacaatgtatcaggcactttgctaggatcattcctcagggttatattcatgatctcattaccaaagcctataactactgcatttataagtgtggaaactgaggctcaaagaacataaaatatatactagaggtcactctactctctgcttaaaaagaggtgtttgaatttagacctgtctggctccaaacagaggttttttttgttttgttttgtttccctgtcatgtaaaacacactaatgcttctttctagaaatcccagtgctgagagtgatgaggttaaaatctgtagcatcattaaattatgcataaactaaaaatgtcaaaagagtccacaaaaccaggacaaagggttaccttaaaaaacaaaacaaaaaaattgcacaagttaaacagaaacatcaatagaattttgcacgtaatatatggattagggaaacattttaaaaagactttgcaaatttatgaatattacagtaaaagttacaattagtaaaagctggaatatatctaacttaagtttagcatcagaaaattttaaagtcaatgtataagccatgtacttcatatatatttgccctataaattatatttttatttttacttcataaagtctagaataactgttgcttactcaaatcatttgctttatttatgaacaacttttcagtatgttaagtgaagtcaatcctaaagattaagtttgttgtcattgtcttaaacatagataaattggacaaattccatgaaaaacacatttatcaaaattggcacaggaagaaataggaaatacaaatactccagcatcaaaaaccttcccataagaaaagtttaagctaaggcataaaggttttaagctattcactggtgaatacaataaaaaaaaagaaggaagtaataatacaatcaaacaaactttttcacaacacatttaacaaatgatcccaaaagaaaattagctgataaagtacttagtgtatatttccatttatatgaagttgaccatttatatgaagttgaacaatggcagaactactcaatgttgatagaaaagtgacagttgattataaagggtttggaatgaatgggaagggagttgagggaacttttctttggtgatgaaattgttgagttgtcaaaagtttatgctcgttttccagaactcaagaatgtgcacatttcccaactgaatttccttaagacaaaaagaaaaaaaaatagataaggtaatttgttctcaaaccaattcatttgcatagtaaattaataaactagcattaagtttggaaaaaaaatgatgtcattggggctattcaattgaataatatcaaaacaggatcttaaaatgttttgaatgataaaattatgattgatataaatatctggcttataatatgattaatttgaaggacataatacatatttgcatataaaatcccattatgtttagtagttgccttatttgtaattacaactgaggttgtaccttaaattgtttcctagttttaccatatttaggaatttgagttcttcctcacctagaggttagttcttccaggatgaataatacaatttttcatgttgctgattattatatgcttactgaatctttttttagcttgctttttgttttaatttctatgctttttaaaaaattgagatatagcatatactcagaaaagtgcgcaaatcttaagtgtaccattcaatgaatgtttacatatgatacacctttgtaaccatctccatggtcaagatatgaacactttctgtatctcaaatgattcctttgcactttattccagccaatagcaccttcttcccacctctaaaaatgatcaccatttgacttctatcactctatattagttttgcctgtttttgaacttcatataaatgaaattgtgcagcatatattctctatttctggcttcttttgctgaatgttatatttgagattcatctttgcagttgttgtgacatattcgctccttcgttttaacttctcattgctatatagtattccataatatggatttagtacaatttatttattctaccattgagggcatttaggttgttgatagcttttggttatacactaagcattcttgtaaatttttttttggtggacttaagcactaatttggtggctatatatcccaaagggagatggttgagtcatagactaagaatatacttagctttcgtagaaattgtctttttagagtttgtctctttgaattaggagccagacatgtgcatgcgttatatttgactggtatgtctctttatggtttggttttttttttttttttttttttttactttaagttctaggatacctgtgctgaatgtgcaggtttgttacataggtatacacgtgtcatggtggtttgctgcacctatcaacccatcatctaggttttaagcctcgcatgcattaggtatttgtcctaatgctttccctccccttgtccccccatcccctgacaggccatggtatatgatgttccccttcctgtgtccatgtgttctcactgttcagctcccactgatgagtgaaaacacgcggtgtttggttttctgttcatgtgttagtttgctgagggtgatggtttccagcttcttccatgtctctgtgaaggaaatgaactcattttttatggctgcatagtattccatggtatatatgtgccacattttctttatccagtctatcttccaagtctttgctattgtaaatagtgctgcagtaaacatatgtgtgcatgtgtctttatagtagaattatttataatcctttgggtatatactcagtaatgggattgctgggtcaaatggtatttctggttctagatccttgaggaatcaccacactgtcttccacaatggttgaacttatttacactcccaccaacagtgtaaaagcgttcccagtttctccacaacctcatcaacatctgtttgtttccagattttttaatgattgccattctaactggcatgagatgttatctcattgtggttttgatttgtatttctctaatgaccagtgatatcgagctttttttcatatgttttttggccacataagtgtattcttttgagaagtgtctgttcatatacttcacccactttttgatggagttgtttttttttcttttaaatttgtttaagttccttgtagattctggatattagacctttgtcagatgggtagattgcaaaaattttctcccattctgtaggttgcctgttcactctgatgatagtttcctttgctgagcagaagctgtttagtttaattagatccaattagtcaattttggcttttgttgcaataacctagaactgtagaaaccctagaagaaaaccttggcaataccatttaggacataggcatggccaaagacttcaagaatatttttatctttttattttcttaatttatagagactgggtctctctatgttgcccaggctgatctcaaactccttggctcaagtaaacttcagcctcccaaattgctgggattacagacgtgagccactgcgcctggcctttgaacctttttaaataaaacttgatgtcacttataaatatctgtttacatcatgcattttttataaagaggctggtgtatattttagagtaatttaaaaagtgtgattgctagtgcaattcatttcaacaagcttttcttgagtatctactatatgcccagaaaggctcagtagattcaaaaagaaaaagaaaaagaaaaacatgcatcacggcacaatgttcttaaattacaacatgtaccagccaatagacatagtgctattagaaactaaaataattgggatgatgtaaaacatgccgcattgaaaaatagcgaggatattgtaatcttttactgcataatatgatgtatacataagaacaaaaaatcagatactctgtatatatgttcaagagagacactcatataaaaacagaagaatgcctagaattggttataaattctgcactttcgtgaattattcactgtttttacaaaacatctaacaatacatcaatactctgcaaagatttaagtttctccaataacatcattgaaaatcacattttgtttctgcaaccaaataaataataaatttattttatattagcacataaatgttcatgtcaatatgatttatttatttttctgatgtatgggcctaaaaacactattttaaatatcactaaacaggaatttttaaaagtatacatgcaaataccagaaagagggattggctcaagatccatactgaacaattgattaaaatacaaatcgtgtaaatactacttttattttagatctgtcttaagtaaaagtagatttacatgtgactggtcatcatctaaactttgaaataaatgtagataaaacaaatcaaaagaaatgtaaaattagaaacaacatttcaacctgaggctagctcaaagctatgaaaatatgaaagagaaattgtagtaatattctttttctattatcaaaggaaactttcttgttttctctctcctataaatattatttatttagcaactttatttccttcttttcatttaatgtcgactgacaactcttaagggaattgtcataaaatatcatatgatcagaaagtaaaactctggtttagatatgaaagtttatgatgatagtagtattggtaggttatcagtaacaactttgttcaccaagttaagactgatgttgcatgcgggaagtgtttgtttttaagatatttttatatttccaaaaaagcagtgaaaaagatacaattatgacagacgtttgaactaaaatacaaactcttgctatgactttatataatatcatttaaaattaagtaacatgtcttttggtgaaatattgctgccatatgcttgacttcaccttcttgatttgaagcaacttatttattccaatacgaactactttacttttgggccaggcacagtggctcacgcctgtaatctcagcacttttggaggccgaggtgggcggattacctgaagtcaggagtttgagaccaacctgaccagcatggtgaaaccctgtctccactgaaaaaaaagaaaattagcctgtcatggtggtgtatgcctgtaacctcagctattcaggaggctgaggcaggagaatcacttgaacctgggagctagaggctgcagtgaaccgaggttgcacccagtgaactgggtgacagagggaggcccttctcaaaaacaaaacaaaacaaaaacaaaccaaaaaaaagtactttacttttgaggagaagctccccattgttggtaaaagtgctgtcttaacactcccaaatatatagaaacatgaaaaccacaaatacacacacacacaagcacacacacacaatttaacctaaagaatcctaaatgtggtaataactgatatgtgaaaatttcaggtaatgatctcagtgtatccaggtttccagactttaatattaaaagataaaaagcactgaagctttttaaaaaatagattaaaagttacctcagtgtttgtcatcctatagatatattcacaaatacaaaaaattggacatttatgtctactgtagtatgacatgatttgttaaaaaaaaagtttctgatattttccacaaaagatacagcatctaattttctttggtatttggaaaatcaatcttatttgtatgaatttctttacaggacacaggagattaaaggaaagagaaatctgatggaaacacatcagggaaaatagttctgtattttccaatgcttgaaaattacagctcattgtgtattttcatttcttttccttttcatgattgcttattttgttatttttctgcttccaaccaaaccaatcatactgttttttacacattactgattataattgagtaatatgaaggttctggtagcccccatgtgtaatttgttttcttctcatactaagtagacaggataagtggtgctagcagttgcattttatgacagtaagtgatggtattgagtttatgtggtcttctgtggcacacacataggcttcaaattcagatatgttggagaaggcatttgggatatgttgcaccccttaacactgttagaaaatgtaaggtttaacaaatgatcaaaatttaaagtaaaagttaagtgatatattgttccaggagcaacaacatcaacaacaaaattacaagcacaatgctactgacatttatataataatagtaatgattaattctttgctaaaacattgacctgaggatatttaatagctccactgaaaacaaataattattatggcattagcctccacacattaagcactactccatagattctggatacagtttgtatattatttattacagtggtccttagtgatacacattttaaatatctctgagatttcttacggagatagaaaatgaccaaattcttatctgtaattttactcatacaaaatcacaggtgaactgtagaactaaaagcatcactaagtggtatggttaggctttgtgtccccatccgaatctcatcttgaattgtaatccccacaatccccacatttcaaggaagaaagcaggtggaagtaattgacccaggagggcagtttttcccaacctgttctgttagtgaatcagttctcaggagatctgatggtttataaggggcacttccccgtttgctaggaacatctccttcctgctgccttgtgaagaaggtgccttgcctcccctttcccttcccctgtaagtttgctgcagcctatccggcagaactgtgagtcaattgaacctctttcctttataaattacccaatctcaggcagttctttatagcagtatgaaaatggacaaatacagcaagattacccttaagctttctttttctcttcaataagccttaaatgttaagtgtatgttggaagttttcatcctatctttgctaatatcactgttaaatttcaattcaattattaattaatggggatttaaaaattatctaaaaatgaacacaaaaattgatattaatgtcatttctatttccttgttcatattagtaatttgatacctaattagtgactatttgtattcacggataatattttttcttgtgtgggaaaggaaattagttttcactgatattaagcatactacttgcagaaagacatgttgaatagatattttaaattgttgattaacaataatctgtgttggtatattggtagaaatgtaaatgtgtacaggtactatggagaacaggttggaggttcctcaaaaagctaaaatagaactaccatatgatccagcaatccctctgctaggtatgtaccccaaagaaaggaaatcagtatatcaaagagatatctggatgcccatatttattgtagcactattcacaatagccaagatttggaattaacctaattgtgcatcaacagatgaataaataaataagatgtggtaatgtggtgtatatatacacacaatgaagtactattcagtcacaaaaaggttaacattctgtcatttgcaagaacatggatagaactggaggacagtacgttaagtgaaataatccaggcacagaaagacaaactacatatgttcttactcatttgtgggagctaaaaattaaagcaattgagcttatggaaatagagactagaaggatggctaccagaggctgggaagggagtgaaatggggagggggaagtgggattggttagtggatataaaaatatagtgagaatgaataagatctagtatttaatagcacaacagggtgattacagtaaacaataatttattgtacatttaaaaaatcactaaaagagtataagtggaatgtccatagcacaaaaaatgacaaatacttgaggtgatggttaccccatctaccttcatgtgattattacacattgtatgcctgtattaaaatattgaatataccctttaaatatatatacccatctacctataaaaattaacaaaatacaataacttgtatgtctataaacttaaagagactccatttaaagagatctcttggcaaatttccatttggataattttaatggtacataattagttagaggaaaacagaacttagaagaggcagatatgaaagacaggattctaagattcatcctgacaacagaaaattaaatctctaataaagaggaaatactgtattaagacttcctgcaagattttccaactctatctagataaacaacacagcaaatccataaagaaatggaattcctgccatatgcactgcagttttagatgctatggttagaaaaaaaaagtggagtagcatgtaatgaccatgatatctatcctgagcatcagtaagcgctgtcaaataaattcaagtgaatctatggggccaaaagtacagaaagttcaaaatcagtaggatcttgcaaattctagaatatgttcactggaaacataagtgacctcacaatttaattggctaacgaatatagaatacaaaattttatgatgtatccagtgcctacctttccagctaaatttatgagccttttcctccttgtagtttatcctcgagccaaaacaaattaactttaggtccttgaaggtgtcacactgtttcacacttctttgcctttgtacatcctatcctttctgactataaagcccttaatcacccgtcaacctggtgaactccaactcattgtttaagacagagctcagagtctctgactgccttcagatagatcagattattgtctcctttctgccaccattgcttcttgcacatgcctgcatgccagctttgtaggaataaagagattgcctttatttatatctgttttctcttctatccttgaactatgtgtggacaggaacagagtactgttatgctttacattccacatgtgtaacacgaagcctaacacattatagatacccaataggtgcaaagtgaataattttattataaaacaaaacttcaaaattaaacatgattttatggtaaattgtttattattgatcataagggctgtgaaaattcataggaagaagagaaaaataaaggcaattgcatttagcataagactgtaaagtggagttcaagttatttattgaatatattaatttgaataggcttgaaagagcatgtagggcattcaaggcaaaggaacaaggtgataatgacaggaatctgaatacgccattacatatttcatctgttatgaggttcctagcaacgactaatcacaaagtggtgtggagagagcatttgaaagcagtggtttagctatggcatcaagttcccacgttcgttccattttctaccctgagtctggtcctcaggttaactcttttaaaggtagcaagattttttgccacagtccactgcgtcagctacaaacaccatcctatcagcagaagagaaggggcagattcccaaatttgctgtttttctcagtatgaggaaagatttaacagatttacctcagccagctccccttaagtggccagaacaaagtcacaaccatttttggacttgggaatgggattaatataactaatatttatcatttgctcctacatcacacagggaggcagcacaaatctctgaggaagagaggaaggaatagctattgaatagggaaccagcagtttctgacacattttaagaaaaataaaaaatagatttgtataagtgttttgaggacgattaaatgaactagatggtctagaaaataaggcattgagcattttagacaacgtgcataacttctatacttctattaagggagaagattttccttagagacagttgcatttgttctttttaagagttgctgcaaattgttgcccacctactgagaaatcagtttttttttttttttttttcagaagaacatataccctgttgtcaggaagctatggagtatatggtaaaatggaaatttttattttccaaatgcatatgcagccccctgaaatataaatataagttcatggaatagtatttaaatatttgtaaacaaaacatcccattgtacattgctttttcaattactccaacaatgttcttcctcatttctcaataaaatggaaaggctgacttttcaaagaaataaatcccttttttgcagcctcttcgatatgtttagtgctttttattgagtggaactcttcacaattaactgtggagctgcaacctcattaatttaacaaagaaatatccttacttccataaacataaagcgtaggcagatgtgtagaaaacatttctcaattttattcacccaaacacacaagctttaatgatcctttctacattttcccaggaaatttggtctagttccttttctctgtttcaattaatctgtaacttaggagaaaaaataataatcacaaatgcatttctcagaagtttcaatctcatacctaaacaatgatctcaggatgatatcatatctacttattgatccttctaacaccaacaaattgaaataaaccactgtaaggtacagcactgatattcttagtctctttccagttattttcaaattattacgtttctataaatcaggtttccttaaacatttatacttaccttctgtcttaagaacaagagtaataaacacacaacttttaaaatgcatagcatgtagtgtaaaaataatcacattgaatattttgttagattagcaggcaggtagggatcttatcaattattaagaaggaatttattaatataatgcttgagactagtagatgtccccgttttagagccattacacccttttaaaaccagtataatatcattttattaaactaaaatgaaattcatagataatataacatacaaaattttaaaaatctatgtaatgaactaactacaacataaaagagaaacaaatgtttgcaattctaaactaactttcatttctgtatgtagatgcttagcaagtctctgtgatgtattatggtggagtagttagatgtttactcctacatacagaatcaccccaggtcctgtgttgccaatgccagtggtgcctaatcattgtaaccgccagtgttctccaaaagcttttttttttttttttgagactgagtcttgccctgtcgtcaggctgcagtgcagtggcgtgatgtctgctcactacaacctccgcctcctgggttcaagctattctcctgcctcaggctgtgagtagctgggactacaggcgcatgccaccatgcccagctaatttttgtatttttagtagagacggggtttcaccatgttggccagggtggtctcgatctcttgacctcgtgatccgcccgcctcggccctccaaagtgctggaattacaggcgtgagccaccacgccaggccaaaaacagatatttaaaatgtgctttctgggagaaccactgccttggattgagacgcttttcattttagtgcaaggaattatggaatctgagaatgaataaatagcaaggaagaaaacctttaacttatatttcccaattctttggcctgtgagtttaggtttgctgatctcttttatctaagacacaattctaagtgttattccaaaagtgaaggaagaaatatatgtgaactatactttacgaaagactgtgaaaattatctaaattattacataaatatagggtagatatatctccattaaaatgtttcagaagagtttcaaatacaatgatatatatacattacacaacaaggaaaaacatagctacattatgacttggtatttgtatgatttcacgtaagtaaagtacatttaaatagcattgagggaaatacgccagaatcttcacagtggttaattctagattttaggattatggtaattatgtttctttctacattcccccttcttattgatgatttccaaaatattacaataaatgatttaaacacacacacacacacacacacacgaagaagacattagataaagccagagaattgacaagggttgttgttcatcaattatttactttttattttttaaatcttccctgccacctgttttttcttctcctgaatgcatttactgtgttacttctgtgattattcttccttctcccatcagttaaatttggatattcttcagtgttcttccctcagtttccctcttctttccttttttaaattctttctcactggtattattcacacatgtgtcctctcttctaagctccaaaacaactgtagtctcaagatgaagttactgattcctaggcactaacttgattacgtcctttggtatcaggtggcacttcagacgcattacacctaccattaagctcatcttgtttatacattagcatattccttcttatgatcactccaactctcaggcttaaaatgccagtgatcactgcaaatcttacttcctaattagtgtataatattgattctttcttcatgacaaccttctctaatactggctctagaagtgttctttttttaaagaaaaaaaaagtataacttttatgtgggtatatccagaatttgtatcagaggaactcaagggtggcaattttgtagcaagagggaaagttgtaatttcaaaatatacaacatttttagtggagaaaacattagttgtttatgttaaaattagaggaggtgaatgaattgtggggaagtgagtgtttaaacttccaccccataagtcactcatcttgattcccattcctgcagtgagcaccgcaccaggcccttgaggcctcatcactgtattctgcaaatggccctctctctagggttgagagcccttaatgtagatttctggcatcgcatccctagaatattttatctttattaagagtttatcacattacttaactgacattattccttgttcaaaaaaatgtgtataattgctctattttaccaataaaatggagatcttcagttattatttgagtgcttgaaacccttactgaagtattgcctttatcttctccccaccaactacgtatccacacgtgctacacttgagcataaataaactactgttccccatatatgcttgtgtcatttcctatcatacaatactgtgctctcttgttctatctgtagaacagtctccccaactcaagaacaacctctatggcagtaattctttgaatcttcaaacagtatagcagttggtttgtagtctttgtgacttttgtttctctgtgctctgcactttgattatttaagttcatgtattagaaatcctatttggccctaggcaacttaagggcaggtatctggatgattatttttaatgtttcccagagcataaatcattgccttgaacatactagaggttcactaaaaattccttgagtaaatccacaaataaatacagatgatgatatttgtgttgtccagtgtactgttaaatacttttaactttacatgttatgttttcagactgttgagttgttttttaattaaatttatccctgttttcttaacattttttgttaccttctacttctagatttccctttttctcaactgaatttacctttttcttcaactgtctcagacaatttttctgattttctagtgagctggtaatattgtgctaataatatgatatcagttttaaagtgtgggaaaaaaagtgctctaagttttaggaagcattgcattgaaaagcctcataactttataagatctttcttttttgttttatttctcactgatttgccaaaatattttcaaattttctctcaaacaattaagtatccaaattttgatcacggcagaacttcatgttttctaagatatggtttatctgattaatatatttttcagtaattaatcaaataggattataattgtggcaaagtttaattttcattttcacattatgttggtgaggaaagaagatttgttaagaaagttacatattcactagtaaccaatttttttttttttgaaatggagtctttctctgccacccaggctagagtgctgtggcataatctctgctcactgcaacctctgcctcctgggttgaagccattctcctgcttcagcctccccagtagctgggagtacaggcaggtacccccacgcccagctaatttttgtatttttagtagagacggggttttaccatgttggcccagggtggttctcgaactcctgaccttgtgatctgcctgcctcagcctcccaaagtgctgggattacaggtgtgagccaccgtgcccggcctagtaaccaaattgttttatatatggctattattaaagattaagattaatattactttgcagcttgagatcctgagtttttctaacatttttgaaattttggaattatcataataaaaagaattacttcatactttttggtgccttgtaagagtttttctaacatttttgaaattttggaattatcataataaaaagaattacttcatactttttggtgccttgtaagagtttttctaagagtctccaaagacacattagcttaatcagtgaagtaaaatatcagtagatttaatgataattttgttattttggaataccatttggatagtaagaaaattttataagcttatgtttaatatttatttttaaatatttgaattatttaatgtaaacacaataatgctgaataataacatttcagtcaaggatgggcctcatacatataggaaggtggtcccataaaattctagtggagttgaaaaattcccccctcctagtgacattttagctatcataacactgttgcacaatgtattaccttttctacgtttatgcatatttagatatataaatacttaccattgtgttctaatccctgcagtattcagaacagtaacacactgtaacagatttatagcctaggagcaataggcacacctcctaccaccatgcagtttaaaaccagataatcagtatgttgagcccattgagcactttagtactgcatcctgcattggtatgattatcttatactttgcacatttttattttataataatttgtattcattcattcgtctactttccaacccacttgttccaggtcaggatagtgggtcgctggagcctctcccagcagctcccaaatgcaaagtggaagccagccctgaacagggtgccattccatctcacacacacccacactcaatagactgtgatcttttagacaagccaattgtattaggccattcttgcgttgctgtcaaggaatacctggagctgggtaatttataaagaggtttaattggcttatggttctgcaggctatacaggaagcatggcgccagcatccacctctggtgaggtctcaggaagcttttactcattgcagaaggtgaagtggggggccagtgagagcaggatcaagagagtgagggggacaggtcccagacttgtaaacaatcagatcgtgcgtgagctaactgaaagagaactcacttatcagcatgattcactgggcagggattgatttgttttctcatcaacattataatgaaatggtattgaataaaatgatgtaactccaggacctgctgtactttaaccaagaatataaacatgcatgaactagtgtagttattggtatggaatcaaaggaatatatatgagatctgttttgatggaagcaacaatcaaggtggagtctaatatgaatttgatgttctgatactggtccagctaaataatggggttacagtaattatattaataatttcaaaggctctataaaatgtttaccatatgccagatatagcttcccactcttttacatatataaatgaatataatctttataacagtatcgtggtggtagcattacttttgtccctatttcatagatgaagaaaatggagggttggagaagttcagtaaactgaccattatcacccagtaagtggtaaagcttgattttgagtccactgaatctggctgtgggttttttgttctttccttactgtactagggaaacagaagatcagagagaaatttagtcctgtgaagaattttgaattgaggttatgccaagcacatagatttagaatacattatctctaaatctcacagcaattctcacattgattaactcttatgctcttaaagaacagagaggatacctgagttatctaagcagaaaataaatgggagtcagagctgcaattcaacctcaggtagcacatggttcaaaagtccctgctttccctactttatctggtataaatttaaagagtcataatttttatatggttcttccttgggccatttatttactcataaaataaaaatattggaagttgcttatataccagatacaatgtgaggtactgagatttttgtgataaacagtaattgaggactcttagatgacaaacaagcacagaaacaattgcaatgttgcaggaggaagtggaagggacataatactcatagttcttttacagcatttaccaccgtcatacatttaatccaggtggttgtgcacaatcatctccctagtacttcttgatatccgttaggacccagagtatacctttgtcttttctaataataaatgtggtaccctgtacaaagtaactacttcataaatattagcagaagtgaattcaattcattgcaaactttgtatttcaaaatgtattacagttaggtctgttacccaaggctaaagaataacaagacattttttagttgaaatgagaaagtaaataaattttattttccctaagacacagtcttcttcctgcagattcaatttcacgggcatgcaacctatgtggccacagagtcccatggtcagaagggccaaatgcttagcctaatgctatgctgtcactgtcttgaaattcttaataatttttgcactattatccctaaattttatcttgcactaggctccacaaaatatatgtggctaatgtaaatagcctttttggaggagaggtgctgagaacagatgttaagggaatattaaaccttgggttcaggtacaactatttcacctcttctagcaaccttccacaagaaaaccctcacacacatatacttcacatggaggtcagtgtcttttttctatgttctcctagtgcactcatcactcactttgcatgcaccaaaggttgatgtgttcttatctgtgccctgatagtgctgataatggggtcttttggcaagcaatcattgcaattacagagactggtaaatatgcttatatgattttggaggaatactggtaaggtcgaagtatatgacctgttaagaattttttccttcggccttgagatcaaggccgtgatctttaagaccaagtgaaatcttggcacattccttacctgccagatgaccaaaaaattaaaagtaaaaataaggtataaatcttgagagggaaattctgattttgtcaggaggatgcaccttgtagtaacgattcaccaaaggctaatgaaacgtagaaggtgtgggaaaagcaacagcagcagcagccacagaaacatgagaaaaggttgcctcccaataaagagtggcaaacgcatatgttatgtaagacctgtacattatagcaactcggagcaatctaggcactgagtagccaaatgctgaagactagtgggaaaaaagaaatcactgcatgtcaaggtagaagaggatgagaaattaataggatggagaccttgaatttaaccacatatccttgcaagatgtttactgtcatttttaaatttttgcttaagtaaggaaatcaatgtttatcaattctctactcaattttgctttcagagcttatttatgttatacacaaaagaaatatatgatacagttattagtctcttcattgggcatcagtgaaaataaatcaacacaaaaacacaacttctgtaaaatatttggttgagagaataattagttaataaccgattaaaaaaattgaattggacattagccttaaactgataatattagtgtataaataccagttcacataatattagtaaattcatgagagaacattgaagttatactgtattcaacatagcaggccttttgtgtctaatcttaattccaatgacagcaacataaaactaattgtaatttctatatctagtatacaaatattttataaacaattatatttatagcagaaagcataccagctattatgagccactgtaaaatcttgtaaatagcatttatatagtatttattatgtcttggcaaacactttatacagataatcatatataactataagcactttatatagatcaactattttattctcatttaacgctttaatcctataagataagcacaatcattatactcattgtttagacaaggacatggacgaatagtgttttcacgacttgcctagtgtttcttagcaagtaaatgacagagtcaaaattcagtctcagtcccagacaccagggatccagattttgtgcttttagccactttactgtatatcgttgctgaagaaagtcatttcgcattaaacaagcattaaataagctaccagttagcaacttgtgttaccatgttatcattagaaatacattggtaattttaaagtatctaagtgtatttttaattaaagtttagatagcgagtaaaactctaaacaatacgggacaaatatccataccataaatatttcacatgtaactttactttttatattaaatgagtgttaacatttaaaaattgtcatctgggctagccttgtcatttggcatactctgtttacttgcaaggtagtctttataggtgcaggtctatgataattattaaatatcagtttttcaatggttttcctagccatttattcagggaacagatagacatttactatggtgaatctggaacgtacctaaggtaatataccactttttagaaaaattctgtttctctttttggagtctaataccttggggtataataagtgcttaataaatacttttaaccatgatgattgtttttaatagataaatgtaaaagttcataagaacccacttcctcaaatattttgttcattcatatgtcactaattctgaatattatgtaaaaagagacaacggggatattcattgacatcaagaaccacttatgttttttaatgcgaatttttttcttttaaatgggatgtcttattacaaagtaagtagatcagcagccccttgaagttattatgggcctgttgtggcttataaaacagaaaggcagtaaaaggcacagaagcagaaattggggatgcaaaagatttactaaattttacagttttctcagcattaactctgttcatagctgtaagtgacataataacttattgattattaatcaatttcagccagtgaaatacattgtgaagttttaaaattatttgcttatcagatcatgtgataaagacagctaaatacaataacagaacaaaatccacaaatcccttatacctgtgcaagttgttgtgaaatgtttctgtattaaggatcttagttataagggaaaagaaaaagttatagcctgaaaaaaaaagaaatgtgtcaaaggacaaagtacttcatactgtcaggaaggtaatttctgatgtattgtgctcaccagaaaaaaaaaaaaaaaaaacggccgggcgcggtggctcacgcctgtaatcccagcactttgggagaccgaggcgggcggatcacgaggtcaggagatggagaccatcctggctaacacggtgaaaccccgtctctactaaaaatacaaaaaattagcccgtcgcggtggcaggcgcctgtggtcccagctattcaggaggctgaggcaggagaatggcgtgaaccccggaggcggagcttgcagtgagccgagatcgtgccactgcactccagcctgggcgacagagcgagactccgtctcaaaaaaaaaaaaaaaaaaaaaaagccttatgtctatgaaagattcctgactttgcaggaaatgcaggaaatgaaatcgagacctaaatcaaacacagtgataaagatgtgccatttgtgtatatctgcctttctaaactgaagaatttatagactgaacaaacaattcctaccacttgcggtcctgttactataactttggtcattttcccctttgctctaggattagcaattacattgaaattcctacatgaaaaactggaacaactgcacaccttgaatccaggtagacctggatttgattactggggctaatcaggaaaacagaacaaatgtgaaatagtttggtggtctctggtgctagttttgctttggaaccaaatgataaagttgttgaaaggtctgtaaggcacaaggaaccaagacgaacccagaaattcacagagtagaaagctgttacctcccttaagactggcaagtcagagagttgaggagtgttacagagctccagagtagagaccaccacttgggaggagctggaatcatagtgaggctgctttgtgagagctgagcccaccaagggagaggttgtctatcaggagctgaaatcacagaagaggcacttcatctgcggggatgctgcttagagcagaggaagggaacttactttggcttctttttgtcaccctccagtttcctgctaggtgtctcattagctaaaggctggttggcaacagaacttgagcaacctagtttttatgtgttggccatttatgatatagaatagagcagaggaatgacaaacaatggatacgaggagaaaaagccaaagcaaaatggagaaaaacaaaactaactcaatgatcttggtcaaatagtttacatacctaaatctccatttcattttcttcaagattggaggaatgctatccaaattacagcatttttattaagattaaatgaaatcagattaataaagtatgatatccctggaatatattaagtggtgtattaataatgatttttcttccccaattttgcaaacaggagccaatacatgagaaagaaagaaaatgtgttttttgttgtttagtttattgttttactaatagttccttagtgcagacctatcataattgtatgacttcttcagtattttaggtgcaatttttaaaagtagtatcaatataacctttctaacaatttatcttagaaaagttaatcggtagtccaatccatctcagattacaatccatagctaatataagtatacctcatttattgtattttgctttattgtgcaaagatatacagagtacttgggtattctgtgtatctcctaaatatctgagcttatatatgacaacagtagttacatcatttttatggaacaaagacttacttagtttatcacacttaagagtacatgttacattatttttgcattaaaaattgtcaaaatgttgatcaattgcacttataaaaaactacctaaaaactggccaatttgaaagaatgtatgtaaaagaaagctcaatgaataaaaatgtacaatatttgaaaaattggaatcaattttaatatccattaacttagaaaccaactaaatatgatttaagtatagaatactatgaagtcattaaaattatgatacttatgtacatctacaaatggtaaaagttgtgtatgttatattactgaataaagtaagcatattacaaaacatcatggagccatttttgttatagatgtgtgtttgtattcaggtgcagaaaatatatacaaaaatctaatgataattgtagctatatctgggtggtgttattatggtttatgtttgttgtaccctttctgtgtttcagtactttctggtactttataataatttttttgagattgttacattaactgtttaagaaactaaatgccaaaaatggcaacttttactttaagaaatgggttctccaattttcattgcttatttattttattatttcttgaattttaagataaattatttgtatagaatttctattctaggacatgtagtacatagctgttagttgaatgagagagcacatataggagggaccctagaaattttattaattgacttgtgacttatagatgactagaaacaactttcctctaatttaaacttaccaagttacacatacaggagtgaaaagcagggttagttctcttaaagcatagttattgtttaatttagttgtaatagatattaattaaatacagaaattatttttaaactttaacaagggcatttctctatgatctctgttgccagacactaggaagtaatctctgaaggataggaagcaaagcataaatcaaataagatagtctctgttgtacgctggacaacacaacagaagattgaaaatgtgttgctattgtttttctgtttttttttttatttcttattttgttttttggttgttaatatatggctattcagttaatatatgactaactgttgttttcttttgacattaaatgtgacccatgttgggaaggctaaaaaccagctaaatttacaatgcagagggtaagaaaagttaaccagagtccacaaagttgatgaatgtaggagcagaaaggcaatgtcaaatgaatgcttttgtgaaattagcagtgacaaacttagggacagtttgtaataaccacccctgagtttatagccctttacatttcgtctggcataatatatcattctatttttattttaaatcaccaaatgaggcgagttagggaaatgcaggtcagggcaagtacagttatctttatgaggaaccccaggctcagagaatttaataacttgtctaaatctctgactttcaaattagtgccctttcccctgtgcctcatggccatactcgatcacttcaaataagtacttaaaactctgtgaggcatttggaaataacatattgatatataacatataagataatataatatagtagaaatatttctgaacattaatgatttctacccaattagatactgttagtacacctatttatctttaaagaattggcttcaaatcccttatcactaccaccattaagactgggtcttttgtcactatctatcaaatatcctatgggcataagtaatttttgttcattaatatctatcattctcacaaaagtaaccataataattataaaatgctgttttcaatataatgcattattgattaatctcattaatatgtcattattgttagtagtactacccatgtataatttaaattaatgtgtgtctaaaacattgattcagtctgagggaacttggatttctgattataagcaattatgaaaccttaacacccagagttaagcctgttgaaatatatttagaaatacttaaactctgaaataaatgtaatagccccttgtggcataagagaagcagtttctgaccatctgaccatttttaggtagaaacaaaatctcagtgattaaagtgctgctctattgagaaggatggaaacgtctcgtaatatcttaaaagataagacagcgctaacatgtggcatacagaagacagccatgtcaggaaaaaagaaaaatttacacaagaggaagaacaatagtgacagtgttattaatggccacggaaggagtagctgtttgtgtcaaataggcataccctgaatagtaaggaagaaagtccggggtaggtggtaaattacaagtattttttaccaaccccgtctcctgtggatactaaagagccccccagtattagcacttaaagttgtgtgtgatcaagagatacagcagtcattagtgtgagaaaggagattaatggtaagtaaaagtatattgttcttaatataattcatttattcatggtaagtaaaagtaccttttccacctttcattccatataggccccacaaccatgcatattattattattattaggtttctatctttttttaaaattatactttaacttctgggatacatgtgcagaacatgcaggtttgttacataggtatacacgtgccatggtggcttgctgtacccatcaacttgtcatcgacattaggtatttcttctaatccatgcatattattaaactaaatatactgtatactaatttaagaggtcacacctaaaaaatattatcagatatgattgatgcaaaacaaataaaagccttacctttctgatgtatgtatgatttggaaatgttctacctaatgcatagttgtcatgtaggatcatccactattacctctactcctcccccaagaaatgtatttcaattttactattcttgcccctgtaaattagagattatgtactctgttattgaaaatacaaaatggtgagagtgatagatgtatccaataggctgtaatataatgagagtacaaatcattataaatatatacttatatggaagttacttcttttacctggggcatgtatgaaatactagcatttacggtagctcttgagtgatgagtggaatgccagctaagaaagagtaagggcagaaaatcaccactaagataaacgtaggagaagagacataaaagtacattaatatcaggcttgttgagtagagtgagggaaactaagagatgtaggtgcctgtgtatagtggtagaagcttatatgcatatttggattgtataagcatggaaagagagggtgaattaacaaatgaaattgggactgtagtttggataaagatttagcaggcaagctgagtattttggacattattttgtgagcagtcaggagccacgaactttatgttcagggcaatgacaagaacaagataacttacattgagagacatgatgtgatttttcaaaaaattaagtattcatagtccttcaatatataaattggttttatttctttttcatctattctgtttaagtgcattggttttaaatatgatataatgtgatattcattcaattttattcaaacagcatcaatatttaaattgtctgtaatttacatgaatggttcaacatagatgttttagttgaattaatatcttgcaataacttcagtggaaatgcttttgttcctttgaaaaatatctactagttaagtaaatgtatccaactgtgaaaataatgtgataaaaatatcttaatatacattaaagttcattggttttgaaaaataattggttttagatacaaagctattaaaattagtaaaaatgcctaatttaggataaaatttgttcatttctgtgcaattacttttggctatgatagaaagtatttgtgatgaaaacaatattatgactttggtgacagtaagtagtacttctgtttcaggaaaaataaaatagatgagattcataaatttaatggaccagtaatttaaaataagcatccaagatgagaagaacagtcgcctaattgtttccttttaactagaaacatgcagaatataatattgccacagagttgtctatgattgcatagatttcaaagtgttttcataggttttattttatttgatccccagggtaattctttaagataggaaaaacaagtggtaaaatatgttaatattttaatgacttttccaaggtttcaagtctgacagtaggacccagttgtgtttttattttattttttatatcttctttactgggagtaggctattattagactttcttttgcacaaaagcattccaattttttttcagtcaaggcattcaaaaactagtctactaaatacgtatgaagggtgtatctgatttttctcgctgtcatactgcttgcatttggatgcattaagacttaagtttattatatgacaggctttagtttccttgctgatatactttgcagataatgatttcaagactcttgcaaaagcattgtagttctcaatttataaatttaattaggaggaatgtcctgttataagaatttaaaatcacaatcatatctgttgtgtatgtgtatacagtgctacactttattagctatcactatgttctgtgcatatttgcaagtaatgtgtctgtgttaaaaaacattattcaatctacactgagttcacttttcttataatccaaataattggagttagataaatatcataaagaaaaccactggtgtatccttttatccaaatgtcaccttgtgtcttttaatccaatgtcccttgcacatacagtccaacaatttttttagtgttagggaggcatacaaatatgtcaaagtcatcaaccattagacaatatgagtacaaactgagatggggttggagattatatacgttccactggaaaagagaagaacaagcaaagcaaaaatatgatgtattaccactaattcaaaacctgaaaattttctctagggcagaatatatttcacttacctatacattattacaatgatttaattttgaccaagaccataaggatttttttctgtgatatttacataattttgaaatcaaatccataatagcataccatacataatacaattttgtaacatccgtgcatttacagagataataaatttcttcatattttgagttataaaaattactttaactatattactatattctaggtgaattaatattagaatgcttcaccaaaacctttatatctatttttgaaaacttaagccattattgatacaattaatttgagaaaatttattttcaagaaccatatttgctttattttggtaatagaaagcaccttagttttaaatgctaatgtctttcctacataggtaaaacaatttatactttaagttaggtgatgtctttctcttaggattgaaacctgtataaattgaaggtaaaaggccagtttacatagtaagaaaagtggtgagataaggaagtaaataagattttaaaaatcaatataacattaaactaaaaacaattaggtgggaattatactccttatataatttctgagcgaaaaaaaactaaattttaagcctcaataaatttgctgtatctaggttctgttagaaaatgtggaattctatatatctcatttgccctgtagttaactgagagggggaatagaggtttccttctctaaataaataattaagcagcatttaccaaatcagagacaacacatttctcattcatggcttcaataatctcaaagagttggactttttggtcataaaaagatatttgttgacttacttactgatgaatgtttaggtctgtaaactggattgaaacagatgaatttccatcaggcatatggtattattcctgaagaagcaggtattaaccttgagaagcgacatagttgacaaagtaggccatgcaagacagtgtaatcagagcagtacaggttggaagtctgctttttatttcctcgaggtacccagactaattttccacttacatagaccacaacactagtggctgaaaaagcagaagactttatgataaggtcacctacaccacaggggacaactgcatgaaaagagaaaaatcagctctctgctacgaggttttcatcgtctgacttttggcaaataaaaactgctagtaactgctgtttgtctctgagggaagaaaacgatagtcttcgattgtttaatataaaatattaattatctgattcctgaattcttcttaaagacaataatgagtcactttcctttaatctcttatgtacatttttctttcaattactttagtctatactcgtattcatagcatgcttaagtttcccataaatcttaatagaaagtatttttcagagactaaaaggtttccacaagagatactaatggtttcacactagtcaccaacttgattttttctgcttctcagctgtctttagtttcacagtccagagaccatctgtctagacaggtgttatcgcactggtatctaaaagtagaaactgaacatcattatttttgaaatctatttagaaactgcaactctagtgataaagcagtactggtctaagttgtgcactgttacaaatcacttccttagaacagatggactacaaaatggcttattttgcatgggccagctgtgaacttaagtagagaataggaattgtggatgtcaattacattgcacagaaattttcagtcaagaaatttaccagataaatcaaaaggagtttgttatgagtaggcatttatctcatggatttattttttaaataatgtccactgttaatacagggaaagacaaatatgaattaatcttaaagatattagtataaaagtaaattctgctaaaaaatacttcaaggcatataaatgtatgggccttgactatactccacaaattttagcttgaaaggcaccattctcttcattccaaatttaaaatacctgggtattgatatctgagtcttttctactgtgtaatattggagaacttaccgttatgaacaaatttatagataatgttgcaaaagaatagttaattccattacatagtcacactgtgtcaccccaggaacgtctttacagcataaaaatataatgtgtatacacacacacacacacacacacacacacacagcataggcacttagcacagtgctgcacacatattatacaatctggtattgtgttcattgcccagactcccacttcctagttaagttgccttgagacccttacttgaaattgtggtgtcccagtatttgctgtttttctatgtaaaatagggataataagcctttcctaaatcataaggttgctgtgatgataaatgacacaatacgtataaatcacttcgaaaaaactgacatttaataagaaggcaataaacattagctgttatcattgctgctattatttctgtattcaaagtgggttggcatgttatgttacaaatcacctgaactcaaagtaccttttcctgaaagaaaaatagatatcaaatttggacagatttggttgaaatcatattctattatttcatagttaatgttggtgtcttggtacattaaatcgtaatttaaaacatactttttatggcaaagtatggatctgagttaaaatcattaaacatttgggaaaaaaattttataaagtaatgacccaaaaaacaatcaacgcttctttaggacctgcaaacaatatttttaaagagagaggaaaccacttatctttctaaataaatattttttctacatgtggtttaaaatattttttctctctctctctttctttctctttctctttctttgccagccctgctcccaaggaaaacaatagataagaaataatataaagcaaattccagagaggtagggggaacctaaggtaaagaatcaaatcatgtaagaacaatattcttcaacttcttgatctaacataaaacttaaataaatgttagcttattttgaccttggtgtttatgcatactataaatcctaaatatattgttttttggctttcatttgttttttactctatattaaatattgtaattttcaattagaaatgatatcatagcataattgaatgtattttaggatgacattattacttgtaattagtaatctattaagctttaacaaggtcttaggggctgaagcaaataaaggagaaaataaaatcaactttttgggatccaatataatttagatgagcaggaaatataaaatatgttgaacaaaggctatttctccataatacgtttttaaactactataaaaatatattcaaataaaatttaaaccaaagtgtacaataaaatattacctacttataaatgttgcacaaataaaaatataaatagcatactaaagaaaattaaataaaatgcacttggagatatagaaacatagaactatctctgatgaaaattgagtcattctaaaatgtgctgaaatatatttcttacatgacttttgtaaaagcaataagaattaatatgattgtattagtccattttcacactgctgataaaggcagacctgagcctgggtaatttataaagaaaaagaggtttaatggactcacagctccacatggctggggaggactcacaatgatagtggaaggcgaaaggcacatgttacatggtggcaggcaagagagagaaggagaaccaagtgaaaggagtttccccttataaaactatcagatcttgtgagacttattcactaccatgagaacagtattggggaaaccacccccatgattcagttatctctcaccagtttcctgccacaacacatggaaattatgggaaccacagttcaagatgagatttgggtgggaacacatgataaaccatatcattctgtccctggcctctcccaaatctcatgtcctcatatttcaaaaccaatcttgcattcccaacagtcccccaaagtcgtaactcatttcagcattaactcaaaagtctacagtccaaagtctcatctgaggcaaggcaagtcccttccacctatgagcctgtaaaatcaaaagcaagttagttacttcctagaaacaatgggtacagacattgggtaaatacagctgtcccaaatgagagaaattaaccaaaacaaaggggctacaggccctatgccagtttaaaatccagtggggcagtcaaatctatgaactacaaaatgatctcctctgactccgtgtcttatatccaggtcacactcatggaagagatgggctcccatgaccttgggcagcaccacttctgtggctttgcaggatagagcctgcctcccaacccctttcacaaatcggcattgtctgtgacttttccaggcacatggtgtgaggtgttggtggatctacctttctgggtgctggaggacggtggcccttttctcacagctccatgaggcagtgccccagtagggactctgtgtgggggcatcaatcccacatttgccttctgcacttccccagcagaggttctccatgagggcctcacccctgcctctaacttctgccaggacatccaggcatttctatacatcctctgaaatctaggaggttcccaaacctcaattcttgattttgtgtgcctacagtctcaataccatgtggaagctgccaaggcttggggcttgcaccctctgaagacacaatctgagctgtatcttggcccctttttgccatggctagagtggctgggacacaaggcaccaagtacctagactgcagacagcagggggttctgggcctggaccacaaaaccatatttttttctcataggcctcttggtcagtgatgggaggggctgctgcaaaggtctctgacatgccctggagacattttccccattgtcttggcaattaacatttggcacctcattacttatgcaaatttctgcagccagcttgaatttctcttataaaatgggtttttcttttttaccacatcatcaggctacaaatttttcaaacttgctgtgtttcccttttaaaactgaatgttattaacagcacctaagtaacctcctgaatgctttgctgcttagaaatttcttctgccagataccctaaataatctccctcaggctcaaagttccacagatctctagggcaggggcaaaatgccaccaatctccttgctaaaacatagcaagagtcaccgttactccagttcccaacaagttcctcatttctgtttgagacgaactcagcctggatttcattgtctatatcgttatcagcattttggtcaaagccattcaacaagtctctgggaagttacaaattttatcacatttttctgtcttctgtgccctccaaactgttccaacctctgcctgttacccagttccaaagttgcttctacattttcaggtatcttttgagcagcaccccactctactggtaccaatttactgtattagtccattttcacggtgctaatgatgacagactgaagactgggtaatttatgaagaaaaagaggtttaatggactcacaattccacatagatagggaggcctcacagtcatggcagaaggcaaaaggcaaaaggcatatctcacatgccagcaggcaagagagaggagaaccaagcgaaaggggtttctccttataaaaccatcagatctcgtaaggcttattcactaccatgagaccagtatggggaaaaccaccccagtggtttatctcccattatctcccacaggttatctcccacaatacatgggaattatgggagctgcaattcaagatgagatttgggtggggacacagccaaaccatatcaatgctgtgtttctgtgtcattgcttgaataaaactttttgattatgttttctttgtataatgtatgtatacactagcacagcaccaaggtggtagtgggcattcaataaatatccattctcttctcacccctatgccatgctgttgcctttcctttacatctttttcttcaggtcaaatatctttattattttcatcctttaaaatgtttctttgcatcatcatcttatttattctcccatgtggaccttaacaattttttatttcaatttagaatgagatttatagcatggattcatataaattgaaggaaattttcacaaatatgaatatcccagtgtagtgagttgaattgtgcccttcaaaggatttgtccaaatcttaaccctggaacttgtgattgtgaccctatttggaaaaaagggtctttgcatgtttaagtaagtgaaatatcttcatatcagatctttcttgtttaaccaggtgaaccataaatctaatgataggtgtccttcaaaaaaaaaaaaaagatgtagatagagaaagagacacataggggacaaggtcatgtaaagatggaggcagagatctgtaaaatgtatacctaagccaaaaaatgcatgaagccaccagaaggtggaagagtcaaggaaaattctcctctatcatcttcaaaacactgtggcttggctgaatccttcattttggtcttctggcccctagagctatgagaaaatacagttcttttgctttaaacctccaattttgtggaattcttttatggcagacctaggaagctgatatatgtagtttgatcagtaaatgcatagaaacaaacattcataatgaacatcatagcaaatgttaagagaagaaacatggaggtagacgtgggattaaatgtattttaaacgtcatctgacataatggttgaaagtagttgaatcagataaattaatgagtattaaagacttttgtagttcatgaagagctcactcaccctggatgtctcaactgtagcactgttgacatgttggactggataactattggaggctgtcctgtgcatttttggatgtttagcagtattcccgtcatctaccaagtagaaggcagtagcatcctgagttatgacgaccaaagcgggtgtagcattggggcaaggaaagatgttggtcaaagagtacaaagttccagttagatagaaggaatacattttagagatgtattgcacagtatgatggccgtagttaataatttattgtatatttcaaaactgattttacatgttctcactacaaaaaaaataagtagttaagtgatggatgtgttaattcacctgatttaatctacctacaatgtgtgtgtatatatatatatacacacacacacgtgtatatatatatatcaaaacatcagattgccttccataaaaatatacaattgttatttgtcaattataatttgtaaaaatgcaagaaagaaaaaaatatttttagaagatcaggactggggtgaggtgaatgaggcatttgccatgggcacaaatttaaagaaggtacccaaaagctgattgatcaggaacaatattttaatgcaatattttttaaaaattaaaaattatactaaaattaatgattaacaaaatagcaacttttaaaataaagacaagattagtaccattactaaatgttccctgttggtgaggaagtggtaaaattgccctctgttaatcaatgcaccgatgtaatataagtgatattgctgctgtgaaatcacttgatctgctctattctcattagtctcctcatcactaaaagaagtttagcattcttgtgatgaaggcaaccagatctcagtttgaattgtgactctgcacctacttgctatgtatccttagacgtgagtgtagttgtcagcaaattagattaataagtacacttatgtcgtgggatttgtgtagataactgagataattctagtaaggtaggtaacacagtgcttaaaaagtaatcacgctatagtaaccaaaagcataaaaaaattacagatgacataagggaactatcttctgtagtaatcaaggctttatttaaaattttaaatctacttgtgcaaagaatatgttatgtcctggacatgataagtgagctaaactgtactaactaccataaatgttgttaatattactgtgttttatgttaccttaataaatatcacagaatcttgaattcatagccagtcctacagcatcatattcctacaacatacttagcatctagtcatgcagcaactcttaagagatcttttaacagagcttgtgagttcttttattttttaaccccactttctaaatttcaaacatgacaaagacaagagcatcattttgctgtcgttttctgataaaatgtctgcaatatatgggcagtcaagagcccacttccaggataatagaagtagtaggaaaacctaaaccttagattgagtctggggtaatgcgattcagaagctgctttgaacaaaattagaaagaaaacagaattaataaggaaaccctagcatcccatgagacaagacagtaatctgaggatacactcagaatttcaagttaacttggagtgtgctaatattttctaggtttgtctatagacctgtagagaaaaataaaataatttctatttaaggacttagaacaattttcattttcagttagaaatgacaatgttattcccttataatcacacatgaaaaatctaagttaaacaacgtaaggggagtatctgcaaacttcatggtctaagaaaatctgtgttaattattttttaaaaatagtctgaaagaggaaaacatttgtcatctgagtgagatttgaaagagacatagtttaaagttttaatagaaaacacgaaggatttgcccaaagtctaagattttactcatgatgtcacacttaaaattgatcaaaaagtaaatacccatacaacaaatgggaaatatgcagaaaaatattttgtataataataggtatagagaaaataaagtgcagataacaaaatttcattagtgtaatatactcaaacatatgcttaagtacttatagagtaagagaacatgttaatggtttggccattgggaactgtgtgcagtattataaaaattatgaatatgtgaacaaattttgttacagactacattaattaatatattacatatgtacaattttggagaatattaaatggaatgtagttcctataattattttcttaagagtgatattcagatactacagtaatacatttggttgtcatttatatcaaatattaaatatttgctttatgatatagacctatacacagacatatatgtgtatatgtcacattcttatctggatgaattaacatatcttaaacagttagattaagcctgtaattttcttatctttaagtcatttcactgtaatgtcttatattgttgaaagcaactaatatcagtattactagagaaatgggttattttgcactttttcttcataacttaaagaacacagtagcactgagattgtaacatgatcgttcctctaaagagcactccacagatgtccgctaaaaggtattattaggtgtataaaattgtttaataaggaaagaaaaccacaatatcatatacatcttttgtaacattaacagtacaagactaatcctacgagaccaaaagtcactgagatgaaatataaaccaaaaattcataaaactcaactgaagaacaaaaatgtcacctttgaaggtacctatccaaaatgctatctgttatcaaacaagtgatagctgtaaatgttctcatttttattaccctgcccttcttataactcataaaactatatagatttttcattatatgtgctaggaaaactggaaaatgatgcccctagcatattgaagaataatagaagagaaatatgttacaaccttgtttaacagaactgacattggcacagaaaaatagtggaacatacatacatacatacgtaagtggccgtctatgaaagtatatctataacatgaacaaatttatgcaaaattaagattaaaatcatttgttggtttttttaaaatagatttttaaaacattttactttttcactgaaaaatgtatggagtatctctatgttcttggtactgccttttaagattttacattacatattttagtttagtctttatgtagttaataaataattatgcttagttatttctctatagctattaggctctaagaaacttaattcttgagtcatcataggatatattatattaactaacaaacattaatatttgcaatgagcttaaagtttacattgcagaaaaaaaaatctgggacaaaatggatcttaaactagtgtcggctgggcgcagtggctcacacctgtaatctcagcactctgggaggctgaggcgggcagatcatgaggtcaggagattgagaccatcctagctaacatggtgaaaccccgtctctactaaaaatacaaaaaattagccgggcatggtggcacgcacctgtagctccagctactcgggaggctgaggcaggagaatcacttgaatttgggaggcagaggttgcagtgagccaagatcgcaccactgcactccagcctgggcaacagagcgagactcagtctcaaaaaagtaaaaaaaaaaaaaaaaaaaaaaggaaactagtgtcatgatttttatttggagaggaaggaatgtggttatatttagcagaactggactatgaatcgtttgatgtgtgtattcctttttagtaagcttaattgtcttataatttaaaaatataaggtaattcctcagttgtgatggttgattgtagattacttggaagggaggatagctgcaaaggagattacagtggattagaatttgtatataacaaaggctttttgtaaaagtttgcccttcaccaaaaagcaaactacttctaaagacactttaatgctaaagacaaattttgaaattataagttgattttgatctaatttagatcctagaaagctgcccctaagataaaatatgatgcctacacaacaatgtgctggctcctctccttggttattttattagacacagccataggaacgttgacaataggtgtggattcaggcatttaggagaaaagataagtcttcttaaggttaggtctttatttctgtaacataagagagagttattgggggcgttactggaagtgtagtaaatcccatttttatatttttttaactatacactccacgacatggtttagttttataaacatcatagaatttctaattgtataagcataatatctaaaatgcccaaatacaaaattttacatagtatccaaataccaatattctatctttcatggatttataaaagtggcttgacttaagtaaagctttctgttgaagtcttgatttctctctttaattttttaacattgacaacttttatatagaaaaggaaaaaatcagaaatatagattttgtgttgaattaatgggaaatggaagttgtgataagaaaattcactaattaaatatctgtattactctttaggctttctcagcacttaaaaatggttatacatatgttttgatagcagcacaatgatccccaagattatatcaactaagtaaatacttaattagtatttaacttggaatatttattaagcatatatatacaaaaaaggctcatatgtaagtaaatgtagatacacatatacacatagtatatgtacatatgtatatgtatatacacatatacacatagtgtatgtacatatctatatgtatatacacatatacacatagtatatgtacatgtctatatgtatatatacatatttatcttttagtatgttttctcatatatgactatctgatgttgttacatgtgtatatatctagtcatatatatattaatccaatataatatattttatactcctagagacaaagaaatacattttttcaatcaataatgtaatttttggtagtttggtatattctaaacaaaaattgttgatttttaaaaattatatgtgtagaactcctcgcagtttatacactatgcccatgtacattttttcatatggtgcttacagtatatttgttagatagatatttttatacttttttttgcacaaaaggaaactaggaatgaagatacgtaagggactttccaaggtcacacacccacacagattcaaaagttgcaactgcctctttaaaccagataagccattatactcttgtatcccattccatcactcttgttttttaaaataagcaaagtgtgtctgaagaaaaccaagtgattacagacagttgtagatcacgttagaagcagaggtaatagaaccatcggcatttgaattatcagtttacttccaagccgctgctggatattgcttccctaggcacaatggcttccagtaaaacatagtctgcattgcttatatgtaaaagatataaaagtgaccataaacaattcctttttcttttcagtcatagcaaaacctctatattaatgtgaacatatagattaatgaaaaaaatgaacattagattcaacttataaatgaacatttcattctgtttttcctagaatctttactaagctcatctatcaagtttactctaaataatgtttatcatgataagtgctgaatttttactggtgaacaaaataatcagacccctgtcatctcagaattcatagactaatgaagaacatgagaaggtaaagaaatattcgaatagatgagaaagcatatctcttgagaaagaagggaacctcgctcggagtgcacagagcttgccatgacttcctcaaagagtagcattttagttgaagactaaagaatgcattatccacaccagatgaatggggttgtcaaggagaaagaaggaatactcaaatataaagacagagagaaaagcatatgtgaaggaaagaaagtgcatgataattctgcagaattaaaaactgtgccaagtgtttggattatggactggggagtggtgaaaagaagtaatcagcagttgtgtcagattgctgatttagtatggaatatctcgctttttcaaagcatattatatgacgtatgaatgtcctttaaaagcatgctatatgaacattaagtaatggtttgcattgtaagtattgtaagcaatgttggccttgggatgctaatagctgtgaggacaccacataccaccagcaaaggtggtacttctactattactgaatcacactatttcaaacatcatctgtaatttaggatttgagattatttttcagcagcacatgttcacacgggaaaatatcccctttggtttttcattcactcgtcagcagataattactctagaagcttttataaaagataagttggtgtttctcattactgaagaagttacattattgggaagaagttctgatcaccataaatgttaatatctctatgttccacatcttattttaaaaatgtttaaaagtattttagaaatggaaattaggaataacagaatgatatgatgtgaaacagagtacccagaagaactgtgatagaaatagatccatcattatagcatgaccaatatataaaactttgtttttattttttcttaagccactgagattatagtttgtcattgcaacataatttagcccattctggcaaatgtggatgttttcattgttttattcattaggaaacagttctcatttgtttagatttttcatagatagtatgaatgaaatttaaaattgtgtctacccatgactagatacatatttttagggcccaattcaacatgagaatttaagatgctattaaaatattatcaataatttcaatatggtgaaagcagaatattaaaacaagcgtgggatctaagcaggtgactctgtacaactgcacatgttgcacgcccatcagttccatcttgtgtctatgagatgtcagctctttgtctataagtggtgtgtgtttgtgtgtgtgtgtaggtgtgtgtgtttgtgtatatccttgggagtaataggagtgtaggagttggttggccaaaaaacttagaaaaggtacaaattctgtcctgattttacttcttttttacaagaaaagaaggacatttgaaggatgtttccccacttctccacaacctaaggtgatacatgttgaactttctttgaggtgctaatggaatttaggaattaaggaatacagaaaattacggagtcagtggggtatacaaaagtgaccttatactgaaaattcagtaattcagtcaagatcttcttattagaaatctattttacaaattgaatcttgggatatatttaaacatcagattataattatatatatatttaataaaatgtttgcactggagtttataaaattcacatggaaataaaatttatacagtttgggataaaataggaaaagtgtactagcctgctgatctcttaaatactgcgaacctatttaatacatctttaaaaaatgtgtgaattctatatttgtcctaattaataagacttttactcctgttgctgacagcacttgaattagcatgaccctagtcctctactagacaatcatgttcaaaaaagattaccagcaaaaatattcacctatgcagttcactaagcatattattttgcatgctacttgtattttctacatgaaaattgcataactcaacttctcccacaaataagtcatcaaaattattttaataaaatagattagtacagtacctgataattacattcaagaaagtatcaaatattttaataaaaactatattcatcaaagcctacaacaaatgttgaacaaagtagaaaagacatatgttacaccgaagatttcaataccacactgaattttattgtttatttgggtcattgcagtttataaattaacttatttcgataaaaatgtaataaacgtctattatacacacagggtctccaatagaaacttcataaattttaatggaaaaataaataagggattcttaatctcaagaaggttatgtcataatctgaaatacgctttttcctaggaaatcagcttatttgccataaatagaaaaggcaggacattaatcttataaatgattactctaattgaaagtataaaaacaaagatttattaaaacaaaaataattttaatacgagttttctattacagaatgaattaacaaggctagattgtgaatgcacacgtttcttttgttggcaccattattgactaaggtatttatagagataatgcatttgccactcgcctgaaagccttaaaatccatgaatgatattaagttttgaaggagatagttaaccaaattacatttaagtgcccttcagggatctaaacctagagttaatttcaatattgtaaaagcaatattgaagctacagcactgaatgctggcttattctatttttacactaagtaaaaaataaaagtaacttactaatgtttagcagatggtaatcactgaaattttgtctaacattgatttacatgtcaggtatgagaaacatcttctgactatgcattctttttactatccccctttttttaaaaaaaattatctccctttttaatttgaataggattgtactaaacgttacagtgaggtgagatttacaaatggcattatttcttcttttgtaaatgccaaagttcatgtcaaatctaaactttgcctcaatagtcatacgaaaggcaaccgtattaatggatagtttcccattcaggcaaaaacatgaattaactaaaatataatctacggtacttttaaaaatacatacacacaggatatagaagcatcatgccatcaaaattgtatctttttcagagtaacagttacaccttcaatgtgctcatactggtgatctgttacattatattccctctttgatgatggatacaggagttaacatctccacgcacttatcaccccttaatttatctaaattcttctcaaacctattttctatattataacttccattatttatatgagttgtcttgaaagcaggacctaagttaacatcttgagtgtgggaagtttattttacaggtaatgatggaacgcagtagtgaggaaagggggagaataaggcagaaaaaaaggaaaaggaataaagtactgtatgtgactaacttggttactactgttggcaactaagactcaatcctgataggaaccttctgaggaattatataaaatgcacctcagaattgcctatttgaaatctgtcagctgaagcatttctccattaactccggataccttggttggaggctgttatcagggatgtttacttacctgtaattccagtcatatttatgtccttgaaatgaaattttgccagtgaagttgagaattttctaccataactctagctgaaaccatgagtgagtcaaaggtatgtagcatggcacacaaatagcctctgctacaccatttctttgggggaaagaaaaaacccttaaaataaattcctaacttattacataaagagataaagaggtatttccctgtgtttctctaaaactaagtatcctcttgtaacactcacctaagaatactaagttttagtttttactttaattatatcctgagactcctaatgaatcccacagcacttggtgcatccctctcataagttacgcttatctattagtataatcattcatgtatttttaatgtttatgttagatttcatagtccttgtcagtagtgatttattttacttattgtttatctgtacaagggatgatactaattgaccttttgcactattactgaattgaattacatagagtatcttcatgatacctctatgaattttgatcaaatccatttcagcctttgtctttctagctctgcagtactgatttattttaatattactgtatgtggaagtgctctgctaaaattggatttactggcctttcaaaagtccctttatatcattcgagagatgtagtgtcataatagtggagaaactctcgtagtaagaaattgttaaatcatgaacctgacaaccttttggaaatgctcagaggtcttcttcttctccttttccttccttctctttctccttctcctcctcctcccccatcccatcccccttcttctttccttcctccttctccttttcttcttcttccttcttttttctttccttccttcctttttactctttcttccttctttattcctcattcttaaaaccatgttatagaagtatcatttttattcctaaaacatttaatgaaaaaaatactcgaattaaaggcatatccattaattatcttcttttttaaaaagtaaaataggcttgcatatagtagtaatcaatacatagccattcttgcttgatcggtaattagaactcaagtttgttcctcgtaaacattcatctgtcaagcatcttctgtgtgtatatatgtgcaagaccctatatgagaggttgtcataagtagcaatacagcttagtgagtatcaaacaatccgtgttatagactaaacatttgtatctccctgaaacgtatatgttaagtcttaatgcctagtgtgatgctattcggaggtgagaccattggaaggtgattggaccataaacgcaaaactcttacgaaggggattagtgcccttatagaagaggctcaagagagctcccttcccccttcttccatgtgaggttacactggaaaaggggtctttttaaccagaaagcagtccttcaccacatacagaatctgctgacacctttagattggacttctcagcctcccaaactgtgagaaataaatttctgttgtctataagccactcagtttgtggtatttttgttatagcaccctgaatgaagtaagaaagaccggggctaggttctggcttttcctgcaattagtcaactacttcatttttgacaaaatactttaattgaatttccatttcttcatttgtgaatgggcacaaaaataactatcttgtacatcttttagaaggaaaaattaaatgaaatgtaataacataatgcttataatatcttacatatagtatacatttttaaaatttagaggtaaaatataaattagaaatcagtgttgacatcaaggggcatgccattcttagaaaagataaaatactggccgggtgcggtggctcatgcctgtaatcctagcactttgtgaggctgaggttaggcggatcacctcaggagaggagtttgagaccagcctggccaacatggcaaaaccccatctctactaaaaatacaagaattagctgggtgtggtggcaggtgcctgtaatcccagctactcgggaggctgaggcaggagaatcacttgaacctggaaggcggaggttgcagtgagctgagatcacgccattgcactccagcctgggcaacaagagcgaaactccgtctcaaagggaacaacaacaacaaaaaagataaaataccagcacatgaataacagacctgcaaggtaaagagtgagaagcaaagaaaggaaggagacacagctagcactttcagaaaaagaagtgagtaaatataattattgaaaattaagggaagattttagaatgaaatgtcatttaaataggctcatttgtgaaagaagaggtttggtgaaaaaatatgtttctgaaaatgatctattttgagaacaatcaccctatgctgtattgattttgctaactttttcagacacatgatcaactttccctccagcagcatttgataatttttaccctagaatgaggttgcattcatttcttcacaatatagagaaaataatattacaaatgcctacacattttatttctatttacctttcttatattgctagagaaattgaaatttcttgtgtgtgaattgatcacttgcatttctttttagtgaatttatttgttgtggcattttccacaataatattttatatcgatttcccccaaaatttatctgcacacttaacactgtgaatagtagattaacagtgggagaaaatatctgatgttctctttaagttcaattctattatgtcctagtagtaacttttcattttggagatatctgcacttaaattattacttaaatcgtcttttttatgtgcttcgtggtatagctgacattgttttattttaaggcgtttggatgttgatttcctattctcaggttgcacgttacataataggcatgcaattgaccaacaaaataaatattctctctatatcatggagatcatagtatagtgggagagatggatgttttgaaaaacacaaaaatataaaaagatattgaatgagtttatagagtagagggacatgattcaatttatgatttaagagtattatctcatcaatgtataaaaataatatctgacttgagaaagtgggtagatggcaatgccatttattgaaaaggaaaaaagtggttggcgagttaggaaacagatgaatacatttagatagaagaatcagaactctcatttggatctgttgaattttaattgctcatagggcatccaagtaaatagagtaagctgctggatacataaatatggaatgcagtactggtatttgttctgggatgtaatttgagagtcaatagcataaagatgttccttacattcatagaaatgtgatatactatatggcagtcaaggtgaggcttaatgaaggaagaggacccaacaaaagataaatagtaaaagaggtgagaggaaaaccagtaaagaatggtattccagaagtatggagaagattttcaagaaggaagaattggttctaggcaaattatttttgagagtttgagtaaggtttgctgttggaggaaaaaaatggtgatgtttgcttctctccccaccaaattcaaatttgaactatttataaggtataggcaaatgcatgaatcacaaatatgcagtatgatgaattttcaaaaactgaactcacccatataatcagcacacagattaagaaacagagtattgccatcatctgagtggcctgctttgtacctctttctggtgactgtcctacccaaggatgaccacaatcctgattctaacacgaccagtttgcctttcctgtttttgaactttatataattttaattatatactacgtatttttgagtacaccttcttttgtgcaatattataatgtgaaatttgtccatggtgttacataaatagaatttgttcattatcattgttaaatacattttcactccctgaatattattgactgaatgtttatttccctccaaaattcataggtagaagccctaacacccaatgtattggtatttggaagtgggatctttgggagacaattagctttagatgacattcatgagggtagggctcccatgatgggagtagtgtccttctagaaagtgtgagagaggccacagctttctcttcttctgccatgtgagggcacagtgagaagacagccatcttctccagacttcttcctggtgaggaagagcaccctcttcaggaatcaaatctgatagcatcatggacctcccagtctccagaactgtgggaaataaatgttgtttaagccatccagtccatgctatttgttatagcagcccgagcggactaatacagtgaatatatcacaattttaggtatgttttctgaagagtaatttccaatgaggtactattctgcatactgctattatgaataactttgcatatttattttaggaaatatatatatacacaaacactattctgttagtatatacataggaatggaattgtgggtcatagagtagatatatgtttagcattagcaaatatttagaaacaatctaaatctatttgtaccaatttatatgcccaagtcaatatgtgagagtaccacacgttcaaatactagccaacccttggctagtcttttccattttgacattatagtgggtgtgtattggtatataattttaattttattatacattttgatgattactaataatgttgagatatcttttatctacttagtatttggatatatatatgggttgctgttttggtttcaatgttgctgactttaatactgttaatcagtacacattggagagtgaatcagcaatgtagatgactatttcacatactcagtgggtctttctggagttgtgcttccattggtttattcattgtattctaaggattcccttgaatttgtgcatacagtgtcaacattcatccgagaagtatggaaaatatatagaatataattttattgaaaaaaatgtattaaaacaattaacgaaaacaagaacctgagttaaaactctttaattgaagcttttgaaataatattttcctaaatatcatctaattacatctaacacatagaagtaaattatatttaaaaagaagtttgaagagttaagccccaaaaatcattcttaaaagtttgaatcactggcatgtaacctaaatttccaaaatgtcagaaaaatagatacagaataatttaggtataattatggtatacctaaataagtatgaaatatctaaatatatttaggtataccataattataccttaattatgctgtatttattataattatgttagataatattttaattatggtagataatattttggattgagtgaatatgcaggttatcactttctatatatcaatggaaattttttaaattacaacctatgaaggcctcacaatgaaaattttctagattaaatccattagttcaagtttttctaattgtactgtaaatgaaatatcttctccattatcaatctcgctttatttatttttaacacttattttaggttcagtggtacatgtgcagagtgttatataggtaaacccaagccatggggttttgttgtacagattattttgtcatccaggtattaagcctaatatctattagttatttttcctgattctctccatccttccaccctccaccttcaagtaggccacagtgtctgttctctctatgtccatgtcttctcatcatttggctcccacttataaaatgagaacatacggtttttggttttctgttgctgtgttagtttgccaaggataatggcctccagctccatctatgttccttcaaaggacatgatctcattcttgtttgtagctgcatagtattccatgatgtatatgtagattttctttattcagtataccatttatgggcattcagtttgattccatgtctttgctattgtatctagtgctgcaatgaacatacgcatacatgtgtctttatgatagaacaatttatattcatttcggtataaacgcagttatgggattgctagatcaaatagtagttctgtttttagatctttgaggaatcgccaccctgctttccacaatgggtgaactaatttacactcccaccaacaacatattagcattatttttctccacaaccccaccagcacctgctattttttgactttcaataatagccacagtgagatggtatctcattgtgtttttgatttgcatttttctaatgatcagtgatactgagtttttctttcgtatgttttggtcacatgtatgtcttcttttgaaaagtattcatgtattttgcctatttttggatggggttgtttgtttttattcttgtagctttgtttaagttctgtgtagatgctggacattagacctttgtcagatgcatagtttgaaaaaattttcttccattctttaggttgtctgtttattctgttgatagttcttttactgtgcagcagctctttagtttaattagatccaatttgtcaatttttgcttttgttgcaattgcttttggtgtgtttctcatgaaatctgggtgtgacagctgtcaccccacagatcaccagttgaccccactgatcaccgttgattcggctcatctggctagatgggtgtctccttccttcctcaccactccatgtgtgtccctactgaacctgcgtgtttggttgaagagaacagccatccttgatagaggaggaccagtcttcaataaaggatatacgagtggctgtgcttgcctgctacaacctccaaacatgctattagtcttgtgaataaagggatgagccatataactagacgctgagaaagaccagaacagtgctggtttagaaacggaggaccactgcattcttagttcatgtttggaaagtgctttcaaaaaatttcaagtacttggatgatctttagatgccattgctttgaaataatctttattttatagcacaaataaaatataacacccccattgaatatctatgtcccgttatctctgatagatttccataggtataaacctttaatctgaaggtcacacaaggcttgggaaaataccatcatcaagggtcaggtgagtatattgtatatttttaattgcatagttcgagtcacagatgcagatgtacaaaatttggtcagataattttctgaagattttctaaatcttgaattttctcaagattggacaggactttgggttaattaataatttatcagaatagcacattgcacataatttacccaggcttatatattctctaaaatatataaaattaattcaaaataaaatgttttagtcaaatacaactttactttccaccataattttacaatgaaatgttattatattttaacttaagagcttgggctcagcttcagtaggcctgttatggcattgtttaactcccccacagccttaaatactacaggaataagtaggaattttcaagggttttaactgttctttctttctttctttttttttttttttttgagatcgagtctcactctgttgcccaggctggagtgcagtggcaccatctgggctcactgcaacctccaccttctgggttcaagtgattctcctgcttcagccttccaagtagctgggattacaggcactcaccaccatgcccagctaatttttgtatttttagtagagctagggtttcaacaagttggctagactggtcgaactcctgacctaaggggacctgcccacctcagcctcccaaagtgctgggcttacaggcatgagccaccacacccaaccggttttagctattctttcattccctgtacaaaacaacacaaagacacatcctgccactgacatattctggcctgggccaaatgtaggattattgggttgtctgaacagtctcagcctcccagggcagtaaagttttcttaaaaaagagagcttgtagaatgggtttgcccacaactcactgcaaaatctcaggcgatttggcaactttttaaaggtaaaatatgttctgatccattttgttacttgctcgggggcagcaatgaaacaccagaggtggtatcctgttatgacccttctgcctacagtattttcaatattaatatctaatggtgggtatcttatttcatttgagacaccaagggtcagattcctctatttacttatggacatattaagcaacaataatgcaggcaagcataattttaaaataaagagtgattttataaaagtaattttgaatttctttttttctttttttcctagatgaccatattttttattttaaaaaatagaaataatacttttaaaatggtgaacaattcttttacatatatatatatttttattatactttaagttctagggtatgtatgtacaacatgcaggtttgttacacatgtatacatgtgccatgttggtgtgctgcacccattaactagtcatttacagtaggtatatctcctaatgctatccctccaacctccccccaactccactttttatgttcttttttcttcttgctatagatctaatttattttctgagaaggtccatacagagatttactatcccttgctttaggaacagttgtcatagtttattaaacccatttattttctaccaaaaggaagatatgtctaatggcatataaaaccattcaatgagtacttcataatatgagtgaaaggtgagaattctttgtattaataaacaatacatcttaggaaagcttaaaaatattaaaatagatgaaaataagtgatgtatagaaacatattttaggtcaataacaatctaaatactatatttatttattaattatgtaccagtatacccagtttcagaatggttgtaaagttaatttttttatatagcagcagcagcaacattattatttttttaacttttaggtttaggggtacatgtacaggattgttatataagtaaactacctgtcactggggtttagtatacagattatttagtcacgtaggtaataagcatagtacctgataggtttattattatttttttgatcctctcactcctcacgccctccacctacaactaggctgcaatgtcttttgttcccctctttgtgttctcattgtttagctcccacctataaatgagaacatacagtatatggttttctgttcctgtgttggttttctcaggataatggtctccagcttcatccatgttgctgcaaaggacatggtctctttctttctaatggctgtgtagtattacatggtgtatatgcatcatattttttaatgcagtctaccgttcatgggcattcaggttgattttttgtctttgctgtcttgaatagtgctgtaataaacatacatgtgcatgtgtcttcatgacagaacaagttatattcttttgggtatataccccaaaatgggattactgggttgaataaaagttctgttttaagttctttgagaaattgccacactgctttctacaatggctgaaataacttactttcccaccaccagtgtataataagtgttcctttttctctgcaacctcattagcatgttttttttttcactttttaataacggtcattctgactggtatgatataatatgtcattgtggttttgatttgcatttctctgatgactagtgatgttgaacatttttcatatgcttgatggccacatgtatgtcttcttttgaaagatgtctgttcatgtcatttgcccacttattaatgggtttgtttgttttttgcttgtacatttatttattatagattctgaatattagacctttgtcagatgcatagtttgcaaatattttctgccattctgtaggttttctgtttgttgatagtttcttttgctgtgcagaagctctttagtttaattaggtaataattgccaatttttctttttgttgcagttgcttttgacatcttcatcatgaaatttttgccaagttctatgcccagaatgttttttcctaggttatcttccagggtttttttttttttttatagttttaggttttacatttaagtctttaatttctcttgagttgatttttgtatatgacgtaaggaaggggtccaatttcaatcttctgcctatggctagccagttatcctagcacagtttattgaatagggagttctttctctattactagtttttgtcagctttttcaaagttcaggtggttgtaggtgtgtagcattatttctggactctgttctgatccattggtttatgtgtctacttttctaccagtaccatgctgttttgattaccatagccttgtagtatagtttgtgattcctctaccttggtccttttttcttagatttgtgttgcctatttggactcttttttggatccatatgaattgtatttattgtcctaattctgtgaagaatgtcactggtagtttaataggaagagcattacatttataaatggctttatgcaatatggccattttgatgatattgattcttcctgtctatgagcatggaatgtttttccactatttgtgtcatctttgatttctctgagcagtgttttaaaattctcattgtggagagctttccttttcctggttagctatattcctaggcattttattctttttgtggcaattgtgaatgggattattttccagatttggctctaaacttagatgttcttggtttataggagtggaactgacttttgcacgtcgattttgtatcccaaaactttgctaaagttgttggtaatttcagggagcttttctgcagagactatggggtttctgtgtgtagaatcataacatctacaaacagggatgtatatagcactaaacgcccacattaaaaagttagaaaggtctccaattaacaatttaacatcacatctagaggtaatagagaaataagggcaaaccaactctaaagctagcagaagacaagaaataaccaaaatcagagctaaactgaaggaaattgagatgagaagagctatacaaataatcaacaaatctaggagtttgttaattgaaaacattaataagatagagtgctagctagagtaataagggaaaaaaaagaggcatgttccaaataaacacaatcagaaatgacaaaggggatattaccaccgaccccaaataaatacaaaaatttctcagagactactataaacaagtttttgaacacaaactagaaaagctagaaaaaaatgaataaattcctggacacatacaacctcctaaactgaaccagaaagcaatcgaatgtcttaaccaaccagtaatgagttccaaaattgaatcaataaaacagcctactcaccaaagaaagccagcactagaggaattcacagcttaattctacctagagatgtataaaaaaaagctggtaccaatcctactgaaactattacaaaaaattgaggaggaaggactcctccataactcattctgtgtggccaacattatcctgataccaaaacctggcagagatgcaacataaaagaaaatttaagaccagtattcttgatgaattaaaaatcatcaacaaggtactataaaaccgaatccagcagcacattagaaagctaatgcatcatgatcaagtagacttcattcctgggacataaggttggttcaacatttgccaatcaataaatgtcattcatcacatcaacagaactaaaaaaaaaaccagattatttcagtaggtgcaagaatggcttttgataaaattttacatccctgcatgttaaaaaccctcaatatactaggcaataaagaaacttacttctaaataataagagccatctatgacaaacccacaaccaggatcatactgaatgggtaaaagctggaagcatttccctgaaaactggaagaggacaaggatgctctctctctcaccactcctattcaacatagtgttgtaagtcctggctagagaaattaggcaagagaaagaaattacaggcatccagctaggaagaaagaaagccaaactacattattttaaatcctatcaatttcaattttgaaatttttgctacaaaaatgttatcactagaccgtcattaaaataaaaaatttaccacttgcataaaaaatacattattttcacttttaatagtcttctatgtttaatatattctcttaaatgcaatttttgacttttaacatcacaaactcaaatgatccaaggtacaatgaaaatggtaataccattatatcattaagtaatctacaaaatgagaaataaaaatgaggctctaattcgtacaattccacttacatgttcagaaattgtattctgcttcaaattttgcccttcttatacaggttagaagatgataaaggattctaaattcttattatttattggctatgatctgcactgataatagtaatttaaccagggctgcgattttggggagcaatgttctatagggatattaaatctgtttttaattattggctttttattaggcaattttattaacagattcagtaaaaaatgtccaccgcagctcaataaccgaatgatcttctaattaatctattagtgccttttaagtattcttactgttcaggcgtatgtcatgttgaacagtaaaatagaacttgaaatgttaatattagcaggactagttctatccccaaatctctgctgccttcaaacttctgttgaaggagctctattgaaattagcaagctcctctgtgtcatactttcagtattttattaggagtgtgactaaagttgagaggcaagagatactgcagaaaatttgtgaagctctctgttcagccttctcctgaataggtagaggaactggtatgtacaaggtgtaatgtgtggtgtttctctctctttggtccaagcagtgactgctgaatgtccaaccaggtaagagcgtaatgataaaaatgaagttggggttggggaaaaagtcctgggtctattttagggtggcaagttgctactacatatcaaggcaaactgtagcacccaggatgcataagcaatgaaaactacaagtgttcatctctcagccagttgtatgaaaattctacattcctgtcggttattatcactttaacctttcaaaattcaaatttttctctctaatagatatgtagatttataggctctgcttctattcctctttgctgtattatcttccactggatgtcagttaaactttcacaattttagagttatatgatctgtctcctttctatacatcactttacaaaatgtcagagcccaggaggaatttgagtctgagactcctggtaggaagtggcactctcagggagccatgccattttctttatggctaccattactatctatgtattgatgactttttctttccttttctttactcccaattccaacttacctctacagcttcagaactcaatagttcatggtctgtttcatatttttatatgaagcacccccatatacttcaaattcacatgccccaaacagaacccattatagcctacttgctcttatatttattacttcgctcatgcttcttcctcacttacatccttaccattgaaaaagtaaatttaaaaatgtattgcatgattttcttcttttttctttttgtgtctgtcttcaatgtcataaatgttcatctacaatgtagattcagccacaaacctggatgtcatctgttactccatactatatattttcaactacaactatcagtctaatattatcttctcatccggactgcttgagacatgtagtatgcttctagtcttgcccttttgttagccagagtgagcccactgatctaacaacagaaaccccttctcttgctccccactgccactagggtcagtgctaactccattgcataagacagtcctcttcaagatctcacttcaccagttctctgcagtttctctctggtcggtgttctagcgcactgcaatcctgataagctgtatccacatcagattcctattccttcggctctttgcacttgcaaccttctcaacttgaatcactgccccacccttcactcacctctgcactatattaattgtccttcaagatatccattatatgccattccccttacaaagcattccttgacctttagggctgtgtgaggtattttgtccagtggtatcctccattaacgtctttatcacatatgacaactatgtgacatggagtaagattcaataatttcattcttatttatctagcttgcttttttagggctaactttcttcagggctctctactgggcttagaaggtgttaatagtttttatttataagattgaattaatgatgagcaatataataaataaatatgttgtaatataaatggttgataatcactttacagatgatcaacctcattccaataacattaaaagaaatataaacaggagaactgtccactgtcatggaaaagggactgaagccagagagccaaacatcctcactcagagggtcccacgcccacagaaccccacaagctgagacccactgggttgaaatccctgctggccagcacagcagcctggagtctgcctaagactaccgagttcatggtgggaggggtgaccgccactactgtggctctagtaggcagttctctccagctagtgctacggagactgggatgtttggactgggtggtactccccacagcgtagcacagcagctgtggcagatcacggccagactgcttctttaggtgggacccagattcatcccttctcactgggcagggcctcacacatgaattccagcaattccagccaggcctttacagacagaattgtcctctgccagggacagagcacgtggcaggaggagcggccaaggtgtcaagttcagtgggcttaatctttcccgtctgctggccgatctagaggagggggactcccccagcacagcacaacggctctgctaaaagatatacaaactacttccttaagtgggtccctcatcctgtgcctcctgactgggtgagacctcccaacaggggtcaccagacacctcatacaggagagttatggctggcatcaggtcggtgcccctctgggatgaagcttccagaggtaggagcaggcagcaatctttgatgttctacagcctccactggtgatatccaggtgaacaggatctggagtagacccccagcacactgcagcagacctgcagaggaggaccgtgactgttagaagaaaaacaaacagaaagcaacaacagcagcagcatcaacaaaaaccccatacaaaccctatccgaagattgacagcctccaagattaaagatagataaatccatgaaaataaggaaaaaccaagcaaaaatgctgaaaatttcaaaagccagaaatgcctcttcttctccaaacacttctccagcaaggccacagaacggggatgaagttgagatgggtgaactgacagaagtaggcttcggaaagtggataataataaacttcgctgaactaaaggattatgttctaacccaatgcaaagaaactaagaaccatgataaaagattacaggaatctgttaactagaataaccagtttagagaggaacataaatgacctgatggagctgaagaacatagcacgagaactctgtgatgcaaacacaggtatcaatagctgaattgaccaggcagaagagagactatcacagcttgaaggccatcttgctgaaataaggcaggaagaaaagattatagaaaaaataaagaaaaggaataataatagaaaacaaacctctgagaactatgggactatgtaaaaagaccaaacctgcaactcactgaagtacctgaaagagacagggagaatggaagcaagttggaaaagacacttaaggatactatccaggagaatttatttaacctagcaagacaggccaacattaaaattcagaaaatccagagaaacccagtaagatattccacgagaagatctactgcaagacacataaccttcacattctccaaggtcaaaatacaggaaaaaatgttaagggcagtcagagagaaaggccaggtaacctaaaaagggaaacccatcagactaacagtggacttctgagtggaaagcctacaagtcagaagagattgggagccaatattcaatatccttgaagaaaatagctcccaatccagaatttcatatccagccaaactaagcttcgtaagtgaaggacaaataaaatccttttcaggcaagcaaatgctgagggacttcatcaccaccaggcctgccatgcaagagcttctgaagaaagcactaagcatgaaaaggagaaagtgttaccagccactacagaaacacactgaagtacacagaccaacaacactatgaagcaattacattaacaagtctgaaaattaaccagccaacattatgatgacaggatcaaattcaaaggtaacaatattaactttaaatgtaaatgggctaaatgccccaattaaaatacaaagaacggcaagctggataaaaaggcgagacccatcagcatgttgtattcaagagacacatctcatgtgcagagatacatataggctcaaaataaaaagatggagggagatttaccaaacaaatagaaagaagaaaaaaacaggagttgcaatcctagtttctgacaaaatagactttaaaccaacaaagatcaaaaaaagacaaagaaagacattacataatggcgtaaggtttaattcaacaagaaaagctaactatcctaaatatatatgcacccaatacaggagcactcagattcataaaacaaatccttgaagacctacaaaaagatttagacccccacacgataatagtgggagaatgtaatgccctactgtcagtatgagatcattgaaacagaaaattaacaaagataatcaggactcgaactcagctctggaccaagtggacctaatagatatctacagaactctccaccccaaaacaacagaatatatatttttatgaactccacatagcacttactgtgaaattgatcacataattggaagtaaaacactcctcaccaaatgcaaaacaactgaaatcataagaaacagtccatcagaccacagcacaatcaaattaaaactcaatattaagaaaccaactcaaaaccacacaactacatagaaattgaacaacctgctcctgaatgactaccaggtaaataatgaaattaaggcagaaatcaaggagttatttgagaccaatgagaacaaagagacatggaccagaatctctgggaagcagctaaagcagtgttaagagggaaatttatggctgggtgcggtggctcacccctgtaatcccagcactttgggaggctgaggcaggcggatcacaaggtcaggagatcgagaccatcctggctaacatggtgaaaccccatctctactaaaaatacaaaaaattacaggcacctgtaatcccagctactcaggaggctgaggcaggagaatggtgtgaacctgggaggcggagcttgcagtgagctgagattgcaccactgcactccagcctgggtgacagagtgagactccatctcagaaaaaaaaaaaaaaagaaaaatttatagcactaaatgaccacatcaaaaagcctgaaagatctcagatcaaccaccttaatatcacaactaaaataactagagaaccaagagcaaagaaatcccacagctaggagaagacaagaaataaccaagctcagagtggaactgaaggagacagagactcaaaaaacccttcaaaaattaacaaataccggaactggttttttgaaaaaatcaataaaatagaccacaagtgagagtaataaagaagaaaagagagaagattcaaatatacgatgagaaacgataagggagataccaccaatgaccccacagaaacacaatcagccatcagagaatactataaacacctttatgcaaataaactgggaaacatagaagaaatggataaatttctggacacatataccctcccaagactgaagcacaaagaagttgaatccccaaatagaccaataacaagttctgaaattcaggtgctaataaagagcttgccaatcaaaaaaagcccaggcccagatggatttacagctgaattttacgagaggtacaaagaggagctggtaccatttcttctgaaactatttcaaacaattgaacaggagagactactccctaactcattttatgaggccagcatcatcttgacatcaaaacctagcagagatgcaacaaaaaaagataacttcaggccgacatccctgatgaacatttatgcaaaaatcctcaataaaataggacaaactgaatccagtagcacatcaaaaagcttatttagcacaatcaagtcagtgtcatccccagaatgcaaggctggttcaacatacgcaaatcagtaagcataattcctcacataaacagaactaaagacgaaaaccatatgaatatctcaatagacgcaggaaaggccttggataaaatttaacatcctttcatgttaaaaaaaaaaaactctcaataaactaggtattgaaagaacatacctcaaaacaagagccatttatgacaaatccagatccaatatcataatgaaagggcaacagctggaagcattccctttgaaaactggcacaagacaaggatgccctctctcaccactgttattcaacatagtattggaagttctggccggggcaatcaggcaagagaaagaaataaaggatatttaaataggaagagaggaagttaaattgtctttgtttgcagatgacatgatcctatatctagaaaaccccattgactcagcccaaaagcttctttagctgataagcaacttcagtaaagtctcaggatacacaatcaatgtgcagaaatcacaagcattcctatacaccaacaacaggcaagcagagagccaaatcatgaatgaactcccattcataattgccacaaaaagaataaaatacctgggaatacaactaacaagggaaatgaaggacctcttcaaagagaactgcaaactgctactcaaggaaatcagagaggacacaagtagatggagaaacattacatactcattcataggaagaatcagtatcatgaaaattgtcatattgcccaaagcaattaatagattaaatgctattcccattaaactacaattgacattcttcacagtattagaaaaaaactatttaaaaatttttatggaaccaaaaaagagctcataaagccaggacagtcctaagcaaaaagaacaaagctggaggcaccatgttacccgacttcaaaccgtactacaaggctgcagtaaccagaacagcatggtattggtacaaaaacagacacatagaccagtagaatggaatcgagaacccagaaataaggccacacacctacaacgatctgatctttgaaaaacctgacagaaacaaacagtgaggagaggattccctattcaataaatggtgctgggagaactgacaagccacatgcagaaaattgaaactgggtttcttccttataccttatacaaaaattaactcaacatggattaaagacttaaatgtaaaaccaaagccattaaaaccctagaagaaattttgggcaataccatttaagacataggcatgggcaaagattttatgatgaaattgccaaaagcaattgcaaaaaaaaggaaaaattggcaaatgggatctaattaaatgaaagagtttttgcatagcaaaagaaactatcatcagggcaaacagacaacctacagattgggagaaaattttttcaatctatctatctgacaaggtctaatatccagaatctacaaggaacttaagcaaatttacaagaaaaaaacaaataacattattaaaatgtgggcaaaggataggaacagacacttctcaagaaaaaaaaaagaccatacatgcagctaacatgaaaagaagctcaatatcactgatcattagagaaatgcaaatcaaaactacaatgagatatcatctcacaccagtcagaatggcgattattaaaaagtcaagaaacaacagatgctggtgaggtcgtggagaaataggaatgcttttccactgctggtggcaatgtaaaatagttcgaccattgtggaagacaatgtggtgattcctcaaatatttagaactggaaataccatttgacccagcaatcccattagtgggtatatacgcaaaggaatataaatcattctattacaaagatacatgcacatgtatgttcattgcagcactatttacaatagcaaagacatggaatcaaatgcctatcaatgatagactggataaagaaaatgtggtacatatacgtcatggaatactacgcagctatgaaaaggaatgaaatcatatcttttgcagggacatgaatgaagcttgaagccattatcctcagcaaactaactcagggacagaaaaccacacacctcatgttctcacttctaagtgggagctgaacaatgagaacaaatggacacaggcaggagaactacatacactggaacctgctgagggagggcaaggcagggagggcattagggaaaagagctaatgcatgctgggcataacacttaggtgatgggttgacaggtgcagcaaaccaccatggcacacgtttacctgtataaaaaacctgcacattctgcacttgcaccctggaacataaaaaaataagtataaacttgcaaattctttgataccattttgagatatcatttacaattagaatatattataaataaggctatttcagatgtcagtgaccatgagaaaatcaacatttttatgtcactggtataaacataggttgctttaattttctgggaggaaatttggcactgtggatcaagtacctaagcatcatcatgataagctcatgctagaattaactatgtatttctactactagaaattgattgtaataatttgatgagttataggtaaattatgtgtcaagatgccagtaaaattttattaaaatgaaaattatagcaaccatcaaacaaaacaaaataaattatgtatgaaaacgctatattgtggaacaatgcacagccaacataataataattaggatcagatttctaatgacatgtgaatgattatgcaatgtactaggtaacaaataaaatattcaactgtaactatgtgaagctgtgtgtccagcaaaaggaagtaaatgcagaaactctaaaagataataatctcctatcagtagtataatgaatgacttttgtcatctcttttttatgtcttctaaaatttctatgatgaacatttattccacttccacgtagaacactataatataagccttgcaatgttctgcgaatttctaagcttaaaaacctcttgtatgtcagttcatttattcattcattgatttatgcatcaaatgttggctaatcagcaagaagtaagacaaggtacatagtctcttcattctacagcagaaagacagaatatgaggaagtaagcaagtaaatacatataaaaataaagtcaagcaaacatataaataaataattgataattgtaatacatcctctgcagtaaatgagtaggccataaatagagggatatgatagaaagtaactcatggagaaaaatgataggtgataattgataattaaaagaagtcaaccatgtaaaaggctgagaaagggcattccagtcagaagaaatagcaagtacaaagacattacggtgaacataggcacagtatgctccagaaacagaaagaaagccagggcgactgaaatccagggggcagaggaagtgtggaaaggtaggatgtggaaaatcatctatgccatggtaaggaatttggattctaagtgcaatagaaagccctttaagatctaccttgcataatgccttctttgattgtcataaagtttcttttttcccaacatacaatttcatgtatttctcatacttctgctcaatgaaagtaattgcatttattgctgacattgtattttatcttctactaaatacttacatgtttatagtaaccattctaccaattatatgttgcatatttatataaatttaaattagtaccaagatctgtgtccgtgattaccaattattatttatttgctgcccatctctcctttctaaaacattagttctagaaaaatagattccttctgtttagcaccattatactcccagtgatttcactgtgcatttcacagaagatacaataaatatttgtttaatgcatgaatgtaattatgtttttcattagattgtaaaaagtttacagcatactgacagctgtatgtcactaaaataaacactttaagttcctattctaaccttccttttgccttcttcttgtcatttctcctttcttataatgtaaggccaggtattctaattatactcttacctggccattcttcttacttttcttttctctaaattaccatttgtgtccttctctctcacttgacaatcttgtgtatttccacaagtccaactgcgaaaaccctcctcaccctcacctctcattagggtagagacaagaatcccagattgtatttctatctagcatagatcaatcgacagaaacatagccagggtactactttgcttgagaaatctctacatgaatgttctcttcattgctcctaaagtatatatcccaaacctaattattttttgtcccttgatttggtatttctattaatagcaccaattccattaatcactaaaattcaaaactacaaatttacctttaatatgtctttgcttcttccctatgatcctatttcctctactcctgccatcttacccactcattgctcatgcacaaagcctcacctcacatgaaccaacatccattcttttaccaatcaaacatattttcatgtctgaaatatgcttttatgtacacacatctccttctcctgaagctgcagcttatcagctatcaaataagagataggaagaggaaatggccatatataatatagctgcaattgtcgcagactacacagatggacggaagaaggcataaaaggacatgggttgttttaatggatgggtgatatctgtgtttcatcccactgttgatgaattttggcagacaccaagatcatgtaacatattaaatttaatatttgttcagcattatatcatgactgaattagactcccatatggaaaacataatttatgtttaattttaatgagatacattactaagatgctgaaaaaatattcaaattttttatcacatattgaacaagcaatatatctacttatgaagaacacagctgacttacattcttgctgatgtttgtcaagaataaaaatgattatgctatataaccattgtatagaagccttctgttgccataaattcacttgacatttcactttactgagtgatgtgggaatgacccttagcaaggctatgcatactttgtgtgtttaaacttcatgcatacagaatatttgcagatacactaataatttaacatctcagtcggacattctactgtttaaatttaagcaaaggaaatagtctagttttaaacaaagcatcttctgaagcagttgcaaagggtatttctagaattacaaaattgtcagatccattagaactgtttctggtctctcaaatttgcgttggcccatgtacttaatactttctttcttgattgctctctctttcatttatgctcattatacgaggtagtttccatgtcacgaaggtaagaaaatatgtggagaattgttaaaattaggccagagtaaaagaatcaacctatgaagacccaacagcaatattgtaaaaggttatcatattttattaaagtgaatttttttgcctgttttaaaaattatctaaaggtataagtattcatagttgtaaggaaatacattgtattactccttagctttcacacatcatttccagaaatagtttcaccttaagacaccctcacctgacatttaaaagctcaaagtgctctggtgtctgccagattctataacactaattttgtctgtggtctttttttccccctagaaacttcataagtatacatcaatctgccagaaatggtgattatgtgagcagattaaagtaagggtatttctcccctgcaagtttaacattaacattctcactatagacatcctcttggcattgaaagagaaatgaaaaaggtgtgtgtgtaacattatctttgttctgtaacataaaactagcatttgtattttccattaatttaaaacacttgttcatacaatacattagagttaacaatttttcacttttgagctagcaaaagtttttagctgatttcttttgaaatataatttatttaggtcagatattttatttttacattttgtattatataaacacattctttcctttttattacctcaatatatctcaccaaaatattttaatcaatacttatacacataccacaatccaacatgataggtgttaggtgtttctatttattattagcatttttaaaatttaacagctttagatttttttccttttcttattgtacattctattgcaggtataaatcgtcctatatggatgaaatgttaagcagaggtaaaacactaaaaaatcctatttggcaactttgatgtacaagcatttggcagttatgttaagtgggagtgagtgatttttaaaaatggtatgtataaacccaggtgcattttttacatagacacaaattgtcactcccttatagttcttaaaccaagataattttatgctttatttttaaacaatgttgcgatgcattataggatgttatgacatttaaagaaatggttgcatcagctactgaatatttatcttaattaatcgattatgcatcagaagtaaaacttttgtataatgagattttgaaacttgttcaaagaaactatatctcttttacctacctcattagtttggttaaaataacgaattcccaaaacccacaaataacatgagaagtcagtgctaagacataaaaataaagcatctatttgctgaatacttatatatttcattagtatgaagatactgaaatgtaaacaaatatgggcctcagaaaacataaatgaagctagctctcagtcaaactttttatctcgagaagattttctttactttttctttctctgttctcagcaaaaatagatatggtagcaaagaaagtagcaaataaaactgcagctagctgggtgcagtagctcactcctgtaatcctagcacttttgtaggcaaaagcgggtagattgcttgagctcaggagttcaagaccaacctgggcaacatcttgggtagagatgggcgaaactccatctctaccccctccccaccccccccccccaaaaattagccaggcatagtgtccattcctgcggtcccagctactcaggaggctgaggtgggaggattgcttgagcctgggaggtggagattgcagtgagcttagagtgtaccactgcacttcacttcaccctgcatgacagaatgtgaccccatatcaaacgcaaaacaaaacaacaacaaaactgtagctttgctaaagaacagatgtggctttggcagagaaacttgcaaacacaggatgtgaatatgtggatagatctataaaagaggaaaaagcaggaatcattatatttgataaatttagtacagaaacattgcttgggatgtgtggtgacctaaataaaaaatgctaattgaagagaaaataatactttctaagcattttaaaaaatcagttagtagagacccgagccgttcattaaacattagttaaagagcatgttaatagcacttacagggttaaatggaactgttttgagacttctccaattataaaacatcttttcttatttcaatatgtatttaatgttactttcatttttaatttgtcttattaaatattccctcaagtaccttggagaagtttatgttcaaaataaaacaataaaaattcttatttggcagctttgatgtacaaatatttgacaattatgctaacagaatgaatgatcttttaaaattatgaaattgattttaaaaactttctgtcctttacagtttggacatttatatgttaaatatgcatccttctattaaatatgagaattgtgaaattgataatatttgtactattttgtttgtttttaaagccaaaaacctcagatcgatattaagtgtcttatgaaattataatagctctcatgatctccaagcttattctccgtttttgtcactttacttttctattttaatagttttcttaaacaacattaattttgaatataaaggcctaattaagtaaataaaacataatgatttcaaaattacattagtgatttgcacaaaattagcaaaaatacatatagaatttaatatgaaaaacttagaactgcacaagttcataataaaacattatttttagtgtaatatctttttaaaaaattccaaaattttaggtttggggttacacatggaggttagtaacatgggtaaattttgtatcttgggggtttggtgtacagattcatcactcaggtagtgagcatagtacatactaggtagattcaatcttcaccctcctcctaccctccatcctttggacagagactgtgtggttctctaggtacagaatcatatcatctgggaagagagatagtttgacctcctttcttcctatttggatgccttttattttattttattttatttttattttttcttacccgatagctcagactaggcctttcagtattatgttgaatgaatctggtacgaataggcatccttgcttgttccagttctcaaggggaatgcttccaggatgtgtccattcagtatgatattagctatggatttgtcatagatggcccttattattttgatgtaggttccttcaattcctagtttgtggagggtttttaacatgaagaaatgttaaattttatcaaaagcattttctatgtctgttgagatgattattttgtttttgtttttagttttgtttatgggatgaatcacatttattcatttacatatatcaaaccaaccttgaatcacagggctcaagcctacttgatcgtggtggattagctttttgatgtgctgcttgattctattttctagtattttttttttgaggatgtttgcagctatcttctttagggatattagcctgaagttttgtttttctgttgtgtctctgacagtgttggcatcagaatgatgctggcctcatagaatgaattagggaggagtccatccttctcaattttttggaataatttacttaggattagtactagctctttcttatacaactggtagattttggctgtgaatgtctggtccaggatgtttactggttggtagttttttttatgattaattcagttttggatcttgttatttgtccattcaaggtttcagtttttttattggttcaaccttgggaagttatgtattttcaggaatttacccatttcttcttggatttctagtttgtgtgcattgaaatgtttgtaatagtctgtgaggtttgatttttttttcatttatttctttgaggtcaatggtaatgtagtaatgataatctcttctttgtcatttctcattttgtttatttggatcttctttgtatttttattagtttagctagtggtctatcaatcttattcattcaaagaacgaactttggatttcattgatcttttgtatgttttcttatttcaccattttattcactcaagctctcattttggctatttcttgacttctgtctttggtggtttttttctctagttcctcttgggatgatgttagggtgttaatttgagatctttataaatttttaatgtgggtatttagcactatatacttctaacactgctttcctgtgtcgcagagtttctagtatgttgtatcttttttctcattagttttaaataatgtcttgatttcttccttaattggattgtttacccaatagtcatccaggagcagtttgtttatcttccatgtaattgaatggttttgagaaacccgcttggcattgatttccatttttattgtgctgtggtccaaatgtgtagttggtatgatttcgatttctttgaatttgttgagaattgctttacgtggccaattttagagtatttgccatgtacctatgagaagaatgtatattctttcgttgtttggtgcagtgttctatagatgtcctttatattcttcaatttcctggagtgtctgactgtgctataattgggttccgttgactggctttgcttctcgatgatttcaaggggtgaaggctcagttcagcactcctgggcagcacatgctaaccctggcaggctgggaccaggcccacacctttgttctctggcttcttgagggtaagcacctgttgcactaggggggcctaggtgttctcagtcccctggcaacaatactttgatggtgtgtgccagaaaagcacatcatcagggttgtggcagtggggttcatgatagcatgcagtggagttgagcttgtggtggcgaggtctgtgtgtgcttatgtgccagtaaaactgtcggtgcaggctgcaggtgagtgcatgccggcaaagcagcagggggaatctgcaggcaggtgcgcaccaatggagggaggcctgaccacataagctctctgatggtgaggaggggtctgctggtgtaggagctatggtagtagctgctggggagtgacccagttgggcatctgaggctgcattccaagtgagtgtgaccagaaagagcccctgggaaagactggcagaccagactggatggtgctcagaacacactgcccccatcccatggacaagacagccctgttctgtccaggtctatcagtcaacaaaggcaaaagcccctaaaggagcatgttgagccttgggggataagcatccctgggcatactctactgcagccattctgacaccaaacctctggcttctacacaggctagagtcctgtccctgctgactctccttgcagctctccctgacagcacaagtgttcgtgggactcgtagggcttcctgcagcttcgatttctgaggcacctaatgagactgagccattcatgtctatttaactcacctcttacttaggagcacctcagggccagggactagtcctggtgctcagcagccccatgttcccagcttctctatccttcaatcccttcagggtctgtgtccccactctgtccactctcaacgcctttcttcctaagatctgctggtaatgtgtcagtctactttatcttctgatctctcagtgagagttccttctggttgtgtctacttggccatattggctatttctgtaatcatatcttatccgatgacattaaggcagaaatctttaacaagcaaacaaaaaaacaaagaaacagagctatacagctgtaaaacactctacatagaaaacaatttaattcacttatgtatcttagaaatgtaatttaaaaatatataaatatattttaaaatatacatgtaaaatatatatattttaaaatatgtaatatatatgtatgtgtgtatatatgtaaatatattttataaaattacatatataaaatatactgtaaatattaaatatatcatatataaacataaatcattgaaataaaatggcagatcaacaaattgactgaaccaaaaatctttgcaatatagaagatattttttgtatatgacaatgggatcctagagacaaatgtttctttctctcctggctcccttccttctttcctttctccgtccattcctttgttccttaaaatatattgagcacttctgcatgtcaagaggcaagctgtacatggctatattaagttatgtgcactactgattttacctttttggtgaaaaccttaaatataacattttggggatttagtaaaacacctctaaaaatgtaggaaagttaatcccaaatgccattccaggcccttccattcagaacacattaccaatttgtttttcaaacataacacattttttttgtattgatagtttacaggataagacttttgaaaagacctgttttagagctaagaggagggtgggaattacaagcagtgttctttgaaagtgatatcctacaaactgttgttccatcttcaagtcaataaaagataataccttagagatgacattatagtgaccacatattttcttattcttattttttcccaaaccatcatatttcatgaaattatgaaatcataatgaatatacattttatacagctttatgtaacactaatttctggagatttaaattttacatatgaaatacattatttttgcagaattatgattggctaaattacaatttgtgtctgatctttttcatttcagggacttttaaaaactggccatcatttattcattgttttgcctaaccaaattgagaatttgaattaagaataaattctagtctcatctatagtctagggaaaaatagatatttggaatcattcaaggaaataacataagaagtgggactgttttactaaatatcttcaaatagtaattattctaaagcaaaggaaattcttggtgccatatttcataagagaagttatttgtccagaaaaaggatatttcaagaatgcagcatctcagatccatatcacataaggaaaattattggaactaagtaagacataaggaggttttccactactgtttcatcaaacaggttttctgtgccctttgccgtctcctctcctcctggaactcccagaattttcgtatttgttcagttggtggtgtcctatatgtcacataggctttcttaattcctttgattatttttttaatctgactacgttatttcaaaacacctgtcttcaagttcagaaattgtttcttctgattaatatactttattgttgaagcttattatattttctatttcattcattgaatttttaatttccagtatgtctttttttaatgatatctctttgttgaatttctcattcagatcatgattgtttaaaatttctttttatcgcctgtctgtattctcttgtatctttcttagtttctgtgaaatcgctattttgaattcctttccaggcattttatatattttattttccttggattttggcactggagaccttttattccttcagaggtgtcatgttttcttgcttttccatgtctcttttgtatttatgttggtatctgcacatccagcataacagttatttctttcaattttatggagtaaatttcataggaaataatttttattttttattgtttgagacagaggcttgctctttcacccaggctggagtgcagtggtgtgatctcagctcgctacaacctcagcctcctggattcaagcaattctcgtgcctcagcctcccaagtagctgagattacaagcatgagcaaccatgcctggctaatttttgtatttttaatagagatcaggtatcactatgttggccaggctggtctcgaactcctggactcaaatgattcacccacctcggcctcccaatgtgctgggattacaggtgtgagctaccacgcccaaccagaaacacttttttttttctgtagatgtgtctatagtgttagttagatagggtactttggtttcggttgtgggtgggtggtgtcatgtagtctacatataatttcttgtttattctatatttttgaagacgatttttcttcttataatcctatttgtcttcattaaaattaagattaaatgtcaatatcctccagtcaattctcagtaacaattcttcttactgtgagttgcatctagttttaaatatttagagtatcttattttattctatttatctctccaaaatagatcttgagctcctttttagtaggtaaaagacatgtcagctcaaacggcaagtattacttactcttccacaaatgatggtaataatattttatagaccatagagatagttcttcctcctcaactgattatctatgtgactttgagaaagttacttaaactttctgtttcagtctattcaacctacaagaaggacagtaatgtattatgtagctcaagaagtgtcatatagctcacatgaaataataaatgtgaaaaccctttacaaaacaagtgtaagtatgttgattttttttttagtggtggtagatttaggtaggccatttcttttctattctcacatatagtatttaaacagtttaggtacacagtgtaagtttattttacatataaacttaatagatccatgtgcatattaaatcttaactcatcattaccctgctcttatcaaccaagctaattaaaccagcaattattgtcaaaatgataaatggatttatgtaatctatatactatttgtattatatttagccagtattcccttctccaaaagaggattggagaagtatcacaaggaattctgggaaacgcaaaagtgggtaatattaaaattgtataaaggaaatatataggtatataattcgtttatccatttgcaaaatgctgtgaaaataaatggggataaattatgtattacacatatttggcctttgttcatattttcatttaaattattctgaatacaaaaattatgcataatccttaaaagtttgatctccaaattttaacctaccttgcaataaacaaaataccatatatatattaagtcaagcaagactaatttgctaaggaggagaaaataaaggctataatcacaataatattttatagcaattcagaagttagggttctaaacacaaatagtattaaatcaacacccaatccttgttgatgaacattttcaggggaaaaatgatctataaatactttattattttctgtattgcttaatctccatgaaatgtccatatttatttacaatgagagaactttaaagagaaagaatacactttttattttttttaagctggggtctcattctgtcacccagactagggtgcagtggcatgatcaagactcactgcagctttgacctcctggactcaattgatcctcccacctcagcctcccaagcagctgagactacaggcacgtgccaccacatctagctaatttttgtactttttgtagggatgggttttcaccatgtttcccatgctggtcctgaactcctgggctcaagcaatccatgtactttggacttccaagtgctgggattaaaggcatgagtcgatgcattaagcactatattgaggacaaaataaaaagaagcatgatattttgtcatatgtgagatactatgtaaatataatattttaaatataaattgacattgtgcttgctttccaaccctaagacttaaactgttttgttattaatgcatctttcagtatctttgaataggtcaggacacaattaaaaccaaaacagaaagtttctttttactttcatgtaagtatgatgattaaggtgacatataattagtgggctctttactgaaagagagattgtttataaaagcaaagacagctgaagcaacctttttctgctatatttacaattctaatgttaattataatggaatatccaaatataaaaagtggtgtcattaagagaaaagaaagatttcagaaaattagtctgaaaagaattccagaggcaaagctccatatattttagttttataattttatttctgaaatgtgcagctaaatttacttgttttctaaaagaaagaagctttcaggagcaatggcatgattttgtaatgaaggacagaccacatctatcacaagaaattatgaataatatgtttttgagagagcagcttacaacagattagaacttctgctgtccttttccctaccaggacaacaattttccatgctgagctgctgattgtgattatttattaaagggacattataatattttatttctcctctgatatttcctaacatagaaatatttgtggactaacactataatttacagaataaactgtattgattaaaaactacagagacctattgtgtcatttatttaatcacagaaagccatgttttcatccttaaataacatcatggtgaagcacttcattttatatattgtagaaattcaatgacagatgctaacgtatttatatgttaatttttaggaggaaatattttatggaatgatttatacaagataacacagaatggaataactttccagccattcatgccaataaaaacaatagtagggatttaatagtattaaacatcatgcttcatatttttgattgggtaatataaatatttttatattacatttaaaaagtatgtagtcttttatgcgccctttaaggattgtaaatatattcatatttgagcatgttctcttgtatcaaatacgtactaaaaagggccttttaaaataaatggttcatcagtgagataagtgactttattataaactgacttttgctaattttaaaggttttcatgttgtttttctttcatctttttggcaactgctttctcctcagtttttttacagctttgatattgataaaataaaaactttagttagcacagtttatttgagcaaaaaaaaaattcatgaattgggcagccctcagaaccagaagagactgagacaactctatctaatcagccaaggtgggcaggcaatatttatagacagaaaaagtaagtgaggtacagaaacagcttgattggttacagctcagtgtttgccttatttgggcatggtatggtaatgaatatgccttatgtgaaaatgatgtgatctgttggcagctaagcattgtctgaaactcagctgctatgattgactgaaactcagctatttgttacaagattatactcttaagttagcttgcagttttcataattaattatgttgtgggttgctatgtagggattcaaagtacagaagcagctttaagccaaatgtaatttaatataattatatctttatttgctatgtagccatctttttttatttctactcttctctccattcattctggaaaatgaatggagcacaagattattaaaataatgtaatgctatgtatatatgaccaaatttaatataaaattatgtttttttaaatattcacaactttctacttctcaaacccttctatcctcaattttaaagaacagtaaaatcatttgtatgagagagttttagaactagtaagttacacttgacttttgagactcagttcataatgagtaataaggaaaatggcagagaaatgctgatcagttagtttctcaataatcattagaggtattgtcaggattttatctatggtctaaatttccaaatgtttaacaaataaggatgaacattttagctactcttgagaccaacgaatgcattaactttagcctcattagatcccaagttcataccactgcagtgtgtggggttacaaatcttgtgtgtcatcaacaaggcctgaggatgtccacatgggcaggacaggaagagcagaaaaagacttctgaaaaaagaaggaaagaaggcaaatgagaaaaggggaagatgagagacttaaaaaatgcaaggggttccaaattttattgaataatatgaaagaaatgttttcaaagaaaagaatctttataaaaattgctagtttttagttgattgcatttcttttgtgaagaatagaggcttattattttagaatactagatgtataaaatcataattatgaaggttcacatataccacaactgtcatacgttacaacacaggaagattattttaaagaagcaaatcaacaaaactgttggcaacagcttagcaacttctaacaaagtgaattgctaattgtgacttcttgatctccttaaatttggttataattaaaagtatattcttattatttacaaaatcccacactgcttctatctatggatgtccctcctatagggtcacacatttctacaactggtcataaagtctcaatttttttttaagtaaatatttgatcacacacacaaaaaaatgtatgagaaagtgaggttgtcttttacataagtaatagtaaatattacctggtgtcttgcagaataaattaagataatttgggatacacaacctatatatctatctccctcaccttaataaaggaggccaggagtattgtatattgctattcacttagatctttagagcttattatgatacctggtaaataattagtgttcaataaaaatttaatgaacaaataaaaaaaagataatgactcacaggttaagtgaataattttgaatgtccatgttttaaatgtaaccttattaaaaactttgtttgaaatgtagttcttttcctttggtgacaatttacatgttaaattttaggaagtacaacaaagtttatacactaaatattattttaaatcacaaatgactgtaatttttattatatttatttgccagtgtttgggctaggttcacagctcatttgaaatcatatatttacattatttggtatgtcagtcttataaaatgcctgcttaggctttttaacatatcaaataacatatcatgtattttttatctaaggaacatgcaaatctttgttgaagattctcatagaagtaaaatatatcacaaatgttgacaactatatttttgcttagtagagcaataatagtaatccaagacttatgaactacaaataaatatattacatataaataattgtagttcattttgccttttccttaaaattgtgattgaagaaaataataattaattgcattattcaagaatttgtatcacatctttattttgaagaatggtgtaataaggtgaaatttcagaaagttgtaataaattctcatgttttattaatctaaaatatgaaaaagataaagatttagtaagaatatttttgttgtgaaaaaaatagcagtcgtattcaattctattttaaagttaaggatagtgctttaccttaaatttaagatgttagagaccaatttccttgtggtttgggattaacttttcttctcctatatccctaagcctagtcatgtagaagaaacattaaattcaggatacctcataagtagattgaaaggatattattgaaaaattggttttgaaaggtcttaagtaagaaattaatgttttctttcttactgaagtatgaaacaaagtaagtgtgagagagaaacagaaataaaaaatgaagcttatattacaagtattaaaaggatggatatttttccctcagaaaacgggatcagggttcaatgacaaaaatatttatacttatttagaagcaaaaatcattgctcttgaatttttatcaattaggtatttgataatggaaattccagaaggtgcctttagttgaatgttttatgaaaggattaaagcgcctgctttgtcaactttttttttaaggtctccttttttaagtatcctagaaagatagataggttaggcatgtcatgtgtgtgtacatgcatttgtgtgtgcatgcactcttgtgtgtgtgatagggatggagagaaaatgagaaagagttgagaggattattctttaaatcatgttatactcagacagctgtcttcatagaaatatgatactttaattaaaattagcattcccttcttgtcttcagtataccttgataacaaaaatccttttagatttttggttgagaaagatagacaatagtgtgaaatttgtagccatgagtatattttgaatattttccggtaatacagtgtatcttactgggcagaaatgactataaaaggaagaaaatgtatatcaagaaaaggaaatgacaaggtgttattattttgaattatagtgtgaaatatttgggaaccaacccaaatgcccatcaatgttagactggataaagaaaatgtggcacatatacaccatggaatactatgcagccataaaaaagaatgagttcatgtcctttgcagggacatggatgaagccggaaaccatcattctcagcaaactaacacagaaacagaaaaccaaacactgcatgttctcactcataagtgggagggggacatcacacaccggggcctgtcaggggatgggggcaaggggagggatagcattaggagaagacctaatgtagatgacgggttgatgggtgcagcaaacccccatggtacgtgtatacctatgtaacaaacctgcatgttctgtacttgtatcccagaacttaaagtataataataatacaaagtaatgaaaaagtagtaggaatattgatattggagaaataatgacagctcaactttaatgttcagttgattctaacactacctcttgtaattaaatgtatttcctttttctatttaatggtaaaaatctacagtcattatgataataaacttgcgcccacatcaacttttcattttacactttctataatatttgaacaatatgattcaccaattttctgtttatagtatagcaacttaagaacttttaaaaaatattcatgagacattttcaataagattcatttatagcttcatttagacctgtgtctcatcatatctttgttgtctccatttaaatttataatattccattaccattatataacacccttctttgtcttttttgaccattgttgatttcaagcctgttttgtctgaaattggaatagcaacttctgcttttttctgttttccatttgcttgacagatttttctccatccctttactttgagcctatgggtgtcattgcatgtgagatggatctcttgaagacagcataccactgagttttactattttattcaacttgctattctgtgccttttaattgaagcgcttagcccgtttaccttcaaggtcaatagtgatatgtgcagatttgatcctgtcatcatattgtttagcttgttatcatgccagacttcattgtgtggttgctttataatgtcaatggtccatgtacttaaatgtgtttctgtggtgattggtaatggtctttttttccaaatttaggaccttttaagaacttcttttaaggcaggtctggtgctaatgaattcctttagcatttccttgtctgaaaaggtcatatttattttttgcttatgaagcttagtatggctggatatgaaattattggttgaaatctcttttctttataaatgctgaatctaggcctccagtctcttctggctagtagtgtttctgctgaaagttctgctgttagcctggtggggttccctttggaggtgacctgccccttctctctagctgcctttaacatttcttcttttgttttgacattggagaatctgatgactatgtgtcttggggatgggcttcttgtatagtatctcatagggattctctgcatttcctgagtttgaatattggcctctctagcaaggttggggaaattttcatgaatgatatcccgaaacatagtttccaagttggttgctttctttcttctttcagtgaattgtagatttggtctttatacattatcccatatttcttaaagggtttgttcattccttttattcattttttaaattttttgtcagatggagttattttagataactggtctttgaactctgagattctttcctcaacttagttgattctgctgttagtatttggtgattgtactataatatccttgaagtgagttttcagctctatcagatcaggtttttttttttttttcttaaaataaccattttgtctttcagctcctgtattgttttattgtattccatagattccttggattcggtttctactttctcctgaatcttgataatcttcatttctatctatatcacaaattgtatttctgtcatttcagccacttcaggcaagttaagaaccattgctatttctggggtatgagtgcagttgtttggaggtgagaagacactcaggatttttgagttgctagagttcttgcattggttcttactcctctatgtggcctgatgttcctccaatatttgaagttactcccctttgaatggctttttttttttttttttttgcttttctctcctttgatgctcttatttggtataaggtgatttcagctgactggctttatttctaggacatttaaggggataaggcttagctcagtactcctgggctgcatcctctaactctggggagttggtaatgtgctcttggctttgttttctggcccctagaggttaggaatctgttgcattggagggtctgaggtgttccccatctgctgacgaaaacactccgatggattgtgccagccaaagccttcaccagggtgctggcaggatgatctgtgcttgcttgcatgtgccagcaattgtgacactgtagtggggtacaagcacatttcctgtggtggggaagcagcaggagcagggtacagtgttcctgcacatgctcactccagcggcatggtatgggtgggttatggttgccagtgtccatgcttgcacttgcaccagtggcagccatggcacggttgagacacaggttatcacttgagacaccagttgttgcggggctgctggcctccatgcatgcatgcacattggcagcagtggcagcatggagagacagggctgatggcatctgtgtgcctgtttttgccagcagtggcagcctggctaggttcccgtgtttgagcatctgaggtgatgggtggcaaggagcactcacacatccatgctggcgggggagggaaggcaaggacgacctgtgcatgtgtgctgacaaagtggtgtggaggtggccatgaccaagtgcctaccaacaaagctgtgcaggggaggctgtggtagaaggaaggtgtgagtagacacacattggttggggccagtctgctggagctctctgatagccaggtgctgtctgctgtaataggtgctccgccgaggacctccaggaagcacccaggttggacatctgaggctacaagtgggcatggccaaggtggggccttgggagaggatagcagacagggatcactcagatcagactggctccatcacatgtgcagaaccaccctactctgtccaggcctggtggtcaccctcaggctaaagtctcctaaagaagcatgaaaacccttgggagactggagtccctggctgtgctccactacagacggtcctgctccacgtccagacagtagcagaatcaggctggagttctgattctgctacctatctaagcagctccctctgccaacccaagtgtctgtaggggttgtggggtctcctgctaccaggatccatgaggttcattgtgagagcatgccactcctcagctgttcagctctccgcttcccctggagttgcaggaggccaggaagagttcctggtgcttggtagccttgtgcaggatacccagctatttcccccttccgcccagcatctgtgtcctcgctccatttactttcaatgccttctctttgaagatttgctcaaagtgtgcatttaaaacatttttaaaaatctagtttcactttcagtcttatcacttttaatttctttgctgcacttttgctgctttactctcttgattaactattttgtaaagtgtcatatgagtgtattactggggaataaacagataacacaactacacgctttgctgtttgtatgtgaactaacagatgtgcagtgaccaaacactggcagattctgaaagaagtgatgcgattggtcattgatcatgatgttcctattatttgcattataatttgtggaatggagtgttagcagcaaagtttatgctttgttcaattttttatagttgatatactgtggtaactgaaatttaaattttattgttgctaggctggcatcatttaacttaaaaaaaaaaactagtaagtgaagcccatccatattggtagcaggcaataaaaagactacttgccctacaaagtcacaatgatgacaataacattcaagaataaagaaatatgtcaactgaacagagtcaagacagtgacacatatgtatataaatcaaaattaagctacaaatgaagtgacactttaaatcagtgggcagacataacctggtcatcaaataatattaggaaatctgtaccaaagaggaagaacgactatattatactcttctagggaataatttacacaataattaataatacaagcgaggataaaacctagaataatttgaaagaaaatgtagacaaatatttttatgatctttgcaataaaaagttctcaataaccaaaaaacaaccccaaaacaatgcctagatacctgatcatgaaggaaagacagatttaactatataaaatgaatcatttctttattatatcagataagtgacagactatattacagaaaaagaaatgtcattaataataaaaagattgtataaaatacagtaagaaaaatcttataagttgattaagaatgtgcaagagaaacaaataagaaatttgcagaaaaagaaatatggatggctaatctttgaatagatttttaaactcattagtaaatcagaaaacatcaattaaaacaataattaaaacaataattggatttttttatcatcgaagtagccaaagtaaaagattaattatcactcattttaaagaaggtgcacagataactggcattcttatgctctgctagtgagagtattagtttataaataaagcctttttagaacattcatgacatcattaaaatttttagcttatatatattttgcctagaaattccacctttaggactttctctacaaaattaattgtgcttatacctaagacaaaagtatactgcagactacaaatacgaaaattagcatttcatcctataattttttttatatatctgttaacctttttctcaaactaggctttttcatcatcctggcctatctgaggataatatatgctttgtcaatattgttcttttcagtcaaacatcttctaattatatgtctacacatatagtttattcaagaaaaccatcaaaagtgatgtggatagtattacaatgtgcacagtgctcaaatataatgcaatattttttaaacaaatctcaggtgtataatactgtgtttcaataacagcatttaatggaactgtatacagagtataactgagagtgtttggaagggataattgttgccactaattaacaacggtaatggtgaaaagttattcttcactacttttattttctcatttctaaaacaaaaataataaaaccttgcatgcatgattttttaaagattgaataatatttataaagtggtaagttttggtgatgataagtagcaattgctattttttatcttaaaagtcattgggttacagtatatataaacagactttgcctatgtaaatgatcgtttctattataaattggtgcaccttcaagatagagaagtatttttaagggaaatgtaagaaaatatgtattttgatttttaatagccttgacaaaaatctcctcataaatcatttttattctagtaatttcttttaagaaactatcctgttatatagacttctgtgaaaaatcagtatatgcatttcctcatttatattttccagtaattgaattgcttttaaaaccctcacagcaatttttattagtgtaaatcactgcatttaactatttttatctttttgagctcatttttggtatacacatgtgcagcagagcaaaaaaattgatatcaagttgtatataaataccatatattagaacaagtgcaaatatatatcctagtagatttttaaaaacaatgttttggtaaaaatatacctatactggaaattgggataagaggacattaaggtttgacactcctttaaaataattaaagcaaaaacttccatgtctctatgttaactttatatatcttaagctacatttctcagtatgattagcttgagaaatatttcatttcagcttgacagactactactcactacctattacctgttctaaacatagaagataaaaaagaaaacaaaagaaaaacaaattcctggtttcagaattcttgcagtagcaaggcagatggataaataaataattaagaaactgagtggcatatgctgaaactgaggtttgtacagggcacagtgttgggaaaagggagtggtaatcaactatacatggagaagttagggaaagctttctatgtatttaattcactacctttgtgttatgctaaataatcatctcacactccttgattaaagtcaaatagacataatgtatctagacagtgactaggcacggaattgaaccaatattaaagaaaattaatttgtgggcatgaattttagagtcatgtactcacctgtccacctcacctctctctccaattttgtgtcttgtttggtatgtaaatttcacatgttcaaaaccgagctcttgacattccgctcctgaacttactgctttgtattcctctgacttccaaaatgatctttctgtatgtcaggcaaagaaccatagggtctttgcaagtatgcttcatgtgcatgaaatgttcgtgtcttggatattcacagctctctccctctctcgtatagttattcttgttttgcttacctctgttttctgggctacgttttatttttatgttgttatcatttattttattccttattatttctactttagaaaatgcctttgagatatctgttttattaattggcatacattttgcttttcctgaattttttgactgtttaatttttttgcatataacaaaggaaaccccagtattaaaaacacgattaaaattcccaaatgaaatgaacgcgaggtacctaagaaaacattgttctaatgaacacatcattgggcaataggagaacaaatttcctaggaatatgattttataaaataaaataaagtttacagacaacgtaattctctttagaactattagaagtgttatcaaatacatctgtaacagtatatcttgtgtaattctgttttctattaataattatatcaaagaagcaacatatttggataatcaacttatataaaaataataaaagtaaatacaaggcttcagggttatataaaccttcagtaaattataaacatattgaatattaaaacattaaaaactaaatattactttcaataattcattcttattacaccaatttcacttggataattatagatgtagaattaatggaatttaagaatctgttatgcaagattactgcctgtccacttactgaaactgaaaagttatgtgacttaggtctcagatttctcacataaagcatggaaataataacataatgactttatgaggactacattggataatgcttgtaagattctctgtttctttagtgctgggttaagttttaacaaatgtatatttcctgaagagcttagattcaagttagacatatttttaaaaatatatatctaatttttggtagagttacattatagtttattacacattttatcaatttcaaaaggggcaggcaacatatctaatacaatatttaaagtatagtaatctgccgggtgcagtggctcacgcctgtagtcccagcactttgggaggctgaggcggaaggatcacgaggtcaggagatcgagaccatcctggctaacgcggtgaagccccgcctctactaaaaatacaaaaaagtagccgggcatagtggcgggcgcctgtagtcccagctactcaggaggctgaggcaggagaatggcgtgaacccgggaggtggaggttgcagtgagccgagattgcaccactgcactccagcctgggcaacagagcgagactctgtctcaaaagataaataaataaacaaataaagtatagtaatctaaaaaactcaagggaagcaatatcttgaaagacaattcttaaaaagattgttccattaatttttaaaaattcaatggcataagggataataaattcagctctactggtaaattatcacattaataactagaggaaaatataggagaagtacgtattttacctcataaattttggttgctagttatttgaagttgtttaatgattaatgtcctgttctgtaatataataatctcaacacaagaattgctttaattgtcagaaaatctcattttaaaggcacttgatatttaatatttatcaacctcccactgtacacctggttatgtcttagacacagggagcacaggtgaacaaaacaagagtagtctctgtgttcatgagatttaaactatattaaaagaatttacacaattaaatataatattaaaactgtaatataggaacgtctcttggttattctgacgttgagactaaaatatttccagccactgtttcatagaggactttgtagtacttgggctagcttaagaaataaaaatgatataagccagtagtgttactttcaaacaccagtcttagactgttgataatttgggaaatatatagttagctcattgcttatgttatgacaacatttggggaaagatttcctgaagtatgtgcaatattttgttttgtttagtttagcatatacattgatggcaagtattctgcaaaggacataagctatatgtggggtgaaatcataaaagtacctctttccatcatcctaataagtctgtgaattgctttctacttggccatgtttgcactagtctccaatttttacactgtacctcacctaaacatatcactaggattgtcttaaatgatatatattttactttttgctgtaccgaactactaatcaccatttataccaactaattacaccccaaggcacaaaggggagtaaacttaattagtctgaaaccccaacagtgcagacttgccatctagtgatgacagaaggtaactatagattacaaaaactgtctacacatatttatggaacacttactttgaagcactggcaaagatacaaagatgagtaagacacagaatttgacccaaggagttcaaaatacagtgagagggagaagacacaagcagttacgtttaaggcaaaaacattgttaaatggcagaaagagatacatattacatgccaagagaagggcagaaagatgatgaatgaactctgattgaatagatcacgtaatttcctataatacacatatggtattaatgactaggatactgggaaacaagtttaccaggtacaaatctatatattgcaattaaaaacttgtgaatttggggaaagtttgtgacagaaactgagtgtagaaaaagtggaccacggagggaacaccattagagaagaaaccacatcatattcctctcatttcactagaatctagaatagtccctgattgatatctacattaatttagttaatatttgtttgcatgttaattactgcaaatgtgagtaggaagcatgattataaaaaatcttgaaatatatagataggaatacttaaaaactgtttgtatacagtattgaatattaatatttttgagactctatgacagatacttctaactgcatacccaatactttttatttccttaataacagaatcttatgtattttcagagcagcacatttaaggaaataaacttctccactttttttttaattctaggatagtaaaatgacacagttctggccaaggagataaaagcagaagtcactgaggggtgtttataggaggccctttaaaagtctcggatggggatgtctttgagctcccaaaaccaattgcgagcatggagagttgcattgctctttaagaatggtagagcagaaagctgaaatgagaccagcttcctgatgacattatggaaccatcatagcagccttggactgccagattccaaaattcttatttaagtgagaaaaatataaccttaatttttctaaagccattttccccaggcttctatcattggcagccaaacagaattctgaaattatacagacactgactaaaaagtcagaaaccattgtaggtagcaaagcatagattgaattctgaggatgtttagaacaagaaacttgctaatatcatattgccactgagactatatttaatcacacttttaccactgttgggactgctattctcctcatcactcttcaagtaaaacactatgcaaaatccatgtcaagcaccattgtttctatgatgccttacctaacatccatttagaattaatccctctttgtgcttatcttgctcagattactactataatacttataaaagtatagcaggcagtgtgtattgcttctacaaccctagactaccctggttaatagaacctcctttttttttcctagaaagaaaatgtatgtctgccctgggagcgtggcatggttgatctaaactaaaaagagctatcttgtcctgttttgatgatatttgttttctctggcttctgtgcataagacccagttctccccagtaaaacaccaggaagagaaagttggcttgagggttcctagacatgttttttttttcttttcattgataaaagaagagagcctttgtagaaaatgcactttgttctttcactgtcttgcttcgcttttagatgaactcctggtgcttgaagctacatcatcttgagaccatgaggcaataaacctaagcatgaaattaagcatgtcactgacgggaaaattctgggtcatgcttggtgaatcaaagactgaaaccatctatctctggatttcaatccttgcattaaaatatacctcttattgactaaaattactgaccaatacagaaagaaaatatttatgaaattttctcagtacaatattttcttcctataatacattatctgatattaacagacactattttacatacaaagaaagagaagctaagaacatcaaagtagcttgtctgaagttgcacagctatgaggtagatattacttgacttaggtatgactagtttcttccatttgattgaagatggctgtgaatactctctagccccactcatcaaataaatggattacaatttttaccttgatactgtataaataaatgatcagtgaatgtgaagacaggtaactcctttaatcatgattctacaagaaagattcaaggcaaccatttgtcaatttaaacgggtaagttttaccttttgtttttagaaacacagtgaatttggtcaggtgatagacttcttttaagtgttcttaatttgatatgcgacactctgcttttagtttctcttttcacaaccgaagttgccttttcagaagaaattacggaaataggagagtgaaaataggatttgctgcttttgacaaatcacctattgacctcgcaggttgttcaacagtttttatggctcttgggtaattggaaattcataaataactcaaaattattcatattaaaatgttttctgattattgattaggtcacattcctttaattttactgagatatgacttcttagaaggaaaataaatttacgttgttttctagagtacattttattttatttattttaaacaaaacaaaacaaaaagttttctaaggccttaacaaagctactccttttggttgaattagatactagtaaataagatttgttgttcactagaataatattatttgagttatgtatgctagttttctccaattattttaataagaaatatttaatatttaacaatttctcaattttctgtttttcaattaacactcaatgaaattagttaccaatattatcagatcattagattctccattttaacaaatttttaaataatgtcatactttgtttatatatttcttagtatacttctttacctaaagtttatttatttctaatttgatgaataaactgaaacttattttccctgttatgttataaagtttgtcataatatttagagaatcatggcagtttcagattttaataatccatataagaattactagacatgctatacattaaaactgtgtacagttcattagccggtttgaatgtcacatttaacctcagcctacctttgttcccatgcagagattttgagtgtaccactactatttgtgtaagcaagtaatttattgttatgacatctcttatttggaggtgaaaacaatgcagtgtggaactagttgtaagtggtttgtcttgttgcaaatttattgtatttttaggtcatacattaacatgactttaaaaagctcagctgacttatctgattaatatgattgatataaaattatgtcaaaaaaatgtgttgcaattgggcagggcgcagtggctcatgcctgtaatcccagcaatttgggtggccaaggcgggtggatcacgaggttaggagttcaagaccagcctggccaacatggtgaaaccctgtctctactaaaaatacaaaaattaacagggcatggtggcacctgtctgtaatcctagctaatcaggaagctgaggcagaattgtctgaacccaggaggcagaggttgtagtgagccgagatcgcgccactatactccagcctgggcaagagagcaacactccatctcaaaaaaaaaaaaaaaaaaaagagttgcaattgaaaaatggtcaggtgagaagtatctatatacttacctaaagagcaatacaatactttaaaaaactctataatagctaggttagaacaaaccaaaaattaaaaatttagaataaactgtaatatttatgaacattcaattaattggtgcttcatttttagaactccttcatgtatcatatagttacgtagtacaattctgctctgcagagtaacatacttactcttaatgtgcttaaattcagagtaaaattattttgagaaatgaaaattctagtataaatattaacatatacaaatatctataagctgtaagtacatgctattttccctgataattttataaataagaatgtaaaataatacatgaaaattggataattgtcattttttcagacactgattatttcattatgcagcacaagttgagtatgattatgtgtgtgcatgtgtgtgtgaaacatgcatatattgtatgtttggtacacatgttgtgtattcatatgtttataagttaacataagatgagaaagagctctcgctgtctctctacatagcgagatgtttgtgtgcatatgtgtgtgtatatatctaaacagaaatatgccatctttttacctttgaaaaactaatatgggcaatacaaccttgtccagttaatttcttcaatttttttttagttgttgggtaacactagcaaacattctttaaataatctggtttataccagtggtttaatgaatgcatttttggtactagaatgaaatttattgcaaatgagcgtttatctaccaatcagtagttaatgaggttgtaaatctgatagttgttgtgattgtttcacatgttgttaaaccattaataaggattcataaaacacagttgaaagttaagttttgtttatagaggctatcattctgaaaacgataaaagagtcattcactaaatttactaagtaagcaatatttcagacacaaattaggggagtctaattattaggtacaaccaagtaatattattatttaggaagatcaaatttggcatgtcaggccttttggtagcatactaattggcatagttacacttggttactaattaattggttttacactagccgtctgtaaatacagtgtttcccagaggggagaggagaggaaggacaccaactttatttttaaatgaacatttatttttgtgctaatgagggtgttcaggggtacaaatgacaagacccaactcaaagggtacattaattgcctcacatagtaatgcagagagaggacagatttgagagatgcttgacttctttgctcaattattttatagaatgcagggtttttgcattttcccactttgtttcagtgctttccatggttaatgttggtttccttctcaggtcaaaataagagatcgcatctagaaatgataatcctcctccagttgaggcagattttcttagaagcttcctagtataccaaccttcatatcacactgaccagctatcattagaaagaaataagcaatttccaagattgacttagacccgtcatctgaggtgggatgatggttgagaagtcaacattaatattcagcataatccacctttaaattttgtattatattagtactatatgatgaatgtttaatctttgggcagccagttctttcatctggatatttacaattttatttctgaatcaatctgaaaaatgaccgcctgaactatatttggttccctactagaagcacagtgtaaaaatgagtaattatgactgggcacgatggctcacgcctgtaatcccagcactttgggaggccaaagcgggtggatcacaaatcaggagatcgagactatcctggctaacacagtgaaattccatgtctactaaatatacaaaaaattagccgggcatggtggcacgcacctgtagtcccagctactctggaggctgaggcagaagaacctcttgaaccaggaggcggaggttgcagtgagccaagattgcgccattgcacccagcctgggccacagagcaagactctgtcaaaaaaaaaaaaaaaaaaaagagtagttatgttaagactccaaagggtttgagcatagtgtaaaaatgggtaattttccttaagcctctcaggaaaggagttccagtactaagccaaaacaaaaaaattgtgtactaaatgtatactagagggagtaaaagacaacctgaatgacatagaataatgcatgcaaggcatttatagactttctttgattttatatcctccattaattttgaaaatcatcaacttacactgtcataacatattaaaacttgaacaatagttatacagctgacacagtaatgttttgatatgcttgtcatatttacagtggtcacaatttcaatttttcctttttctttttttttttggtttttgttttttcatttcactgtggtcatggtgacccgtaagccccagatctgtttgaagaacatatttcgttgaattacatttgatttaatttcatgttttcattgaaaaaatccacacgaaacagccttaatgattttaaaatgttgcataatgttatttaaaacattatccactacatttttgtaaagcgcaagtgaatacttacctttagagttaattgcttgaaaagctttgctacttctgaggctgctgtgtactttttctgtattaattaagaagtatgtgacaggaatatggttctttttgttttggttgtctgaagttttacagccaaatttaagaatgaaccataatttttataaataaaattaaagcttgtaaaacattttatgttatttttatctcaatcttaacattcggatttgggttctctgtggttctgctgtttctaaaaatattttgttagacttgataaaattcctacaaactgactcataatttagtgttaaaagggaagaggtagatagacatagataagcagatatattttgcattatgtaaattatatagttaaattgatttttcctaggctggtatgtaaaaaagtaggaattatacaaatatttgctattattatcagtggctaatttgaccaacacttatactgaactagcctatgattatttttatttgtactgtaaatgcagctacagaatatatcattttattaaaattaaattttagttgctatgatacttgagagttaattacatttgtgatatgctctattgggaatgcaaaatctcatatgaggcaaaaccaaaattagaatttctgttactctcttcatagtgatccattatctaactaacactatcaaggatggggttttgtgagtgacaatggggtgtgaaagaacttatgaatttattcattctataattaatataaggtaaatgaacacatctttaatatatcaagatctaatatggctccagtataacttttaactaagtttcatcataatgtatcataatctattttgatataactataatgagatgaggcttgaatatcaacagctatatgtaatattcacaacataaaatttaaaaaattagatctgaccccaaagcctatttttaaaaatttattcttataatgattttttttttttggagatagcatgtcaatctgttccccaggctggagtgcagtgatgtgatctgggttcactgcctcttccacctcctgtactcaaaggattccccccactgcctgccaagcctcccaagtagctaggactacaagcacacaccaccatgcccggctattttttaatattttttgtagcgacagacttccaccatgttgcccaggcaggtttcgaactcctgggctcaagtgatctgcctgcctttgccttccaaagtgctggaattacaggagtgagtcaccacacctgaccatatgaatgtatttttgtacaggaaatgtacaagttgaggctgggtgtgatggctcacgcctgtaatgccagcactttgggaggccgaggccgggggggtggggggacggcaggtcacaaggtcaggagttcgagaccagcctggccaacatagtgaaaccccgtctgtactaaaaatacaaaaatattagccaggtatggaggcatgcacctgtagtcccagctacttgggaggttgaggcaggataatcgcttgaacccaggaggcagaggttgcagtaagctgagaccacaccattgcactccagcctgggtgacagactgagactccatctcaaaacaaaacaaaacaaaacaaaaggataggaaatgtacaagttatggctagaaattctgaatatatcgtaactacctttgataagacaaacagaaatggtgtattttttcactgaattatcacagacaacacagaacaatactggtaatcaaacaaacattaaggcaaaattgaataaaatatattaaaatgtggcaactattaatgcttacagaaaagcaagcacatatggaagaagaagaaatagaggatatctttgaaagatttttcttgggaacatagcactgaattctaaatgagcagatctgactttgatttgaacatttgtgcttatcagcttttaacctttgtggaagtagcagaggctctctgagcatgatgctcacctggaacatggtgttagtttctattctttcttcgcacaactgacatgaagaacaaatattaaagagctttatgaactgtacatgtaggacttagtcttttgttctttttgggttaattaaggagtgaaataaagactgggagtagcatctcaggcctcataaacaaaacatggccgttgatactagaacacagatacatgtactttgcccttattttagaaaactttttctgtttgagaaaaattactcatgacttaatagttatggcaggcttccagagtgatccctgaatattcatatactagtagttgtaaataatctagaggtcctggaattcctgtgctattttatagtcatgacttggagagatgatataaataagcatgtagatatgcaataagctatatgtgtgtgtgtgtgtgtgtgtatttagtatagataattttccacatatgcccataatacgtacatatgtgtgtatatatgattttgtgagataacactttaagaaatatgaagaagaaatgaaagaggaaaagaaagaaagtaggttgatgaaacctatgagccattaataagaagaataatgatccttacaagtatttgatccactgaggaaagagaagaagctgttggattaccactgtcttttgcatcggctccttaatagaagtgatggcccaagacgagacagtagtaaggggtaaagagaaagaaaatttcaaaaagaggaagataaagggtttacatgcaaatgattaaactcatagttttatataaatcactttagtcggtgaaaaacattatctccctaatgttatacataatcctcacctcagagataacataatgtataaaactagggataaaataacatgcaaagactgaaagtttatctaggtatagaaatcatacagataactgagtaaacatcctgtaaatatttcagttaaataattacataatttttcaataaagaaaagctgtataatgtataacgaaaattaatagtcaatgggaatttggggaaagacaaagattacttcttgttttccagatggtaatcactaatattgtgtatcagtttttttgtgctacatgttatgaatattttatattttatttgtttattttgcatgttatttaatttatcaatatattataggttactaatattttgtgtatatatggcttacgtttatatagcagataatatatatggaaccaagcactgctctaagtgtttcagtaactcacttcattctgtcagcaatcctatgaggtagattcagatcaagaaaatgaggctcagagagcttaagtatctttcccaaggacgcacaggttaatatacacaaaggtcgcagtcagatgtgtaccaaggaaggttgaaaaccagcagcaggctcttatgacaggtgggtctaatcttggctttgtaatttgcaagatgtctaacctaggacaaatcactttatctctaaggggcttatttttctaaggtctaaataagtaaattgcattaaatgatctgtaagattgcttctagttctgttacgcctatgtcttggaatcaacggattcccaatagtaaaaaggatataatgaatatcttaattgagatagggtgagccagagagggaaaaataacatttaaaacagcatatgtttctaggttgcaaagtagaacagaagcatttttttgttttctattacaagtgatttgtaagtgattaagtaaggctgaggaaatgcatattcaattttattttacttcttaatccaaagcagactgcaggctccaggcagctgccacattagcattttgcaggcacacatataagttcaattccttataatcctgttttctcagtgctaaatagtcagtgatcatgaagtcatggtgttaccacaaagctaagaaagtaatgtcatgtcaatttacaacctttagaaacacatttctaaattaaatggaaagaatatgctaatgcaatattaaggctgcaactttaaaaatagaaagtcaagacctacagaagttatggttttcattatcatcattaacatgactgcatcacatacactgaatatattagtttttttttcttacctaacttgtaatccaaagtattgcacgtatctaacttaatattatttgggagaattcttgcctgcatttcatgagttttgtactttatacttgaatgcttaactttatttaaaaatgtatttcatagatacatatgccatcaattattaatgtactaataaaaaacaagcaacattatatactactagaccacacacaaaatttgcatagagagtgatgtcaaaatttgtatgtacacaaggatgtttttctccaatacaaaagttttaactgcctaattttgcttcgcagattgcttatattcttctaaatcttttctgtctttcgtactgtctcatctgatcattcagttcctcctccttattccttggttacccagccaattcctcattgtcatgtaacacgtactccagtttttttgctttttaaccactgttccccataaaaatttacctgctctatgtcctgtttccttgtagtttgttagatgatgaatttctgagtcagctgaagtagaaacaagacaatcaagtcacctgaagtgcttcgaaagaattactaatgcctactgaatcagaacttttaaaaatgattttcagaatatgcatttaagaaaaaaactcttcgtgttatgccagtgttttctcttgttaagaaccattttgctcagtgtttccatgacacttttattattactctttctgttattatcattaaagtattaataatcaataattacaatatattggcacttttcagttacagtagcattttcagaatactttgaggattttagtcccagagaatgaataatacgcgaatttcattcaggagcaacggaaagttacttccgagcacagggactcaaattgatgttcatgtggccaagtactaatgaaattcctcaaagtgagcaatttcattttgaagccagaaacataaccattatataaattcatgtcagcaaatacaaaaggacatttagaaacagatctttacatgctttatatgcagaaggcagatatagtgagaagcagcgtgtcagaaactttggataaccgttgcagttctgcctctgtggcatagtgatattgcttaaatcatttaaaatcactaagacccagtttctttttatacaaaaataagataattacactaatctctgagtaactgcaaaaatgactgatggatactgtgtgaaaatgtttggtaaacataaatgcaatttatttataagaatatcattggtatacatttaaatgtaaagaattgcgtatccaagatttccattttgtttaataagttcgtttaattaaattaatcttttcctcttcatcaaaaaaatgtattgcaccttttgatgagaaaattgtgcctaatattttttattgagacatctgtggaataatgaaatgagcaccaaacttgagtcagaaaattttcattgatacattaacatctctgaagctcagtttttgtatcttaaaaatgttgcaatattttctcacctaagttaattgcaagatttgaaataggtaagttttgtgaagtaaccaagtagagaataaaatattaattaaataagcacaacaatgaatctatagttatgaacaggcaaatattccgaatgaaagaagttgacttctagaaggacacttaacagagaaatctgtcctagttggggaattagaagtgacacttgagccaagatctgaaaaactgtacaccagtgagaatttgtttccatcatgagccaaggagatttccaaaatagtaacttatttgagatttaagtataattcttgtattagtctgttttcacactgcttataaagatatacccgagattgggaaatttacaaaagaaagagatttattggacttacagttccacgtggcagaaggcaaggaggcgcaagtcacatcttatgtggatggcagcaggcaaagagagagcttatgcagggcaactcccatttttaaaaccatcagatcttgtgagacccactcactgtcatgagaacagcatgggaaagagccatccctataatttaatcgtctcacacctgggttcctcccacaatatgtgggaattatgggagtcacaagatgagatttgggtggggacacacagccaaaccatatcaattttccctcaaataagaggactttttaagtggatagtctatggctcatttggtagtaatgctaaggtattctgggacttctaaaagcctcaggttgaggctgtcacccacatggtccaaaatgctagctagaaccaagccatcccaagtacattcagccagtaatggaaaaagagaaagaagacataatgttttactttaaggagacttctctatatgttccacaatatttcttactagatattattggtcagattttattgttagaaggacagctgataaatatcaaattcatactgagaaacgtaatggttataaggcaggtttctgttcattggggcagactgggactaaatacatagttatctgtcatatttgtcaaaatgatcacagaacaattttctgaacaattatgtggattattacatagaaaaggtgagaagaaggattgagagcaggctagagaagacattagggtatgtcataagtgactgttttagactcaacaatcggaatcagagggaacatagtcaaattcctactttaaaaagactacttcgctatttgaataaaatatttaatggagccatcaaagcctgaatatcagttattaggctattatggcagcccagacaagagagatggtagcctaagcaaggatggtggctctataattttttgatacacttaagagctatttaggaggttaaatctatagaactcagtattttaactatattaaatataaggaaagaagaagcgtcaaaaatgccttttgtgtgtgtgtgtgtgatggagcctcattctgtcacgcaggctggagtgcagtggccgtgttcttggctcactgcaatcaccgcctcccaggttcaaatgatcttcctgcctcagcctcccgagtagcttggattgcaggtgcctgccaccacgcctgactaattcttgtattttctgtagagacggggtttcaccatgttggccaggctggtcccaaacttctgacctcaagtgatctgcttgccttggcctcccaaagtgctgggattacaggcatgaggactacgcccagcgagaatgacttctaagacactgtttcctctgtctctgtctctctctctttctctccaattagacttggttatatcattagcaagataaagactattataagataatgcatttttaacttagtgagctcaacatggtacccgtgatttccaaatgaggataattcatttcttcctagcctttcagagtaattcattaactggtcaagctatccgaatttcaaattctgtctagtgttaaaaactctttatcataccccatagactacatggaggacagtacaaagtccattttttctcatattggcaacagtgtagaagtccagaatcaggctctactaattgaaagtccatttgatatagtgaagccatttcataattgctatgtcactatgcaaatgttaggcactattatgcccataatttattatttaaatactatccattctagttattaaattggtaatttaaattatatattatacataaaatatatttttcattaattaacttattaatgcggtaatcacagaattttccaactattatacttgttatgtgataaaattgtatctgtggctatgtaaaaattataatttctatctttaaattcatatatagttattagctctaatgtattcaaaatcttagggtttaaggccaggcatggtggctcatgcctgtaattccagtgctttgtgaagctgaagttgaagattgcttgagggcaagagtttgaaaccagccttggcaacaaagtaagactctagtctctgcaagatatgaaaaaagaagccaggtatggtggcatgcacctgtagtcctagttacttgggaagctgaggcagaaggattgcttgagcccaggagctcaaggctgtagtaagccgagatcatgccactgcactccagcctgggcaacagaatgagactctgtcctcccaaaacagaaaataaaaaaataaaaaataaatagggtttattactcatgaatgttcatggtcttgtaccaaactgtcatgtggaagaaaggacaacatagctctgtgaaaatgaagagagaagaaaagaggaagacagagaaaaggtcagataatcacaattgaaggcacagtgggagcaggaaaaatccagactgttctagcaacctttagagcttactagaaggaaaggaaacaggagtttgttttagaagtgatgaagagatagttttgtttgattaaaaatggaatcctattcaggaaaactcacatgagaagagacaagatatgatgtgggaccagaccccagataatgaagcaggagttcatatcccaactcattaggaacactaaatgaaaaatgtcttcttctttctgccagagatcttggaaaccccagaaaaactttccctattgatggacctcgcatctaccattagataaactgcaaaaattatagaggggtcagatgtaattttggcatgattatttaagggctctttctcaacaattttaaatcttctaagttaaagagataacctaggagaactgcagctactagatggttggaaattatgaatttggatgaataaacatgatgggtatattacatacaaaattggtatgaattatttgaagatttaaaagtttcagctggtttggtttcagtgatactacaccacaactcaagacactattatctcaagtccatggttctagcaattattttctttcttctccacaaaacaatgcttaccttgtttctggacggtttatttgctcttgcaaggttcccacttaattacatctgctaaacccaatggcaaatacttagtcctcatgttcttagaagaatgatttgtgatactgttttccattcattttttgttgttttaggaaatcactttgtcgtgtttcttttttcctacaacatgagccattctttttttttcttcctttagatggctctgtcccagaccgagaggttaagagacattgaagactttcagtgcttagtcattagattattcctgttctctgtgctacctcacttccttgacatagaataccatcatggatgacttctacatttattgctccagacctttccttaaactccagatttgtgtattcaattgtctgcataacctcactacttgaatgtataatagacatctcaaaatggatacttccaaaatcaaactcaaaatcaaagtcaaataattttccttccagatttttatctcctcctgttagacttccccatttctgtaaatggcaactccacatgtccagttgagagttgtgcaagccaaaagccttggagtcattattagcttctctttttcttacacatcatttccagtgtgtcagcaaattgttatgattctacattcaaaatattttagattctaatcatttcccaccacctccaccactacaacccttggttagatgccatcacttctctgtatctttgcaataaaattctaattggtccctgagcttccacctttgacctgcctgccaccactcagtatgtttccatcacagtaatcccaaatcagattctgtcactcctctgcttaaattcttcagtgacttccattttttttcagagtctaaactctcacaatttacagaatttgacctgatcttggcccttgtttttaccttgaccacatcttatacttttattctactatctagctatgtttggtcaactctgaccttcccactgtaaatcaatccaggtcttgaacaggtcaaggaccaggtttgtttcccaccttagggcatttgcaactcccagtcccactgtctggaacatcttaccatggattcttcatggaaataaaccttattccaagctttttttctggtgccaccttctcagtgagagcttaagatcctgtttaaaagcggtatcttcactactcaatacttctggtcccttccttgcttaattttccttaacacatcaccacctgactctctaaatatgctatttatttatttgtttatttttgtccctctccactatataatgtctatatagtgtcagaagatggaatagtgtctcgcacatggttgacacccagtaaatatttgttgaatgagtgaataaatgaatgagttaaccaatgagacatttaacgaaatagggctattgctatcacatctgaagcagataaggtggaaaagccagaaagcaggatctgtttgttttcatgaaaatcacttttatgtgtttctcttcaagtaagggttttgttctcacacaaaatcttggtgttatgcatgtctatggttcatcgaaagatttggaacaggctgtgtgggattagtcagtcaatcagactgaagaggagctctggtaagtacatagttacgtgtctggaatgtgtagcctatacagagagaaggaaaaaaatgtatatatgaaaagtgaaggaactttctacagtggccaagttgtcacagtccagaggcctgggggctgtttttcatgaaaagaccaaaacaaagtgcaggatgctacacaaataaagaaaatgaattcagcaaagtcatataatacatgtacatgaaacaaaagcacaaagtcaaagaaattctatagagttcagagactaagattaacatcaaaagcagcagcagcagtcaactttgtagagaactatatgaaaacaggacaagatcttaaactggaatggctgatcttggggagaaaaatcagagaatcttgaagtccctgctatgttgtaatatattaaaacactatcgattatgtaaccgtacatgaagtgaacaggaaaggaaagtaaaaagacagaaacaagacctacaactaagaaatggtatagactcaactagcaactaaaacaaacaaacaaacaaacaaacaaaaaactagcaactctaggctgggcaccatagctcatacctgtgatcctagcacatttggaggccaaggcaggaggatcacttcagcccaggatttcaagaccagtctcagtaacagagtgagacctcatctccacacacacacacacacacacacacacacacacacacacacacacacacacacaaaattagccaggtgtggggctgtgcacctgtagtcctagctattcaggagcctaatgtgggaggattgcttgaacccaggaaattatagctgcagtgagctgtcatcacaccactgtactccagcctgggtgacagagtgagaccttgtcttaaaaaaaagagaacgaaacctagcatctttagagacaggagaaataagtgtcattaatgcaaatggtgtttatatctataattaattggaaaaatgtatacagatttactttacagtaaattttagttagaataatgtcttcacaaccaaataatttaaatcatattaaaaataagtactgtgtgacatttagcaaatttacctttttgtgactaatttcattcatctataaaatgggtattatgagctttaataatcttttcaattctaatattatataattatttaatgtaaataaagattattagctgtctgaaatatgtactttggagtagaaaataatccattaatatgcatttaaatacccaaattgtgccagaaactgaaagtataagttgaagtaaaatatgatgttatttaaatagaaacaactatggggacagggttataaacataaatacacacagagatatacacacataatatatacaaatgtatttacattcctgtaaaacatggaaatgcatatatctgtgcctttatatattaagcattatataccttcatataataaacagtaattgtattcattacacttactgaaatataaattgaaatttaatggctgggctgctggttggccaggtgcagtgactcacgcctgtaatcccaacacttcggggggccaagggaggtagatcacttgaggtcaggactttcagaccagcctggccaacatggtgaaaccccatctctactaaaaatacaaaaattagccgggcaaaggggtgcacacctgcaatctcagctacttgagagtttgaggcaggagaattgctcgaacctgggaggcagaggttacagtgagccaagatcgtgccactgcactccagcctgagcgataaagcgagactccctctcaaaagtaaaaaataaataaataaaaaataaacaaaaacaaacataaaaaacaacaaaaaaagaaatttaactagttttacctagttcatatagatatttctaaagagttaatgtaattttatggttacatttaccccactcctacaactcaggatgatgccatatgatccatatgcccaaaggctgtatcaaaggataaaataggattatttctaatttaatttagacagtcacatcacaataatttccacacttgcctcagtttgggtgctgttcatattgtgtttaatttcatgttgctacattctctttgagacataagtgttacagatatcttctgtagtaatgtagccaaataagattttgtggtgatggtagtttgtgtgtgttcctgtgtatgtgtgtgttgggtgtaagtgactttagatagaactcatatccttcaaacattgaaaagtcaaccactatttttattcagtttgcgtttttgtattatgttttagttactgtattcaaaatattatattctctctatatctccctgaacagcatattttattataggtatccttacctttaagtagtaataaatgttttcgacctagtaagttcctgttctgtgtgggaaacacgggagggagaagaaaagacacacacacactaccttaaagggtaaaaaacctttatcccatgtaaatggcaatgcagatgtaatgagcaaatgatataataagcagattgatataataagcaaatgatataataataagcagatgatacagtaagcagattgatatgataagcaaattgcaatgggaaagggagaagggaaaagatatttacactcaccagactatggaggattcaccaccagactgggaagcaacagtctcggctccagagttggccactcatgtctgtgcacaggcgaggagaggtctcatgaagtttcggcgcagtctgggaccctaactctttttgtaatgagttgtttcgcataaggtccagtcaagagggctctttgtgactgggctcaaggaacacaaaaaggtcaacttgtttttgtgattgtctattgttttccgataactaacatataggaatagattgaaatagagatttctctgaaacagtgctggatgaatgcctcaaggagctcacacaacctgtttcgggacttggtgactgttgtttgtgtccatgttcaattgagttcaaatttaatatttaactttcccttcacagtcggcctccatctgatactcaattgtaggaaaatacccttacagatacatagggaaggcatagtcgatatagattacagatacggggtaagcacaggagaattagaagcacaattaataaaataccacacccaccatggctttgcaaggagagtcatattgtgagaattgccagtgatatacacataagattcaatatgcagtaaatcacaaacccctccttgggctgcggtacgcatatctaatgccattcgattttgcaacataacagtacgcagctgagcaaattcatcttataacaacgtaagtccagtgctactatcattaagagctttttgtacgtgtaagctcaatattttaatttgttgctgaagcaggattgtaccggtggcaggggagaatactgtgatggggtaccaccaccagggggtctggtgcattcataatcagtgatgtttgtaagcatctagattactggggaggggactattatcctggatgttgaatgtaattaatggccaccctgaagtgcatctccccgtccaagtgggggcaggtattgccacccgtaggatccacgtgcccagagggcgcccagggaacaggaagagttctactataattgtattgctgtcatgtgtaatttaagtaacaaaggtgctgtgtctcatttgggtttgggcaaaatagactgtttggttaaaagaagtccaggttggattacaagtgttattatcccacccccattggtattggcatatccatccagaaatgttagcagggatgattctccaaggtagcccattcctgggggcctcccgcggcaactccacacatagccagtaccgactgcagttggcttgcgttgcaacggtggctacccagttgatgaactcattctcagcctaagacatgatgacccaggtactgattactagcagacaggttattctctgtaataacaaaaatggaggggaggatgcattatttttcttcgttaggaaatagtactatgccttcattttctgcccctatagctacaaggtcacaagccttaggggcaggatctgatggacactgtacccatattttggctccaagatttaagttgccccctttggtggacctgaattctccggttctgtatgttatttctattggggcagaaatttccttgggggttaattgttgacaaggtaccactaacaattgagcaacccgcatctgaggttatatagcaaaagaatctggagtggtattatataaaatgacctttaactctccctggtaatcactatcaattatatcaccatacattatgatgcctctcattgcaagacttaaacttattgtaatccactcatccacattcaagtttgcagttatggtgggaattttgccctgttgatctgcccgctgattaaatagtctgtcaagagaaagccgaagatgcatgagcatcaacatggaaaacagtgacaatggcagtgtgaggatattgctttttcccattaatttttcatattttaatactattagtttgaaaatgagcatttgatatggcaaagtatacgtagagtgtcaaattgaagtaaatgctgctttcattattttatcacaaagctactcgacaataaagaggaatgaagcactattgaatgttgtacctcacagtcatgctctgtaggaatgctttgttcattaaagtaatagttccagtaaagattcctctggggattagctggcagagtggctttatacacaggcatttttttttcataacaattcactaataaattatggataaaaatacagctacccaaagtgggtaacatcttagaggagctctgcaatgctgtgacatggtgagtgtatcaagaacattctcttgtttttttctattgccagatgtctagagtccctccatcctctgggcatcatccaagaagtctgggccaaagaaaaagaaaaattagaaatcaaagataaaatgtttactctctaataagttccagtttttaacgtactcgggctcctttatttagtcgtcaagccagtatataccaataacattgtaacagtttgcttcagtaataaaaatctattacagcatacagtggtaacatgtgttctaacatgtaattcctgacgttgagcttcactgtgtaatgaaatattaacataatttaaaatataatatgcaatcaagaagatgctaaaaggatagtagatagcattaaaataaactaatcattaatagtttattagtagataatggggtagattatgtgatatatataaataaacatctgtcataggacctgtcacatagaagccactcaaatattttgttgaatcaatgactgcttagactcctagctgaccatttttcttatttagtcatggtgattacattcaattttggttactatattcaaaaggttttaatctcaccaatattatctactggaaactaacctttcactaaagatgtccttaggcttctagaagcaacaccataacattttctcatcttcctgcttatcaggcagtgatgaaatttcctctgatactgtctattgaagagaaattttaaaagaatacatgaaacttaattcagaatttcaaggactccaaaccattctgtagaaattatttcagaaaccagatagaagttattcctctaagtgacattccactgaagtgatttttgcagagatcattataactattgttgctgctgagtcagatgactcttttcagtctgtaggcaactcaaacccatggtacattggtcaccattaatcatccactcctctcctcttaaaattatctcctttcttagtttcatggtatttgtttctctggtgtttctcttatgtctgggtatttctttttaccttcctggcaaaattgtcttctcttaatgacccctaaagtgctggtattctccaaagctctatcctcggttttcttctcttccttgacataccatttgctcaggtaatctcatttactcctttggtttaatggcccaccaatatatagatagctctgaaactggctagtccaacctaactgcgtaaactccacacccatgtagctaacttcttactagatatttatttgctggtttcatttaaaattccatgtctaaagtttaactcaatatcttaaccttaaaatttgtttctgtattttaatagtttaattacccattctgttgcccgtgtcagttaaacaatgttatcctgttccttattcacatatctaatagatgaatgaagacttacaaattttacttatctgatatttcttgaacctgtccatgcagcattgtattcattctcattgcctccactctggctgtcattatggtttgcttggtctgttaaaatatacactgttttcctaatctcaattttttaacttctaattcattctacttccaccatagtgaagtttttaaaagtatttgtcacccccttagaaaaattcaagataaaattttacttcttcattatggatgtgaatactcttctttgcttatctgtgctcttggcatctcccccacataccttttgctcattatactatgtctctacttaactactgacagtacttgagtgtgccatgttctcttacaattttatgaactcacagctgctactccctctgctcagaaagcctcctgctctcaccacttaacttggcaaatttctcaatcctcttgaaaatttaagtcagatgtaactgctatgggaaatcttctccaatcctgccagctttcttcctccaggcagccatccttcatacccatataaaatcttttctcttattgcaacattttatatagtgagtgttttaacatatttgccctctagcttattatctagcacttgaaatagtcaatagccattatggaatcttacttaataagtgtcatatcatataattccatgattatcaagaagtgcaaagaaaatgatttaaaatggcacactgccatacagcttgaagtgtattactttgcttagaaacaatgaacatctgatttttttgtgtgtgtaatgatggaaaataaagtagctggttggaaaataatatcccagccctatacctaaaaatagcagtggctagaataaatgaaatttaacactgtaaattttaaaagtgatatttttagaaaactcattgataaaagactagtcattggttttgaaattcttcttgatcgtgtataacgtttaaataatcaaacctattaaataaatcaattccagatgataaagaaacttgaactgaagttagacataaattagatgcttaaatacatacacctaagaaaatacaaaagaagaaaaagaaaaaaataatatgaatggagaaaccaagttgccccatcttttattttggagaacacagaaaaaaagccaaaaattcaagaaagaaaatatcaacaagaacagaaaaaaaggaaaagactttctttttcaggtaatatttggaaggatattgtgtagagagggtgagcataggaagagatgaggtgccatgagacttatatgaataggctgattagggtgaatcgataactaaagattttttttattcattcacttaacaaatatttattgagtatctatagtgggagtggatcacaaaaacacctaaaattaaacttgtaaatgataggttaagaagtaatctcgattgggtgaatcaatgatagttaagaaaatgattactaaaatagactaattccttaaaaaataaaatatcttgatttctttgaactcagagttaatggcctattcttttttagaagataattgcctttaggtacaaaacaatatacagtgaaatcctcaaaagttttttttccctatgaccttaattaagatctgcattgaacttttttttaccctttgtctactatatttttaaggaaataaatgcactaaatctgaactaaaaagtttcaataactagacaatgtgagctaatgatttaaattttgtacttagttggagctgaaagtgtatatttttctctttggtgaaaaaaggaggggaaataaaataaagagaaatgttatcacaattttaaaataacccatcaaaataacccatcaaaataacggagaggaaataaaataaagagaaatgttatcacaatttaaaaataacccatcaaaattaaggagaggaaataaaataaagagaaatgttatcacaatttaaaaataacccatcaaaattaaggagaggaaataaaataaagagaaatgttatcacaatttaaaaataacccatcaaaataaaggtttatgaatatatcaaaaatagcttctgcagatggagaaccatgttacatattcttttaaagcaacagatgggagaaaatagaaatttttcttagagataattatataaaaataaaatctagtttgcaacataaatttctacctatgtgtcctatgaagcaaaatttattgtagatttttctctgattttattccattatgaaccacagaaggaggaagagttccattactcaaggtttctaaaaacacaatagagagaaatacttttctactttaaaccctcattcacattatagcactcataccttgtagagttagattgcagtaatgttcactgacattctaaagtttttatatcagctctgcttttattgggcacagtattttctgtttattggtaatttgtggttgcattttaaaaatactgttctgttgataagctttcatgatttcttaatgtaaaattgaactgggtttttgtatactttgcctgcagcatctagatttctctaagaaagttttttattttaattcaaattgagtttttgccaatctcatataccactgtaagagaatggttaatgtgactttttctactatgatggcattatcttcaagaacacaaagttaaagaaaaaaatgcttttcagtacccacattctctaaggagataacattgacaatgggacagattcttttcttagaaaagtgaccactttctcaatctgtaaaataagaccagagggaaggcaagagatcaagtgacagggatacctaaaagtattacttattaaaagaggggatggctgaaaggagaagcctggaatcttaattcctgcaagagtagctgattgcccttgttgatcttccttgaggctgagaatggaaaaagagaatagtagagagagggcaaagtagatagagaaatgagggttgagcagccagttctcaaacatttcctgtgagtcaaatggacaatgagagctatcttgcctgatctaagagggttgagtgttaatggaggaattcccagaggcaactgaacaggaagtacctggaggtactgagatgttcaggagcatctcaccaggctttctctccaaaattctacgtgtatccagtgataaatccagcattttgattcattctatagagaggcactggtcagtaagaaacaaagaagcagcagacaaccaggagagagaaaattacaatcaaagatggtgaagtaatgaaaaatgtaccttcttctcttataaccccaggcagcacttaacataaagagaagtctgcgaaataaaggaaagcagtggcaccctagatgtataaccctgcccatctactggggttttggagtcggatacatgttattttaatacaaattacaatttacaaattaatacaaattacaatttgttatattaatacaaattacaatttgtattaaaataacatgtctccttccatgtatcttaacatgaattaaaataacaaattgagatatgttattttaatacaaatttaatatcaatgttttaactacttcaattttatgtattcttatgatgaatatcttgagttttactttttaattttatgttctaccaaaaatggtttcaaatgaacttatccaatattactacaaactatatgtatgaagatctgattaaatacacaacttttgtcattatgaaaatactgtgctttcaatcacttaaagcaatttttgtgtgatatcactatgctaatatttaaattggtgagttgtttatagttttttgggactttttaccttaattttatttataattatgtaaaacattattaaatacaaaacatctgagagtcagaaaccacatagcattatacatttaagaaagtcttaatccatccttgaacacttcttttttgatcactttttgacttttccttccagtggttactattataaatataaacaaatgcatgagcaaatgaaaatatacatattcatattttcttctcttgtacaaaacttggcatatagtaacaccattctgcactttttattttcattttaacacatatatattctgaagatgactttatttttgtattaaaaattattctttttataggtgattagttatatatcatacaggcatatgacagtatgtccaactagtcctttgatggtataaggttgggttaattctttatttttattattgcaaataatggtggaataaataaacatgtatatatgtcacttcctattttggcagtctaactttcatatggattcctagaagtaacattgttgattcaaaggtgactgaatatgtaattttgctagtggtgtccaagtccctttccaatttcaatctcaccatctgtgtacgagaatgtccctttcatcacagtcttgccaacagaacatgttgtcagaacttttatgttttgccaatctgataggtgagaaatgagctctcagtgtatagaaacagagaaattctccaagagtgagattgagcaactttcatgtttacaatctgcaattattcaaaacatgattttaatgtttcttatatcccactatatgaaaggaacacgatttatttaatatttttatttctttttatttataaccattaagaattttaaaggagcatgtattatttggtctgatattaaatacgttctcatgcttatgctcgttagtatttttactaatttctttatgtttaattgacaaaaaaaatttattggataaaacatattgtcttgaaatatgtatacattgtggtatgtcttaattgagttaattagcatatgcattaacagacatacttctatttctacattcttagcagttttctactctcttaggaattttcaagaatataatacatttttattaactatcatcatcatgttgtacaatagatctcttgaaattattccccctttttaattgaaactttcgaactttgaacatttccccaaccacttccctccctcaacccttgattctactctctccttctgtgatttttgacttttgtaggttccacacataagtgaaatcaagtggtattcatctttctgtgcttagcttatttaacttaaaacaatgtcctcccagttcaaccatgttacacaaataacaggatttctttcttaggctttggagtggagtgaataatattccatagtgtgtgtgtgtatacataaatatacatttatacatatatatacacgtacatatatatttatactacatttctgtgtttatttatcgtttgatagattcttaggctctttccatatcttgactattgtgactaatgttgcaatgagcatgggagtgaagatatgtcttcaacataatgatttatctcttttaaaaatgagtgggattgcttggtcatatggcacttctatttttaatgtatttgaagaacctctgtgtagtattttatattgactgttctaatttaaattcctaccaacactatgcaaaggtttccatttctccatatccgtgtcaacacttattatctttcttctttttaataattgccattctgttgagtgttaagtgacgtggtggtgttgatttacatttcactgatgattagttacatttctatgatgattagttattagtttacatttctctgatgattgaacattttttcatatacaggttgaatgtcttcttttgaaaaatatgtattctagtccacattttaattaggctattcattttttgctgttgagttttttgagtttttaatatattttaggtgttaaccccttatcatatgtatggtttgcacatattttctctcattttataggttgtccctttactctattgattgttcctttggctgtgcaaaagatttttagtttgatgtaatcccatttttctatttttacttttgttgtctctgcttttttattcctatccaaaaaaatattgtctagaccaatgtcatgaaacttttccctgtatttttctagtagttttatagtttcaagtcttacatttgaattttaacttatttgagttgatttttgtatgtagtattagatactgatctaattgtattgttatgatatccagctgtcccaacatcatttattgaagagactgtcctgttccattttgcactgttggcacctttgtcaaaaatcaattgcccataaacacatggatttatttctggggtttctattctgttctattgttctatgattgtgtttatatggcagtaccaggctgttttggttactatagccttgtagtatattttgacatcaggaggtgtgatgcctctagcttatttatttatttatttttcaagattgctttgtctatttagggtcttttgtagttctatacaaactgtaagatttttttctatttctgcaaataatgttattagcattttgaaagagattacattgaatttgtagatatctttgggtagtatgaacattttcatattattaattattgcaattcatgaacacagaatgtatttccatttatttgtttcttcttctatttttgttcaccaatgttttgtagttttttttagtgtagaggtcttaaattcatgcctgagtatttgatttttttggttagtattgtaaatgggattgttttcttgatttctttttcagagagttcaatgttagtggatagaaatgatactgatttttatattttcgttttatatcctgcaactttactgaatttgttacttttatttttttggtttttggtggagtctttagggatttctatatattatatcatgtaatctgtattttttttctcttgcctaactcctcaagctagaacatctaggattatgttgaatagaagtagtgagaatgggcatccttgtcttgtttctggtcttagagggatagctttcaccttttcactgttcagaaggatgttagctgtgtttaccatatatattgtctttattgtgttgaggtacattccttctaaatctaatgtttaagggtgtttatcataaaaggatgttgattttgtcaaatgcctttccttcatctattgagataaacatatctttttgtttcttcattctgttgatgtgtgtaccatatttatagatttgcctgtgtttaacgatccttgcttaccggaaataaatttcacttgatcatggtgaataatcttttaaatgtactgttaaattcagtgagatagtattttgttgaggtttttttcacctgtgttcatcaggaatattggcctataatttttttgtagttttgtctggctttggaatcagggtaatgatgacctggtaaaatgagtttggaaatattatctttccttcaatttcttggaagagtttgagagagagtggtattaggagtaggaaagattaagtgaaaggaaacatctgacttaaactacactttagaccaagtggaattagcagacatacacagggcataccatacaacccctggagaatcttcttaagtgcgcacagaacattctccaagataaatagtattttaggccatgcaataaaatgttacaattttatgaagattgaaattatatcaagtatctttcctgatgacaatatgaaactagaaatcaataatagaaggaatttgagaaaattcacaaatacatcacaattaaacaacatgtttctgaaaaaccaatgagtcgataaagaattaagagataaatttaaaaatatcctgagacaataaaaaatggacacacaatataccacaacttaaagaatagagcaaaagcagctttaagagagaagtttatagcaataaatgtccacattaaaaaagaagatctcaaacaacttaacattttcctcaagtcactagaagcagcaagaataagttaagcccaaagttagatgaaggaaaaaataataaagattagagcagaaataaatgaaacagaaactataaaaataatacaaaagatcaactaacttgagttgtatttttttaaaaagataaaattgaaataccagaatgaagaataaaaaccacatgatcatctcaatagatgaagaaacgtcatttgtaaaagtcagcatgctttaatgttaatggatggactagttatgactaacaaaagaaagaagacaaataaaatctgaattgaaaaaaaaattacaatggaaaccacagaaatacaaataattgtaagagactactgtgaatagttatatgccaacaaattggataacctagaaaaactggataaaatgcctagacacaggcaacctaccaagacttaatcacattgaaatatttaatattcagattgtttaactataaggtaaacagccaatcatgtaggctacttttctttatttttttcttttttcctatgtttttcttcaagttgattaatggaaaagtcaattgcaaaattagaaaaacaatatataagtaagtagtagatagtagatatgtcaccatacttaaatgtataaaaatatatttgaataacattagatactagaattataatttgtaattatcttacaatttccttttgaaaatttcaaaaaattaaatatctgtcattcagacttaaagaattagtatctacaccatgaatttaatatactgaacatgctacaaacaaaaccaactttctgaagcttagctaaaacatgcttatttaaatctactgtatggaaatattatatttaaaaagaacattccctagttgtatgaacactgaaaacagaaatgacagatttttacttactgttatatttgtttttctcgggactttagttaaaagtaatattaagttgcatctgctgtcaacagatgcccatataacagcaccaaaatgctaactccaacataaatgaccatctccatatgttgctggcatttttttggcatttgtgtattgtacataatcacaggctatgagtaacacttgagaaaaacaaagtgataatctcattatgaaggttcaagatctattcaaagctaagtagagcttcttgtttctcttaaatgtatttattagtacataagcataaacttaaatcatgaaatgatcatttttcaaaatgtttgctacagatttactgtaaatggagatttttatcaaattcacgtttcttatcactatgacaggggataatatacaaagctctatcttcactataaaaatgaaattttggataatatacaattgttaatacatagcaaatttgaaaaataagaaagaaaaagccacagcaaccaaaaataaagtgagaatgtaaaacaagaatggagagtcgaagttgaaactgaatgacctacatgagcatgggaattgtgcactgtgtgctgtctaggactcatgatccaaaattatgtggggatagtaatcaaggaccctggccttatgtgcagcagataggcacagttgtcttgttgataaatccaagaattgagaaaggatgacccatctccatataggattagaaacattcttcttcctagattgggaatgcagtatggtaacatgtccttcacttgagctgttcacctgggctttcaatgataaaagagccataatttaaaagtggaaacccttatactatacacaggtattgggacttttcgcactcatttacaatgctcaaatcctgagatgaaaaaacaacccatgggcaacccaggagaccgtttcacaggcagatataaatacaaatttaaatgcaaagccatttcaggggaattacattagaatctatggcatcaaactaccctttggaaacaacttctgtagaaggtaagctcatcattcaaaaatttttgtaatcagacaccttgaggaaaagtcagaagacacaaacaaaagcattcatattcataagaggtaaagaaaacagatcattctcaagaaaatgttttaaatgactgtgttttaaaatgaatagagaacatggtaagaacagaatcaataacgtaataaaaagaaaatctggcaaaggaacaagctagtttttagaaaatgtaattttaaaataagatacttctttagcattggatagaaatgctgaatactagtctatttagagctgaatttacagagaattcataaatgaaaaatagatttgaggaaatcctccaaagcatagataaattttttcagaatataaaattaaaattaggaaacaagaacaattaaatgaaggtttataattaatgtttaataggagttctgaagaggtgatttcaaagagataaaagtagcacatttttaggaataaagagagacattagaccacaaagatgagataaaaaccttaaaactgtgagaatgaaaatgcaaattacctgtaataggttgcaataagatacacagcacatattttcatgtaacaaaaaagaaaacaatgaaatattatcccaaaaagctgaatgtaaatattatccccaaaagctgaagttctctaatataataatttgattatgagaacctagatctggaaagtaagctttggaaattgagcaaaaaagattacttagaagtcttcaacaatttttcatcaagtcctattgaattatttttttttcttttagagatgcagtcttgctctgttgcccaggctggagtgcagtggcccgatctcggctcactgcaacctccagctcctgggttcaagcagttctcctgcctcagcctccccagtagctgggactacaggtgcatgccgccatgcccagctaatatttgtattttagtagagatggggtttcatcgtgttgcccaggctggtcttgaactcctgagctcaggcaatccacccgccttgtcctcctaaaatgctaggattacaggtgtgagccaccaaggctggcccctgttgaattgttttagattagctaaatgtgcttcaacattgtgaaatacaacagtttcacgaacacgaagtcaagtgacagaatttacagcccccaatgattcaaagattgaatttactgaaaggtgcaatttgctgagaaagaaaacaaaaccttaaaaacaactggattaaaaggaaatggtaaataagtcctcaatgtattaaaaaaacttttaaaaagtaatctgaaggattatattttatttatttatttgcattttgattatttttaacttattccttatattttagcaggtaaaaatatatctcattcctcctgaatggtgactagtacatttacccatgcccctattactagacattcacttcattttcattttggagtaactaaacaaacaactaactttgtactaacatttacctattttttcttaatagtacagatgcccagaactgtgatttctgggtgaaatgctatacatggtttaaatgagaggatatggcgtcctctttatttttcaaaatttattaatatcagcaatcctaatcagcaatacattaaagcgctcctttatactgaattcctgacaagagtaagcacccttcattattttggggagagtgtattttataatcaattgtgttttcctgatatctagtaagggttgaaattctgtttttacacatatgccactggaatttccttttctaggaattacctattaatattatttgttttaatttgtttttggactttggtcatatatttttgtatttaaaacatttacaaattcataattaatttacaaatggactaaaatatggcgtacttatccaccagtttataagtggaccaaaatttgtgggtgtttgcagtattctatatttatatctagaagatatgttagtaagtatgtctatttttaaaactaattaagttttacaatttatttatattttactttaacttaaaaagcctcaaagaaatactttattctgtctacagaattccaaaggccacttaaatgccaacattaatggctttcactttttaagttagttatttaaagaaattctgcattactaatgcttgtggtgtcacagaggatgatattgtaaagaaaaccatgaataccagggaattcaattcaaaaaatgatccagaagagacaaatttttaaggtaaagaaaggttaaaagtgtctatacaatgcttttgcttatttataaacagtgagtgacttacagtaaaaaaaaaaatagtgtgttttagctaaaacaataattaaacaacaatctgttaactataaatttcaaataaagaaatatatatgaaccttatatttgccacatgcatggcacatatttttacaatttattttttgtcatttgattttgtttaatatatagtttgcattataaaaacaattgtaaatatttgtataactaaatccttttctttagagattttgggttttatatccaacattggtgtgtttacatgtgtctgtgcatgtatgcatttttctcctcacatttttgttttatgtttagatatttaatatatttgaaattttgtcaaaatcatttttctgtaggtaagctgtgagttatgtggtactttattttctttcagttgtacaagcaaaatttgctaacttctatttttccactacattgaagtaattgaagtataattttttgatatattacatttccatatatgcagtgtttttttcctgaactttcctttgtgcctcacatatctatgttttgatgtctgcatcaatattgtattgttaaaaagtgagtatattgtttattttaatatatcatgatgcaagttgtctcccaacatcctttaaaaagaaaaacaaaattttaaaacttgtttaacttaatatgaagattaaattataaacatagcctataaaagattaggaggagtatgtccttggaatatagtatggatggagggagtgaataaaatattaatacaatggaagtcaggaaaagagaaaataagaagcatagaaaagtcacagaacacagtaaatacacaaaccagatgctaaaacatcatgggaatcatgagggacattgacttagagaataaatctgacaaattgattatgcaagtaataagtttagcagagaaaaatgaccctgttttcagaaagtcaagaatacataatattcaaatttctaagcacatttggaatattttacaaattggacacatacaacaccacaaagttcttaacacatcccaaagaatgattaatatgttagatacaacatattctttgaccacaaaattatacaattaaaattataaattttataattccttctcaaaacttaagagtacataataataagatacttaaatagatgttgaagccatagatacctacctaaaaatgtatatatttttatgaattattaattacacacccaactcttaggatctgttttctattgaagtaacattgattcctttaagcttgtaattctccaaagtaagttaactgagaaagaaagtccacattatagaaattcaacttacatatatttttatgtatctactcaataatacatgaaataaagcaaatcaaaatctgatctattttcccactccttttcttcaggcaattttacatttccaacataaagagaccattaaaaaagatgcagatccctcaataacatcacagttttacagcttcacagcaagaatgtcaccctgacttccttgccttttcttatacatgcttgtgtttcctatacctttgcttgctcttgagcctgctattctcagtgcttagaatggaaagagcatcggattgaagtttatcccaattctaccatttaactattggataatattaggtacaaggattaacttgtttgatttattattttctaatagtagagataatttctaacagtagagataattataaaactgtgactgttttcagaaataaatgacataatttggtggtaaacattaggtacttaagaaattccagttgtgtccagacagacttctctgattggcaaattatttatttttaaaatccaaaatccatgttactgcttttgatgagaattcgctggtatcttctatagctctttctattcccagctcaatgtagaaatgaggatttcttcccatgtctatcccactgtctttgtgtattcatttgctctacaaaaaacaaatgctcaccctgttttttgcttaaatttcttttctgtcttcccctacaatggtgaaatctgcaagtataagctctatactctggccagtgtttgatataggattgcaagaaacaactgtcatatgggaagcttttacaaagaggggaagcaaccttgttgggttaagtactaaagaattttgagaaccacgatgaagttgatctcagcataatttttaaaaacagattacataatgtttgcagtactgtgaccctaagagtacaataaactaagagcgttgttgcaggcaagttagatggggccaaagttccaaatgagaagattagaattatgtatgctctgcttttagttatcatggttatgggtgctctaaccacgttcattgatatttaaagggaaaacaaataaagacattgaaaaagtcataactgtttaacaacaaaaaaagaaaagctataaatttcaacttttaatcacaaagcttataatgatttaaatgtttaagtggaatattttgtgtattatatataaaatattgcagttgtcccaacaaggtaaaaaataggttgggtactggcacttttgtaactaattttaccctagaaaataacaacactttctggttgagaagggagactttttgttttgtttgtttgttttttgtgttactaattttgttttttgagactgtcactaacagatttgatcccaacatgatagaaactttaagagtaatctgattgttaccttgaagacagcctcagtcatattctagcatgtatcttcaatgccatcgatagtatttgtgcgtaataaatgtttaatagatgcccatgaaagtataaattaatgcactaaagaaagggggaaggaggaataaagaaggaataaatattactgatgatgatgccattgatgttggtaatgattgtatggaaagacaggctacagaaaatagcatctaagggccaagttttctaatataacaatttgattaggagaacctaggtctagaaagtcagctttggagattgggcagaaaagattacatcaaagtcttcaaaaatttttcaagtcccattggtaaataaatgaagaaacaaaagacaaatgcgactcaggattccagtgtgggagctaggattaagttggtgtcactgattaaagcaagtaagaaaaaacatgaagtgaaccttgcagaccaagtggccatttagttttgaaattgtttcattcaaagatgaaataatgatagaaaaattatgagaaatagcttatatatcagttactgttgcaataacacaatatgacattctacaaatcaaagtgctttaaaacaacaacccgacattctcatgctcaccgtcctgtgggttagctggaacagagctgatacaggctgatctcatctgggcatggctccaagccatggactgtgttcagctctgcttcacacagtctcctattcctctaggaccagcagaccacctggggcagaatttctcatggatacgacaaaatccaaaaatggcaaaagaaacacacaatgtttgttaaggctcataactcacacagtatcctttcctccaatattgcattagccaaacaattggttagctgaattcaacacaatggggtggagaaatacactctaattagagaaactgcaaagtcacacagcaaaggatgtggattcggggagaggtgaagaattacagtcttccacattctactttaaataaatgactgaaattcagttaaaagtgaagcctaaactagcagggttattaatgcaagaaatactttgcgaacaccaatatatatccatcaacatcatcatcatcatcatcatcatcatcagtgatagataatataggtctttgttctgtttcctactgtattgcttcccaatactatacagattacctaaatttgtttagtctgctgtggttatactttcagattttccttgagagttgatcatttttttctataattccagctagctgtgggcaaagattttttctataaaagatctctcaccaccaccatattaccattagctatctgattttgagtattatggcagccaagccatgctctctaaaatggattggattttctatgaataataatactgttatgaattagttttccattaattcatatagctctcttagatattttctactattttctaatatgtaatatctctgcactttgtcattcacatgatcttttcgtataaatcagaccaagacaaccatcagtacccaaagtacgattcagaattttcagctttaattgcatctttcccaacacgttttgcttcatagaccagttcatttttgtacataactttggcaaataatgacaaggagatgtaggcccattttaattattactgtggctgcacgcatatgcagcctgttggcaacttgcccactgtatagctttctgctgcaatgtttctcttccaatatggaataaagtacttaaaggaacctgcttagccatcatgatataagtgcaaaagggaaagcacaagtggttagcaccctcaaggacaggagctggtgcataaggactgcactgtttcatcctttggacaaacacttctattatgcattctacacagtccaatcaaggatcccaaacagaattgaaccccagaggcccacagaggtgattagctagataatatacccttggattggcttgccttcctcacctgcctcatgtttctcaatccctaaatcaccttctttgggaacagttcccaaaatgactattcaaatgcaaaccctcgtgtttaacaacagcaacaaaaaagtctatttatagctttcttgcctgcccacctgccttccttccttccttccttcctttttttttttttttttttttttccagagtcttgacctgtcgcccaggctggagtgcagtggtagaatctcagctcagtgcaacctctgcctcccgggttccagcgattctcctgcgtcagcctcctgagtagctgggactacaggcctgcgccaccatgccaggctaactttttatatttttagtagagatggggtttcaccatattggccaggctggtctcaagctcctgaccccgtgatccacccgcctcagcctcccaaagtgctgggattacaggcgtgagccactgcgcctggccccttccttccttccttccttcctttcctttccttccttccttccttccttccttccttctttccttccttccttcccttctttcttcctttcttccttttttccttccttcctttcttcctttctctttcctttttttcttttctgttctttcttctattgtgataggcagaacccacatcttaatcctcagaacaagagaatatattaggttacctggaaaaaaagattgaaggttgtggatggatttggtgattgctaatcaggtgacattaagataaaaacaattatgctgaatcatttggatgggcacactggaattaggtgggtgcctaaaagtgaaaagaggatggcaaaagtttagtcagtcaaataaagatgtaactatggaggaaaggcacagaggattcaacactgctgactctgaagatggaagggggctatgaaataaggaatgttggtcacctctagaaggagcaaagggcaaggaaatggattctgcactagagcctttaaaagaaacatagccctgccaacacctggattttattctagtgagactttcaacctaaagaacagaaagatagtagacttgtcttgtttaagcttccaaattggtggtaaatttttacagcagcaacagggaactaatatatcaatgcatgcgtgttttgcacaaatatgtcattcgtatttagaaatgccacattaagatgaaatcagtttcatattgcattctaaatgatcctaatagaaaaattttacatgattttatgatcagttcattttttaattattttgaatccatagacttcttttgtatttcctttgacaaatagtttggggctttaaaaagttgctgagccaattactcatctaaaagtttttctgaagctcatggtttattcaagtcattcaattaacaatttaactcaattaacatttacttagtgcctagcatgctcatggcattacagaaaatggaaatggaaatgactttgaaacaatttattttgaccataaaaatatcaaagtcctttaacatgtaggtcatggattactgggcagtagtagctaagagttcacagataatggcaaacagataaaatactttcaaatatacagcagatttaactttcattttggattctttgctaccagaagtgcaggaaaaatactaaaagtaaaatcaaggacatcttaagatggctttaattaacattcttagtaatgtaacaaacagacctaagaaataacaaattagtgtcattaatttttttaattgtttaaactttggaattaaatatttcactactttagtttttgggttgtttttgttttttactatgcagtacttaagaaacaatatagaaacacagtccaaaaacaaaaacactgtatctcagtgactgtaaacattgtggtatgtttttaaatatatgtatataaataaatataaatatatattttaagtcataatttaatatagtaaatgccattgaatacttctaggtattaaaatatttgccttttctaactgcccatatgtttgaaaatattttcaatggttttaaattgttagctcagatgtaggacgcatccagaaaagagagacaataagtgagagagaaagaaaagaaagaagagagaaaagaatgaatgaaagaaagagagagaagaaaggaaggaaggaaagaaggcaggcagagagggagggaggaagagagggaggaagggagaaagggaagaaaggatcctaatgtctgtttaatcttgtgccagaaaatcttgctaggtagtttacctcttttaaatattcataataagaataactcttaccctaaatattatttttgcagtctttctggtaaggacactgaggctcacagagacccattggagagaccgtgcctgcttatgcaatcatgttggtatttatttggagcacttaaaagccattctacacagaatcatttgagcttcatggaagtttatattgctttatgtactatttaacagcaaatatcaaataactagtttcactttggggaagaaaatttaggtgtaatctactttatgaaggtgatacagttctgaaaatataaggatttttcacttgtattttacatttgtatcatataataagttataggcaaatttaccatctgaaaaacacttacagtaaatcctttgtatgtttaaagatctcattataaaggcaatattagctgtaattgcagattttcatgtaacatttcttttttttttgggtggggggtggtggtgggacagagtatcactctgtctccaaggttggagtgcaatggcgtgatctcggctcactgcaacctctgccttctggttcaagtgattctcctcctatcaagtgataggcctcccgagtagctgggattacaggcatgtgccagcacgtccggctaattttttgtatttttagtagagatgggttttgccatgttggccacactagtcttgaactcctgacctcaggtgatccacccgactcagcctcccaaaatgctgggattacaggcgtgagccaccaagcccggcctcatataacatttcttaaggcaagtgccattccatctatgtcatatctctactgttgcttttataaacttataaaatttctcatttgagccatgacttgaaaagattataaattaatccaaaataaatttgcttctgtagtactcttctatatagacatttttaattttaaaagttttatcacaacgctctatctcaatacaaatatacttcataacaatttattgacttaacattaaggaaaaatgtctgtgcaattgttcatgcaaaggtaatcgttaattctctcagattcttgaaagataaaacatcacaattcaaagatttcataaaatgctatttgttctcaatttctaaagcagtgtttttaaattcttgacagaatggagacagaaaaaccatacatatctaggtctgagaaataccccaaattaatatagtgtattgctctccacctgatactgttttttgcatacgtgtgactaaagaaaatgttaaggtttgagatcacttattcctttttttcccctctaacagttacaagtcttcatgttattgaacctaatattgacatacctcctccctattgcagaattattaaactagctctcaaaggaaatttaacattatagggaaaatgataactttcttttttcttttgccattttctcagaaaatcacgactagcttctggccatgacaaaagttatgtcagcatcattatgcaacacctgtgatcagtgtgcaatggaagagcttaagagccagaactgagtatataactgaaaagtttctatacaatgttaaatgtgctgctcaatcccctaaagttaagtaaatggccttcagtgaggtttgaagaaagctctgcaacagcatgaatatagtggcctgagagctggcgtggaggtattcagatatgaactctctttgcttctaaatattaagcctacagttccttgcacttttatttctgaggcattttaagcttattgtgctgaacagttgtgctttctaagcttgattgacattccagaaaatattgatccgagtgttgggtgagcttactttctattaaaaagtgctcatcacatggcattaggctcactcagtccaaaatgtcagagaattgcactttttaacaaaaatcttatatttattttaaaatcaaacttaccaataatttataatcagaatttgaagtgtagtatgaacactttgcttctttagaattgatttagaataaaaatctgacaaactcaataagcaaacaaacaaacaaaaaaaactccaagaaaccactgtaaagaaaaagtgttttcttggtcactgaatagtattaaaattccctggaaaaggagaatttcttttagcaaatcatatttctcatatgttcttttatacctgttctgatataggacagccatttccataaccctccccctctagatccatctctacctgctctagaagaggtttgctctcaagacccagagcttaccgagacttcccttagctccccaagattgtgtctgctgtagcaataccaggaagtaattcgtttcttcctcggttttctcttctgttttactggatcaccgtctcaaattacttccaaagaaaatgtttgttggacaaagggtacaaaggttcaaccatgcaggatgaataaattctggagatctaatgcacatcattatgactatagctattggcactgcattgtatacttgaaatttgcaaagaaattatacataaaatgttctcacacactctctttcccacgcaaaagggtaactatgtgaagtgattgatatgttaattagcttgactgtagtaaacatttgacaatgtatatctatatcaaaaaattatattgcatgccataaatatatacagtttttatttctcaattgtacatcaataaagctgaaaaaaaataaaaagaaaaggctcattggaggattacaggatttctgaatcttggcccttctgaaaacatctttagtctaccattttattgattgatagtttcgctggtgatagactatatgacttgaaattagtcttgatcctcacttctgacctgcttagtgctctgtgagggcaaagtggcttatttctttgctatgtgctcctctgtgaggtctcaaaactgtcatattctttacatgtcattaggaaattttacagccacctttggttttctcgagttttcctagaaatgtcctgtgttcctctccacttttaactaatatgaatatacctaatttgggtttcctttgggattgtgcaggtagatttatttccgaaagatttctttcttagtggaaagtgtgcctgggtaggaactttgtacaagtgggtggaatatgtactgtcaggctttgctttaggaggtataagaaaggaccctaaggataggctgtgaggcaacccccacaacttgagaattaggatgattcttcccataaaagaacttttcactttccccaggtcgtctcaatgtaaacaaacaaaaatcggctgctttattttgtgtgtcttttgtttttcactctggtgttaaaaactgggcagcctgtgctctacaagctgaagtgggagatcgaattcatcaataaatttacgttttttccaccatgatttttctcctactattagtgtgtttgtgtatgtgtatgtgactttttccgggttttgacaaaagttcttacccacttactactaccttagctggaactaagtataccttctgttgcaatttccagagctttggacttgtattctacctggtttgcatgttttctgtgacttgttgagtctctttcactgaaatatctttaagcaagttaagcaaggattttggataacaatttaaagtggttttgtcataatgtttttgtataattttagcaaaatagtagaattttatttaacttttcttttggccaaaagtttacttccgtatgtgacaaataaagtaaaccccaaaaagcaaacaaaaaccagcattctattctggtttattatttcatcaataatatcaaattactgccatctatgaaatggatgtagtaattgtaattctccatacctaaaataacattttattaaagtggataaaaataatttttatggctgctagtcttagtcacaagcagtattattacagctcttactgtattctaattatttttatttgctcttcgaaaatttataagtggtattaaaatataatgacttgtcaaaatctgaaatagggatacatgaaatcttttgatgaataaaattaatgtgaatttaataatgttaacaccaataaaactgtttgcaatactgtacaggacgcatctgaagcatgtaccacatacaataattatagtagcagctctctaaggactagagcactagaaactgtactgtgctaatctgaaatcaggtgaattaatcctcagaggagtcaggtaccacagtctcaagtaatcagtaataattgtatcatattgctgaagcacactccaagagctatgattttccctacctgctggattgcctgcaatgattgaaatttgttaagcagtggcagaaattcaggcccatgatcagtggaaatccaagagttccaaatacataggtaacatcactataacaaggtttttctattgtttttttcctttggttttaactttatgttttatagtagatggattttgccaataatacattgctatactttgataacgaatactctgaagtgtttaaagaattgaaaacatcaaaaaataattttgcttataacaaaatacaaacattaaatatttttgataagagaacttacttattagatttacactatttctctaactttaaaaagtagtctgcatttcaagtggtctaccatatggctgtctacatcttagcattttgcagaaagtatatataaaatgaaatgcatataaaagttgcctgcagtaagtaatactaaaggcctggattaatgaatttagctcggctttgagttatttcaaatatatctttgttaataattatgtacttcccaaagccatcgaataatgttaattaaatctcggcttagtttcacagttgtgtttaattagctcaatcactttttaaaatgtaacaggctattaaaagaaagatctattgacagaatgttgaatggcaaattgttagctgccagatttggtccctgaatggtcattgggtgcgtgaaaaagcaaaaagcatcaaaatcatagcatttataaacaggctttgtagcttaagagttaactgcatgcaattcaaatgattttcattctatattggaagggagtaatccaatgagtttaatggtgtatgtattatacagaagcttttcaataaaggcagaaattacatttacagtgccttttctgtggttatttgaaatatacttttatctaggcaaaccttaatttctggcaatataaaaagtgccctgaggtaaatatggactttactcctgcttatgagaaagttaaattaataccctaaggatatgtcctttgcaaagggtcatacttattaccaagccattataataatatacactttcttacaaatctgcaatcgatttacaagcaagatttcgattaaagttcacttcccaaaacattggaaagtaagctgtttgtattgcactgtttataaacacttacttgattcccaatttatctttattttaggaagagatagtaagtcagaattattttgtttattctaggaaactctcagttttcaaattttcaattaggaaatggtgagggaagtgggattcaaacacaaggacattataatgatgccaatcaaaaacaatttattaataactaagtaggcagcttttaaaatttttgactttcaaaataataaaaaaatgcaattccttattaaatgcaaggaggttactggaagaaatttggcataaaatgccttgtttattaaagattaagagaaacaactgtttatattatagaaattaaattactatttattgagcatatgcatctcaatttgcaagtcacagtgtagaatagaggcctatttaatatgtcattaaaatatattttaataatgttgcaaatataaaatctattttaataatgttgcaaatataaaatctattttaaaataatgatatttaaccttattttgctgtgaattgacgctacagtgtacattcagtgcacacaaaatatcaaaactttccatctaggatttaataagagagaaaaaaatctgtggaagaaactatgtacattgaagaaactcaaaggcaggagacatgtgttaggccattcttgccttgctctgaagtaatatctgtgaccgggtactttataaagaaaagaggtttaactgtctcacggttcttcaggctgtacaggaagcttgttgccagcatctgcttctggaggggcctcaggaagcttacgatcatggtggaaggcaaagggggagtagcttggggagtcacatggcgagaccaggagcaagagagagaggggaaaggtgccacactgttttaagcaagtagatcttgcatgaacagagaaagaactcactcatcatcaaggggatgacactaagtcattcatgagggatccgccgccatgatccagtaccttccactaggcctcacttccaacaatggggattacattgcaacaggagatttgaagagaacaaacatcaaaaccatatcaacatatttattcacttttcttggtattatctatattctacgattaatatcatgaatagacagtcatgaatgaatagtaatgaatagacagtaaatgaatagacagtaaattctagatcagaacgtaatttactaatttactgccaatgaacagacactaaattctagatcagaacctaacttcggacttagtgcttccaaagtacatctttgtcatagtaccatgcatctaaaaacccagaatttaaatattttacacgtagacagagaaatagactaaatcatagtgtgattttatgaaaacaacgaaaacaactacttctttagtaatgtaaaacctatcaaagttccatctgtgatttgtctaaaataagcctatagctccatagtcagaactccaaagctgacaacctcttcaatccttcagaaaagacaataatgtcttttagaaaggttttagatttgccatgttcaattatctatattattgagcctactaaccacctacttctaatgttgcaaccagatatcattctggaaataatctttctttaacaataaaattttccatattaatttatagcatgagaatccccattcccgtcttccattattctcatttgcactaccctaaccttccttctcaatttttgcaatgctttccctcatagtacatcatatcataacatttagaacatttatgtaatgtgagatatggaaactgattttagaggtcatttagttggggaaagaaaatgtatatcacttcatatgttccagtagcagctgcctcttggtctcggtagagaagaattcagagggagagctggctcagactcagcagaaaaaggtcctcatatgatggcttatctatgttagagattgggaagtaagaattgtttgtatgtttaggtatcttttagttcactttgtctccgatttcacatattatcttttgatttcccattccctggtccaaatacccttctcaaaaagactaaaaatataaaaatattttaacgtaatttttgtttaaatcaaatccagtgtataaattattatggctatgtaaatgttatgtttagctgttccacacccacatagtataatgtgattacatgttatttcttggacagcttttgttttgcttttttctggagttaataatagcctaacattttctccttgatcatatgctctagaagggcagatagcagtctttctttggttcactgatgtatcctaaagtgtctagtacaacatatgtttctagtagacacatattaaaaacccaataaatatttgtcaaattaaaatattaattttcaaagctctaatagaactataaaattcctgtctatataatcagtcatgccagctaattctttagtttcattttaattctttgagacaacatcactgtcacctaaagctctctaaagccctcctcccaattgggcaggttctttttcttaacccattaccaagatatgatcgtaaaatgtccctttttattatcttggtaatttttgtctcagttttctataaaatctctactttcctgattttcatggtattctctttctttgtttagtcacttgttttgttttggtgaaacatattctttgtaacctgctgtgaaaggacgcaaagatagattttttggggggtttgttttgctatactatgtgtctaaaactgtgtattaaaaagtggctagatattaaattctagtctagacaattttttaaatttttgacagttctcacttccagtagtactttttaaaactctgatgccatgtgagtcatatgtgacatattttgtgatatgaccttctgatctagagaacttgttatttgaaaatctctattgtacaattctaaaaattttttctcctcctttttttttctgaaatagcttttcttatttggaaatagtatcacttcatttaattatgcaagtttcttctctttttttaatctcttattttaggttcttattttttcatactttatcaaaaacttccttacccttttttccagcagatttgtttcatgtttttatgctatcgtattttcagttttgaagcttgaattctttaagtatctccttttaatgttttcatagcaccctgttcacttcatcatgaatactttatatgatcatattccaggaaagacacttatcctttttaaaaaagttatcttctgatctaagtctattcttttacttctttcatttgtttgggtttctttacttttgatttaaaagctttcagtgataatttgtttcatattttttaaatgatacatactttttaaatgtgttacaaaaaaatgctttttggaagtactgtgttttggaacaactttccggccagtgcagtttattactgtatgataagacaatgaaactttttgtttgatgggaaactcaaatttaataaggcatttgttttctcacagggtactttagtgtccagaaagaatcctccagttgcttgccagggctgggatataagttgggttgcacgtgttctgggaatcaagcgaggaagatagcagatcacatcaccattttacataaaaacttatacagagtgcctatgatttcaccgggatgcttcttctccatcctaagctataccaatctcccctgagtccagaatctttacagcttagtttttccttacactataaatctaatccccagcatgggttgtgggggaagttgcttaggatgatttctaaatatttcttataagtcttttgactatttccactatcgataatacctacactttccttgcacgtcgaaggtgcttctgagcatcatgcggttcttctgcttaaatgatttcacttcttattatattctacttcttttagcttcctgcccaacctttagaatttgttccatctttacaacttgtacataaacggacctcccatcttctaaattgtgctgacatcttatcactacccaccctttattgtatttattcttttctatataattttaaaaaatattttatgttatttaggggaattctgaaagatctgtgatcaatctatcataatttgctaaaagtcttaacacatttaaaaattttaaatatccatgagcagaatgatcatgctgcaaatgtgattagttaactaaaatattaaatattaacaatattcaaaaaccttataaatgaagccccaagtgttaactgatttatcagtaattacatataggctacataaaaatatatttcctgtctgggcgcaatggctcaggcctgtaatcccagcactttgggaggccgaggtgggtggatcacgaagtcaggagatggagaccatcctggctaacatggtgaaaccccatctctactaagaatacaaaaaattagctgggcgtggtggcacacacctgtagtctgagctacttgggaagttgaggcaggagaattgcttgaacccgggaggcggagcttgcagtgagctgagattgcaccactgcactccagccagggcgacagagtgagactccatctcaaaaaaaattatatatatatatgtgtgtgtatatatatatatttttttctatatgtatacatatatacatatatataaaatatatatacatataatatatataacatatataatatatacatatataaaatatataaatatatacatatataaaatattatatatgtgtatatatgtatatatgtatatacatatatacacgtgtatatatacacatatatgtatatacatatatacacgtgtatatatacacatatatgtatatacatatatacgtgtgtatatatacacacatatatatatatatacacatatatatttcctgagggttggctctttcctctgtagaattttgattttgttgagagtagacttgtagtcatggagaacttaaaaacaataaaaacagaatgtaataaattgctaaatttcattatttagtcaggaaagccatagtagtttaggaaagagcaaaattaaagtattacagaatgtctcaggtgacttcccttgccttggtgacatgtgtatctggtttgttacatacttctaagatagcctttggattatgctattgtctgcctaacagctggaatctattcaatcaaagattatttgctgaaatatgaggcagagatctatcttttacataatcctaaatattcttttgaatatttctaccatgctgagaataaacaagtacagtgttttattttgagaacaaatttgggaactcaagttgataaaaagatggataatgtatttaactaaaatttttgaatcatactatgtgtcattttctctacttgatattagcaattgcgagaataaaaaaatgcagttactgctattagagcagaggcatgggcaatgaaacaagctacacttacttaacagagtaagtatgacaacggataggagcacacctgaaagtgacaatgaaagaaaggcttcccaggggaagtacagatttatccaaactctaaaacttaactggaagtcagatgaagaaggggaaatggtagtttggacaaaggaaccagcttattcaaatgcacggagtcctgataaaacatggaattgagggaaaacacatttaagtgtgactagactttgggagttagatttaaaaaccagactagtctgtgcaaagcaatttcagaaaattaagataccaaaaaatatatatattatatatgtatataaataaatatatatatatataatgttctaaagcagtatagtataatggagtttttacctagactagttaccagaaaatgtaaccctattatctctgtgaactttgacaaatcctttaatatgtgtaataaatttattgtttaggaccttttattttcttcccagcttcaatttcattgttaagatgttaaccagaagaataaggcccaattgacagatctttttgaaatttcagacacttttgcacttccctagtaatttgatggctcttaaccaatctggtgaaaacttttttcctatccacactgtagaatgttttacacattactctcaatgtaaattcactcaatcttcagactgacaaaaaaatttaggtttcaataagtcatttaacaaggaattccagtgataccataaactttcatcatcatccaactcagctaccctcctgatgcttaaattctctccacaatatttctgccagtcatcatctttattatgcttgagtatttcaagtgatactcaagtagttattctcaagtaagtctatgattagactcctctgactgaaagattttcttgtatcattcttttggtcataggtctaattttcatatcatgaagtgcctttaaaaaagaaaaaaaaaatgaagataatgggtttctagtgcctaaccaagtatgtggctccttggcacccagaatataacagtgatcattgtcccatcaattacttgagaatggaaattaaactatacttccaattttaggcttatcttctcagtgtaaaacatctcacattcctgtgattatgtctcagctgagatggtttttaggtctactaaaattttagtttgttccagttagttttttaccactcttagaaggtggaaaagtcaccatagagcttcaaacatggaaacacagagagcaatgaggaggctgctgacataatccaggacaagatattagaggttttgcttggataacagctgaaatgatcaaagaaacaaatagatttcggagaatttgggtagtaaagttcataagacctcctaatggcttggagtatatttggaagaggctaaaaggactcgataaggactccatgatatttggtttgagcagctgaggggattgtggtgccatttattgagatgagaaagattctggggaataaattttgtttgggaattcagtttgaaatgtctcaaagatatccaacaggaaatcttaattaggatattcactgaagttggctaacagaaaacctatttccctttaaaatcatgatcagtacctcagaaaggcagctagtcatttggagaattgtactacattttctttatcagtttgctctactactctctcagactggtgcttttcaaaagtaatgtgaatggaaatcactgggagatcttgttcaaaggcaggttctgaaaatctggtgagatgcttaagcatctgcatttttttcacttttaattttgttattattaatcgtcagtgcataatggttgtatatattcatgcggtgcatgtgatgttctgatacaggaacacactgtgtaatgatcaaatcagtatccatcacctcaagcatttatcatgtatctgttacagaaacactgcaatatcattcttttagttattttaaaatgtacaataagttattgttaactatagtcactctatgatgctattgagttgtagatattcttcattctacctaactgttatttttgtaccccttcttccccactatccttcccagcccttagtaaccatcatcctactctctatcttcataagtccagtattttttagttcccacatataagtgagaacgtgtgatatttgtgtttctttgtctggcttattgtatttaacataaaggcctccaattctatctgtgttgttgcaaatgaccggatttcattcttttttagggtagaataacatttcattgtgttatacaggccatattttctttacccattcatccactgatggacacttaggttgattccatatcttgactattgtgaatagtgctacagtaagcctgggagtgccgatatctcttagatacattcgttgcttttcttttggatatatacccagctgtggaaatgctggatcatatgatctatcatatgctggataatataatccatcatacgctggataatatctttaactagctcctatttatttttgtctatgtataaaaattaatatggattaaatacttaaatctaagacctgagactatgaaactactggaagacaacattggggaaacactccaggacattggtctgggcaaatatttcctgaataagacttcaaaaaacacaagataccaaagcaaaaaaggacaaatgggatcagagaaagcttcagttcaggaaaggaaatagtcaacaaagtgaagaggcaacccacagagagggagaaaatatttacaaactacccatctgataggtgattaataattaaagtatacggccaggcgcggtgactcatgcctgtaatcccagcactttgggaggccgaggcaggcaaatcgtgaggtcaagaaatcgagaccatcctgaccaacatggtgaaactccgtctctactaaacatacaaaaattagccacgtgtggcatgtgcctgtagtcccagctactcgggaggctgaggcaggagaatcacttgaacctgggaggcagagtttccactgagccaagatcgcaccactgcactccagcctgggcaacaaagcaagactccatctcaaataaatacataaataatcaaagtatataaggaactcaatagctcaataggaaaaaaacaaataatatgagtaaaatatcggcaaaagatctgtcttaagacatttatcaaaagaagacacacagatggccaacagttatatgtaaaaactgtcaacattactaattatcagagaatgctgatcaaaacaataatgagatatcatctcacctcagttaagttgacttgtatccatatgataggcaagaatgaatacgagcaagggtgtggagaaagaggaatccttgtacactgttggtgaggatgtaaattggtatagccactatacagaacaatatggataatgcatttttctttatgctcgcaggtgacatcaatgctatagatcctcagatgcactttgagtagcaaggtctgagttagacaagtctttcccacttaaatttgcatgccctgatgttccttcctcactctcagctgagtgtgtcttactgtgacttatttcaggagaaaatagaagagaagaagagaattttcacatgcttgtaccattaaatctaccaacccactcatctagtaggttttctctcttttaaaaatgggcttttacataaggccaatccttctgcttatttgctagattgcatcccctctcactttctcaaaggcatcaatcccataattgctacctcctttccaagcatcatacatttttacattttactgaatcattctctttagcataattaacatgctaagataaacgttagcttaaaataaaaacaaagaagttttgatactccctatttctttgcttccttttagtgtaaaacttttcacaaaaagattacatttattttctccaattgctttttttctgttttatggtggtagttctagcagtagctactgttaagatcaatgatccttcctttgccaaatctaatggtggattatctgttctcatgtcacctcgtgtatgaaggttattttcgtagttctatttataatactatcttcccttggactctgtgacatcaacttccctttgattttcctttgacttaatgtgtttgtcttttctgcctttttgctggctcctcattctcttttgacctctaaattttaagttacttttgagccaagttccaggacctcttattttctacatctatataccaaccctctaggtcaactcatattatttcatgcctttaaatactacatgtgttcttgatttctagaaacacaccttcagccgaggtttttccactgacctaaagtcctgtatgttgactgggtaatttattgtccaaacgaggacactttagaatgtgaagatgggggattattattaattattctgagaaaacacatgtaaaccaggacaaccacttgtctaagcagttttatgcaatcaggggtatatccaattgcctactcaccattatgtatttgggttttgggataaagatagctagctgttcacaaatacctattttactcttctgtagtactagaaccctgaatttgcagctggttacaagacctgatagaataagaactgaatttccaaacctcttttgtattttatgtggcaatgtaactaattctggacaatacaatgtaaggttagttggtgtatggaacttctaggatttgccttaaatgtaggagatgtgcatttctttgaccgctttccctgttctgatgcttagattatgaaggtaggagccatttagaatctcttagtagaagccatacattgaggaaatcagtacaaaaagatagaagacgcttagattttgatactggtaagcccctggactgctttaatatgaaataaaaataacacccatcttattattgcctttgttaatttaccattcattgcaatgaaaccaaatcctcactaatagaggggcttaacatttatttatatattcaacaaatatttactaagtgactgatactattctaggcatttgggatacaataatgaacagataagtgggcccttcagagcttacagtttgcaaatattaacattctggaagtatattctaatgaaagatttacatactaaatattaaatagtatactatataaaggtaataaagccaaaagtaagagaaaaagtaaagattgctaaagaggcttagaaattctggccataggggtgatttcttaattgggatagacttctcaagcagataattgtgagcaaggaggtggataaggtgagtaattttgcctatgaatctatctggaggaaagccatcctaggcagagctgagaaccatacagaggccttaagttaggagtattcttattctacaaaacataaggaagctagtacagctggtattggtgtttatagaatgatatcagagatgaggtttagaggtgatggagagccacatacatctttcagcacttgtagaccatggcaaagacttttttgtcttactttgagtaagattaaaaaaaaaaaaaactattgcaggattttgagcagaaaactgacatggtctgtcttagattttaaagaatttcactagccataatgtgagaatgtactatgagggtagagggtatggggaaaggatagaagcaaggagaccagtttgtagattacggcaggaatcgagatgagagatgattataaaatcaaaaagtcttaaatatcatgcttaatttctcatctctgccttattgaaatagcttcttctgcaggcttctgtatttctgtaaatagaaactttgctcctcaaagagactgggtctaaaactttgggctcatttggaatcattcagagataggaacacagagaaaatggcaatacatagatcttcatgcaacttgttccagacactcattcctgtcctttccagttttgttggatcagccacgttgcaattatgcatgataatgcaacattctcccaataagttcttctccatttctaagctcgtttacactggatttctattattagaacacattttgttatgaaagtcttcacaattacatataattacaggtcactaacacttgctaacttgaaataaaacatgatttttattaactggccatttcctaagttcctgtgctttgccattgtaatacagatgttaaaaataaaaacactgacttttcttttctctctttagaaataaaaattaagtttatactacttttgattatttgcttacataaatattactgccacaaggaactatgaattacgatgtaggaaaacaattttatatttacaaatagccatggtctcttaaatgcatgatactccttgcctgaaatatactataccaataaattaaaaaccacaattaaataaatgcaagatcaaaaatcacgattttccatgaaatagaggaaagtcattacaaaagttatatttttaaaaatccattacttttacttgcatttttccagctgacaccaaaagagcacacttaagttcaaaaggaacttatataattttacttttggattttgaagtggcacaaatcaaaaggtctgactaggagggccagattaatgctttggagacactacacacagaaaatattgtgttgtgttctcttaacccatacaaatcaacctgacgcaatacaaaagtataaatgtaagccactcaaataattctaaattttcaccttatgaaaacaatgatttaaaaaaaaaatcagctttttagtctactaagtgggttgtccaatgcagaagcagaagaaaaccatttctggaattgccccacttgtcctgaaatttatacaatttacagatactgtaaaagattcagcaagtagaggaatgattcaatttgttggaaatgttcttctctgagtgagatagagagctattgcaggattcagaattaagatccagagggttaaacacaaaccaattaacaattaggagattttcattattaaactccctgtcactgtaagtctagaattcaaacaagtataactttgataatttttattcatttatgaatcactctatattttttaataattttaatttgactttgaaaggatttaatatatttctaattcatgtaattgacaatggagaattaatctgaggaaataattggattttctcaggctatctcagagacacaggtaacagatgaaaaattattttcctttaaagtcctatactttagcttactacagaatacctctgatattatgatttgtttcttgtttaaaaattggaaaagtaaaatagatttacacataatgttacagttatctgaacctggttttgggtctccagggtgacataaatgtcacatgaattcatacaagaacagattttcagtttattcccctgatggaaaaaaatgttaatagatatgccactttttaactgttgtattaaaattaataatcatagcctttttaactttctgtgtcccaggagtatggtttacgttggagtacattctataagttgaaaaacaaaataataataattacctataatgatctccaaatactcatgccttttgtattaatttactcagaggagtaattttgaactaacatatacaaacacttcgtaaacaattaaggaattctgggaaataaatttagtaaaagctctcattctatttgtggctataaaatacacatatatacagcacaagattcacatttttattatcaatatttctcttacttttactttcatctactggaatatatgaccaggaaacaattggacagcaattttaaaacactgctatgtaagcagatttatgtaagtgataaaaagatacacatactttttttgtcttcagtaacttgtcttttagactaattcatcctcatgtatttgcttactgatgtcacatgtatttagatttacaaaaatttagactaaagcaacaaaaaatacctattgcttggttttttatgttgcttgctaaaatatttgcattttataaatgtgtaatgaatgtatgtaattaatataaattaagtctaaaatttatagacatatagattatatccatcgatacaaacatgaaaattgtgcaataaaacataagaaaatgtttatacatatagataaatacaatataaaaggaaggaagtagggaaggaaggataaaggaaggaagaatgggggttggggggacaggaaaaatgtattaactcatgaattaacccaagagaaaaaaatgtaatagtgtcaaaaaactcactaaactttctttgatatggaaattgctcagatggtttatatatgtatggtcccaattttacatatgattaaaatagaattttcaaatcaaccttatgaacattttcaaaaggtaaataaaatgagatgttatttattacatttataagtcaaagcagcatagcatttttcatttataaaccattgcatttttcataccaattcaaagtgaaacatgtcagtactcagacaatttgtattaaatttatggcccacatttctggatttgttatttaaattataattaatttgaatcgtaatgcaggatataaagtttctgtggaaaaattacttctgtgtttcaagtcaattatttaaagtgtatttcaagtttatttgtattcttccttgtctagtcgccattcttaataactgttttgattgatttaagtgttctttaatactaggcaccaataagatctatttattagatgtataaccgtgaacacacaaaaatgattctattccctcttggtcaacgtacactttccctcaggagtatcaatagtgatcatggccctctaaatctctgctgcagcttccaatgccttcatcttttcttttccaaatgagagaggagtgggcttgaatctactagcaaatcagatgcagtgcctaccatggtacactttgcatgtaattagggaccagaccttgtcgatagcaaagccctctctgcccacacacttcatcctaccctatattatcctatcctattctgttctatcctgtcctacctatctgtgtacatcagagaaaaaacatggattcttcttcacagctattatgtcagtagcagaggataatgggtctaaataatcttaactcatccacattaagttatttaggtaaaacagttcaataaatgatgacgtagttcttactttgtgctaacatcaatataaaattatctttggattcattttgaaccaaaatatacttatttcttaaaatttgaaaaatagtagggttctaatcaattgtgttttctatttctttctctctctttttcctaaagtcagtagtaataaactgcgcttcaaattcacttatcttttgtaaaaagaaaagtacaaggagttttaagtagaatcacagaatcataggtgtgaaaagttaacgttatcttaagcaatgcttgagccctgtttgcatcattccaacaaaataatctgtcttatacttgagaggctctaattacatagaagtccccattattccaggaactcattccattgtctgaaaacagtaatcaccacaaagttctttctcacaggtgaaaatctaccctctaaagcttcctctcatttatagcttcatcacataaaaacaattatattcattctaaattctgctgccatgtgcaagctcctcaaatatttggaggacctctttatgtcctctctggatgttcagttctccaggtaaatatttccagttcccttaaccattcattataggacattgttgtccaagtatactcattccttgtggtccatataaatgtttcttctccgcatacactcttaattccaaatagagaaaaagaaggaaacttcagcattcctaacaaaaagctaactacagagaacacagttcaatgcacccatcacaattggaacaatactttaagataatgcaataaatgcccgatagaaggactgcagataatgtaatagaaatgtgaaatattttacattttattccataatttagctgagagagcttctgaaacactctttctagaagtcaaaaaacagaactatatttctatttttctttttacgtatttcgatgttataccagcattatgcaaatgacaagtgcatgcaatgtaagcaattattatcttagggagatttcagcattgccactactgtttgcatcctgtatttattatatggtagcacaagtaaacttccaagtagctacctatgaatagcaaaaataagatcagaacttcaacataataaccacttatttcagtggaaataactgaagtaacttaagtgacacttcacacaaaattttcagttgcttcaagatggtatctgtaatgaatgcattgaggtgtagcacgggcgtcattactttaaagatggaatcactcattgtgccagctggtgagaatgatcatgactaacagctagctatcttccagattaaagagtctcgtctcccaaggttgcattttttttttttttttttttgagacagtcttgctctgtcacccaagctggagttcagtgccgtgatctcggctgggtgcaacctccacctcccagattcaagtgcttctcctgtctcagcctcctgcattttcttttcaaggtaacccacatctgatgactgatcaatgcagaaacataacaacccatcccttgggtctgggatgattcccatgtatttattttgaaaaactggaaggtggactcacaactttcagcaacaggaatgactttaagacccagtttggacattttagaggattaattttggagggactagcagtagcttttccaaagagagacgtcttgaagttagaaggaaattaagtttggaattgagagaaggactagagttggacaatatatattttaaaagttttattagaaatgacatttacaaaaatgagactagatgacattttaaagagaacgagcacaaataaaaaatgaaagaggtgttacaaatgtatggattaaggagatgaagagtaatcggcagaagaacctgagttggaatagaaaggtaggcagaaaatgaggcaggatgagatcgtggccctccgtgtgacaatgtgaagcctatagcaacagggcgctataggcctgcgagagaagagtgaaagaaagcatggttaccgctggaaaggctattgcctttttgtgtttgtttctttattggcctttttctgtttgtttccttattggcctttttgtgtttgtttctttattttacaacataatttttcacgcagcagaaccaattccctactgattcagtagatgggctttgcttaataatcccttagataatcattacattctatcatgagaaatccgcctatctgttggataggcaccaaacattccaactaactgtgcttttgactgaccaggacttaaaatctttgggggcactccttaaattctcactaccaaatctgcataacaatgatcatacagtgttgatgtggtgttctgatgaagctatagttacttttgtcattaattaatgctctctaaatgcaatttaatgatatttttcttttatatacatggttgaaaatatagatgaaatatagcattgatatagacattttggtacattcttttgatgaaaacattttgttctgtttattttatttcataacacatatttcaaatgtccaaatggataaggatgcaaagtctttgttctacagttaaacatgtaatgtcataaattcatggaagagatttattttgactcataataaatgaggaagtatcaaaaaagaccacttagtgctagagttgataatcattttactaaggtacataaaatcatttgaagtcatcgtacaaataagtatattttagaatgacttacaaactattaagcaaatttaagagatcatgatatttgactggaaaaatcatgggtagaatgtcttaagtggttttaaaatatggctatatctcttaaaagggccttaggctctggcaaagtaactagaaatgaattacagttaatctatgaaagaattttagtcttaaatgtgaaatgtaagagggtgctagcaaactaagagacactaacgtgagggtctttaggatcccccttcacatattttcgtatacatttgtggactatagatgtggcaccaaatatttattaattcaacatagtttaaaaatacaggtcaaatctactttcctgtacaaacaggtgactttgaatgatattcaagtcagtgcacattcttaccaatcaactgtgcaattaccttgcgcttcgtatcttctggctctgtacctgacctcatttgtactgtctttcccttacatatctaggcagaaagcctccctaccaactgtacctcgataacaggccatattcatcatgaagtcttgttttgaaatcacaattaaactccactatgattccataaaacatatgtagtatcttcactatagaaaaatctaccttgtgactggtaggactatttcttctccctctaaataataagttcctaataggcaaagatcacctgtataaggtgtgttccaatctactcactttctgtttcttatattatttgatacatgctaagggtgctcaatagatttttttgttgaattcaattaaaattcgtacaaaacagagctccatgctaacataccttttctagctgtgtgatattattaggtgagctagtaactttcttgatcattagttacctcgtatacagataatgttaaaatatctacgtataaatcccataaggatttcacagtacgacaaatttaaaataattatcacagtatcattcacatagtagtggagaataattcaagagatgttagttctcttactgcaaaacagctcttaaaattatgataaggtggccacacgcagtggctcctgcctataatcccagcactttgggaggccgaggtgggtggatcacgaggtcaggagatcaaggccatcctgggtagcatggtgaaaccccgtctgtactaaaaatacaaaaaattagccaggtgtggtggcgcttgcctgtaatcccagctactcaggaggctgaagcaggagaatcacttgaacccaggaggcaaagattgcagttagctgagatggcaccactgcactccagcctgggggacagagcgagaatctgtctcaaaaaaaaaaaaagaaagaaaaattatgataagcctaataaaattgtttgcactatatggcctcaatttatcgtgtagaggaaattatgttagaaacaaagctaaaaactcttcaactcaaaagaattactagtgatttggtaatagaaattcatttacgtctaggtaagttaatcatttcaacatgctgataaaggaaaacaaaactatttctgaacaattttatatactctttgttttaaaaattctttaacatgaggaaaactcttttgtccttgtgcttcaatgcgttatcaataataaagaaggggcttaatataaaatgtatcgtttgaattcaagattatttgaattttaaaaaggtacttttcttccagctatataaattgcagaaaacttaggaaacacagaaaaatatacagcaagaggaacaatatataatttttcaattcagggatatgtgatactaatgttttattgtcttttttatttagcttatagatttatgatgtagttacacttaaatatacgtgagtatgtatctatattgatttatacgcactattgaaattttatctcagtatacaaagtggatattttcccacatcattaaacattttggtaatgtaacattaattcttatgtgacattttactatgtattgtaccatcgcttgatctgttgcccagttgttggatattttcactttttttttgaaactgtaaagagaattacgttatatattctgacacataaccataatctacatttctgattgttttactggttcccaagaaatggatttacctgtatgaatatgtgaacttttgagatattattttatatagatgtattaatataagttcctaatgtgaacttccttatccaaaagttgatttatgcaggtagagagtggatgcaggtagagagtagaatgatagtagaatgatagatactagaggctggcaagcgtctgtgtgagaggagtttagcacacaaagaaagattggttaacaggtacaaaaatacagttagaagaaataagttctaatgtttaatagcagagcagggtgatggttaatagcaatgtattgtatatttaaaaatagctggaagcaaggacttgaaatgttcgcagcatatagaaaggataaatactccagatgatagataccctaaataccttgaatcgatcattacacagtctgtgtgtgtaacaaaatgttacatgtacccctaaatgtataaatatcatgtgtcaattaaaaagttaaaaaatagcctttatgacaatacagtctttactaattttaaatattattctttttttatatttctttgaagttagagattttttcctaagttcatatgctatttaaattgttttgtttttaatactggtattttgattatcttatgagagctaatcatatatcactacttaattatatacattaactctttctcacatttatggcaaaaatatttcagactttttaatgatggcattttgtgctgtgcattcgttaatactgtatatatttcacagtactggttttatttctttatgattgttttgcctttatattttatccttgcttgtatattttacatacatttataaagtttctaatgataccatttggaaatcattttccaattttttctacacatatttctatggattgtatgtattttttgcattattagtattatactatacatgttaatttgtcgttcttccacgtatgaagtgagcaacttgtcctaccattacttatccaatttcacatgacattttaatgtgttatattgagtaaatgaactcataaaaatttttcataatttaacattgaattttttatccacatactgtactcagtgctaaattctaaataaaaaatacatagtattactaatgtgcattcaatgtggcttaaatcgctcttactggaacacatgttaaattaataaaatatggtctttaagtcacttttctaagctatacaggtgttttgtatataaatgattgctgtaaaatgctgaatagctttttttattgccttacttaattggtagtctctttacctcagtcgtgaagtttgaaataggaactaaaaatcattagttttaccacttgaatgataaaactaaatcacaattttagacaaaaaaaaaaaaaaggacacagcaggaggtcaataaaagggaaagaaagagtaaaacacagtttatttccaggaaagaagccgtaattgttactcagaacacataaggagagcgtgattttaaacatttagaggaaatcacaaaagcttgaagggccttcccccagaggcaccttgaaagaattcatgtttctaaaataggaaacatttaccaagactttgtataagaacagtttcaggctagtgtcagcttaactaaagcaaatgaactttctggccttaatagtcttaatggtcactgtgctacttctgtcaacatggtttgcttttctttaaaaaagagtatctgtctatctatctgtctagtatgcatataaatataatgtgcaatatatatattgcacattaatggaaaaataagaaaacttcctcataatattaagctccacaatttttagaaaaagaggtacattttttaatgcaaataaatgatatgcttccattggaattttccaagattctttttcttgtgtgattgatttctgtctggaataaaacttacatacaatgattcttctattgttaaaattcgatacttaaaagagattagaagccattttctcccaatgggaatggtcattttacaataaaatatattttttatataattagaaagactacatattgtttctctggcaggtccccagtcatgcttgctccaatgataacaagatataacaacaaaaatgacgaaagcattttttgggaaataaataaaagtgtgtatatatagatacagatttagatagcaatcatgaaatctgaccttttgatttttgaggggaattcaactgattttgggaaaaatgacaaatttacatattttccatgttttaaatggaaataaattatgttttttgggacttctgactaaccaagtttgcttatttgctgtgtttttatttgtttaacctttaatgaagagctttaggaagaagcagagcaacacctcagtgaccatacataaaaggttttgtcatatcaatttaaagcagatgaataattataaactttttgagactgcaatagcctatcagtgtgtaaacatattctctttctttttaatcttatacgattttattttaagttccggggtacaagtgcaggatgtgcaggtttgttacacagataaacgtgtgccatggtggtttactgcacctatcaaaccatcacataggtattaagccccagcatgcattagccattatttctgatcctctctctcccaccccctgacaagccccagtgtttgttctcctccctacgtccacgtgttctcattgtttagttcccacttataagtgaaaacgtgtggtgtttggttttgtgttcctgagttagtttgctgaggatagtggcttccagctccatccatgtcactacaacagataggattttgtttctttttatggctgcataatatatcatggtatatatgtgccatatttgtttatccagtctatcattgatgggcatttgggttgattccatgtcttttctgttttgaatagtactgcaataaatatatgcatgcatgtatctttataatagaacaatttatattcctttgggtatatacccagtaacggaattgcttagtcaaatggtatttctggttctaggtctttgaggaattgtcacactgtcttctacaatggttgaactaatttgcattcccatcaactgtgtaaaagtgttcctgtttctcctcagccaacatctgctgtttcttgactttttaataatcaccattctaactggcctgatatggtatctcattctgggtttgatttgcatttctctaatgatcagtgatgttgagcattttttaatatgtttgttgcctctataaacgtctatttttgagaaatgtctgtccgtgtcctttgcccactttttaacggggttatttgtttttttcttgtaaatttgttgaagtcccttgtagactcaggatattaaacctttgtccaatggatagattgcaaaaattttctcccattctgtaggttgtctgttcactctgatgatagtttaatttcctgtgcagaagctctttagttaaactagatcccatttgtcaacttttgttttgttgcaattgcttttaacatttttgtcatgaaatctttgcctgtgcctatgtcctgattagtattgcgtagattttcttctagggtttatataattttgggttttacatttaagtctttaatccatctttagctaatttttgtattaggtatgaggtaggggtccaatttgaattttctgcatatggctagtaagttctcccagcactatttattaaatagggaatcatttcctcattgcttgtttttgtcaggtttgtcgaagatcagctggttgtagttgtgtggtcttatttccgagttctctattttgttaaattggtctaggtgtctgactttgtaccactaccatactgctttagttactgtagccttgtagtatagtttgaggtcagaaagcatgatgtctccagctttgctctttttgcttaggattgtcttggctatacgggctctttgttggttccatatgaattttaaaatagtttttctctaatttggggaagaatgtcaatggtcgtttaatgggaatcgcactgaatctataaattattttgggctgtacagccattttcatgatattgattttttctacccatgagtgtggaatgttttttcatttgtttctttcctctcttatttccttgagcagtggtttgtagttcaccttgaagaggtcctatcacttcctttattagctgtattagtaggtattttattctctttgcagtaattgtgaattggaattcattcatgatttgcctctctgcttacctgttgttggtgtataggaatgcctgtcatttttccacattgattttgtatcctgagactttgctgaagttgcttgtcatcttaagaagcttttgggtttagttgaatggagttttctagatattgtatcatgtcttctgcaaacaaagacaatttgacttcctgtcttcctattcgaatgccctttatttctttctcttgcctgattgccctggatcttaaactattttaagttaatgagggatataaatattttataatttcaattagtaattggtaactgccaaaatgtcagagtgctaatctgggatgaactgaaattaacgtatacttatctctatgatctaataactttggcttgtctcttatatttctgttattccctacatgatttcccaattgaattcatcaaaaaccgagcttctactttgtgtcaatttttgtttctatgataagggaataaagaatatgttaaacatataaaatgaagacaatgtgaacctttaaagaaataggaactagcatattttatgggtgcacaaatgcagaatgctttgttcagccgaggagaggttagtagaaaaatagttcctgaagaatcatcttcaagtcaatgttttgttttgcttacctgtagcgggccttcaaggcttctttccctcaggctacatggctgcatttaatttcaaacagcataaacaaaagtcctttatagtgctttgtcacagctgaattgaattatcctagataagacttctcaaacccagataaatatgccattcacttggtgctaaggaataattattcagtgatttcatataaagttgctttttctcttaactttcttgtagccagtgaaaatcccataacaagggacttccaatttgaaacaacaacaacaactaataaatgaaaacattttcaaaagcatattatgtgtggaaatactggggtgttattgagtgatttaggaggcacacaggtacaaataacatactggtataaattgtagaatgatgtttcagatatcgtcaaataataatattctttgtttatatatggtgacgtttcttgattcttgtattctgtataatgtgcccagagttaatagacaaaatattgagttgggtcatgatcaattagtaaaatggtgttgtgaataaaatatacatttaaattttaatcgtatgtgtattaaataatttgttttaggccggatgcggtggctcacgcctgtaatcccagcactttgggaggccgaggtgggtggatcacgaggtcaggagatggagaccatcctggctgacccggtgaaacccatctctactaaaaatacaaaaaattagtcgggcatggtggcaggcacctgtggtcccagctacttgggaggctgaggcaggagaatggtgtgaacccggaaggcggagcttgcagtgagcggagatcgcaccactgcactccagattgagcagcagagctagactccatctcaaataaataaataaataaataaataataatttgttttaacatttgctatagaaatacagctcaaagagaggatgtgaaatgttcccaacacatagaaatggaaactataaagagaattgcattgcaaatcctgacacgtaaatttaatctacatttctgaatgttttcttggtttgcaagaaatggattaacctgaatgaatttgtgaactttgagatattctttttcatgtagatttacaaataaaaattgccaatatcatggaactagagagtgagaatgatagttatcagaggctgggaagagtgtgttggacggggacgggggatgaagacaatgggaagaaggaaggcaaagagattaagaaaagagagggaatatgtttaaaatacatgaagacagaaggagggccaaaataaaggattctgtcttcctcaacgctctattcgtagatcttagcattatgtgcacacataggagatgttcagtaaacaactgttaactatttacaggcactgcagaatttgttacttttattaagttctattatgtaatttcacccataatctgatatgtatacctctatcactgtacatatcataccattgaaataatttgttttgtgagtatatctcctccctcactcttgaattaccttagaaggcatgatccaagtcagttatttcatctccactacttatgtgcctaataaataatcagtttgagtcattatttattatgtatttctaatgtagatatttatttaaaaataaataataatgtaaattttaaataacaatgataattaataaataataaaagtaaataaataataaccttgtgcctaagaaacaatcacttggtaaatagactcaactgacacagatatcattatgtcaataagcatcatcatcaccaataaaaacagttgtgaaaaactattcagcttgctgtgtctactactgaggaaacaaagagatgcatggcatagtctctgatctagaggtatttacaaagtcaattgagaaaccaggatgaaatggctaatgactgtttgaggcaggcctttttataacacaaaggaggaaatgaaacctaccctttttctttttttggaaatcaagtggcttaaaattatattggtaattacacttaatttgtactcataagcagacattaacattcacctttggaagataatttgttcattcaatcaatcttgtatgttctttggggagtgggggagattaggaagctgaagatagcacataacaaattatattttactatatactaaaatggagatgaagaataaaaaataaaagcaagaaaaaataaggatatgtctttatttgcttttatatagcaatcacacttaaagctaaacattatactttatccttacatgtatactttgggacctattcatgagcttcaaatttaaatgcaattcatctaattgctgagatgaaagaaaaaatatgagatacatagtttagcatccctaagattaaaaacataaagaatcaccatgttcccaggaaaattagagctattcaagtatttttgaattattttacagatggctctgtaatcatagtgaaaagtgtcttagataatatccttacaataggtataactatgagttaaatagggctatttcttatagcagtcatcaatataatatagtctgagtaccttattttatccagatttggttagatctgagaatattttaaaatatttgaaaagttagttggatttcttttccttggaattatattcacttagtagattttgtttctactgaatttgcaaaatgtcctatgaggaatacttaactgacagtggcaattgtctggaatgccagcagaattttcttgaataaagtttggattcctgtgttttagcagaaaatcaaattaggattgggttttatcctttcatgaggaaggcaaggaacctggaagctggcttctgcagtgaaccaaaataggacttcacgtcatggacgtggtattcttaaaaataataataaaaaattgaaactactgagagttaaaatgggcagtagaaacttcacaggtatgcttcattgtcaatatacttctaatctaaaaacaataataatctaaacagaaaaagactttgaccttggccaaatatattctcagtaatcatggagtaccaagcattgtgcaataatatttcccggtataccactcataattgagataaaaatctccaaaatgattgagttaacttggtttagtaatttaaatatgggggatactggaacttttctttccactacagcttttcttccttccttatctccttgaatgttccctctctctaggaaggataagtaccaatgtatagataagttttatcagatgaaatgccaaaaacaatgaagatatgcagagctactagccttgtgttattttaaataatatttttcagcttaattttaataatattcacaaatcttagcaaacattctacacacactcacacacaaacacacacacacacacacacacacacacagagagagagagagtctgaattaaatggggctcaaaatctgcttcaactgtttactaaatttataatctaagaaaaagtatcttcctcaatgcttatacttctcattggtaaaatgcagatagttataatatttttctcatataatttttgtgaggattagaagagtggccaagtcataaggcagaatgttgttctgataagcatggagagaattattgcaaccacctttgcaaacaaattacatacgatcgaagtaactgctcactatttttataagtattttcttaacagttttatttgcatatttcatcagatgaaatttagagtcattgtcaagttttccttggtcttcattcagtttgctctcggagtctgcccagtgcatttgctttgtatacttattccaataatatcttatattcctacaatgtattttaattttctgcataatttatatgtttattgagtttgttcctgtgatttaaatttttcttttttttcttatgtattatcacaatatttctacttggttattagtgatatagaaaagttttgtttatttgtatgttctttattctaaatgatttcatgtttaattcagtgtaatttttaggagttttttaatttgttattttcaacaggcaatattactacacgcaaaacattgaaaaatatatatctactctttttttatattttcttttgttcattctttgttctgttggcatgattaaaattgccttcattttgtgtaataatcttcagtatgttaacactgtgtaagattgatgttattgcaagataggaatcctttatcttgcagaaaatagaagctctatctctaatttattagttttattatccattcacctatttacttagtcatttaataagtatttataggccaggcatggtggctcaggcctgtaatcccgacactgtgggaagccgaggtgggcgcatcacgaagtgaggagatctagaccatcccggccaacatagtggaaccctgtctctactaaaatatgaaaaattagcctggcatggtggcacacacctgtagtcccaggtactcaggaggctgaggcaggggaatcgtttgaacccgggaggcggaggttgcagtgagctgagatcgtgccaccgcaccccagcctgatgacaaaacaagactctgtctcaaaaagaaaaaaaaaaggcatttataaaatgcctagtatgtgccagatacttcaatcaaaaatttaaaaataaaaacaaaactatagagataattttatgttttaattctttgatttaataattatgggtccaatttttataagcaaaaataattgctcttactttactcttgcattttatctcattattggttactatctacaaaccaaaggccaggaaaaagtcaatgaaaatgattttattcactattttgtttactttttgtattgttcctggtgcatttttcctaaactgctatgctatataacagagcgctattgtaaaataatctaacaaagctgcaaattctttgtaacatatttttcctgtaagttgaatataatgtcctctaaagtaatttgtatacagaaatcatatagcaatatatattagggaaagaaagcactgcatctttttaaaaatgggataaatcatattacatatccatcaaagtagaataatgcacatggggttaataaaaaggaacaatttgttaaattttttccagaattgcatctagaagcaaaagtcaatttggcttaatgcctataatggagttaataagacactttagaaagtgattggtttatataaaaaacatggggcgtttgaccttgatttttaaattagagagaatcgattggcataaaatgcaatctgaacctacacaatttcaattaccagattcattcttaaatgatatcccagaatcatctatcattgctgggtcttacacaccacttcaggaactctcatatagttgtaatttaagaaattttttgaaacaacttagtttgagaaattcattatggcttcgttaagtaaaaatttcataataacatcatacagtttggaagcattatgattttggaacattgcctaacttggcaagaaaacagtttgtgaataagaaatctagctatcttgttagtatgctaaaatattttttgtcaaaattttcactaagttctcctccaagaatagcatgtttcttggaaatggtaaaattgatcataaatgtattctatctacatacaagtgcatgatctgcatctcagatgaactttatgcaattatcaaatagatggtttacaatgattaaaccagttgaaacaatactaagataaataaaaattcatagatgcaaaaatatattgataggaaaataatttatcataatcattgtgactgaagaaaatttggcaaatgtagaaaagttataagaaataaataaaaactacctgtaactaattcctagatataactttttgactctatgactttttttacaggtttatgtagtagtttatttctctgttttcctcctcatttggcttattttcaatttttcattcattgtaaacagtactgtaaaaattaattgtacaaaatgtttgatcacataactgatgaataagaataggtaattttttaaataaaatattttccaattgagatgtaagactataagtactcaaactaatggagctgaaaaagtataaagattagcttctgattatattctaagagtagaaattaaattgagatttagccaagtttaattatcaactgaaatagttttaaattattttctagtttccatgtctgagttttgagtgataatatgtgtatgcaagtatgttttcattatggatcaatggttttaaaagtttagtctcgaatctaagttaatggaacattttttgatagagtcataatgtctcccacatattaggcgacctctgtttttccatatgaattgcttttaaaattgttgaaggacggaaaattactaggggagggtgattctgtaaactaactgtagctttccaactgtgagtaggaaaacactcatatctttctgtagacctcctgtacagattcatcacttatgaaaaccaggatggaactagaagtctcaaaaagtcacataaggccgggcgcggtggctcacgcctgtaatcccagcactttgggaggccgaggcgggcggatcacgaggtcagcagatcgagaccatcctgggtaacacggtgaaaccccgtctctactaaaaatacaaaaaaatttagccgggcgtggtggcgggcgcctgtagtcccagctactcgggaggctgaggcaggagaatggcgggaacccgggaggcggagcttgcagtgagccgagatagcgccactgtgctccagcctgggcgacagagcgagactccgtctcaaaaaaaaaaaaaaaaaaaatttaaaaagcgagtagtcctcttttaatatttttatgtaattcctaattggaatattgtttaagtagcccttgttccagatgcacatcaatataagtgtggtaagttttcattttaggccacaaattaaagttgacatttaatgtaattgtctttatcattgtctattactatctcagattcctagtcttttacatggtgaaaacttggtattgaataattgggggaggttttcctcttttggcttttgcctggggttgcctttaaatttcataggattttgatcctaaaagtgtggggacgaaattaagaggaaataatgagaaaaaatctattcagtgtgtgcaagggagagtgaacagtaggaaaaagtagagaacgggcattatctgttcatgcaggataccggctatatctgtattctcctcactctatctacaaaatcaggtccatcagcttgttttgccacgtccaagctgctcttggccacagaagaaaacatttgtgttttttccacaacatatggaaagctttcagggctatctctggcctgactgcctacacagagggaactgaaacaagtcttttctgcctcttcctcctctctctccccttcatcttcctccgcctttaccagcttattatgaaaaaaatttctggggtcttgcaacttttggatccctaaacctttttagaagtttttatcatttttcttatgaattccaatgctgaaccctggataaaacataaaattaagaatgaaaattatgatattgatcctcagttctgtctaaaacaaatacaaacaaacaaactgataaaagaaaacaaaatccttgatcagtgtgacaaagggcaaagattctatttggatttagatttctttcatgatagcgtctgccccgtaaaaccaaacacacagactgtgttaatgtcagggttttaacatgcgtcactactgaaaaacaacctgtgcaatatagaataataaatgtaagatatacaagtcagaaatgttcttaagttagtaattactctaaatcttttctgggacatgtcagtgtataaatacacacaattcgagattcaatgaataatcttatagaaggtatttttattttgtaattataacctgtctgtagtagaattaatctttctttgtttcagcccagtcttttaatattactctccatctttacaatatgtctacttagagaatctccatgcatgcatccttagcaatttatttccttggatgtgtactccttccaatactgtccgtaaaatgccaggcaatatttgcagagttgctaacaaatgacttggcattttctattgtgacactccttcatttgattgttggtttttttttttttttttttttgattccattctttctagtgctttggtggtgagaactttgttgtgttctcttcggagatgtgactcactcaatgattaggaactgatctgaaaatatattctttcttaggtggaagtgtgagcaccaaaatcactaaatttcaactcaaagcagagagcaagtatttctaattaacactttactctcagtgaagtgtagaccattagttataaggttacatatacatatatgtgtgtgtaggtaggtagacagattgatagatttttttaaacattggctgtccgtttttaaaatcagttttcatttttccctgtgtccttaatcatatgttccttttattacgtctataaaaataatttgttgctgaataagttgacaggtaacacagcttatttgatcatctccttgaagatcacaattcacagttatgtatcaaaagctccaagaaagtctgtagtaaataaatagatttaaactttgcattctggtgttttcaagatactgcagttaaatttgctttgttgtttataatccttacatagtcctccaatatatgtgtctttgatgatggaggaatacagcacacacacatacatacacacacacacaatttatctttatcatttcaattagtgaacttttaaaaattatattgttagatgacaaagtggtaacactatagtaaaccacaaaaaatttaattatgatggtaaatgccattttattatggagatttaaatccattcaaaataaaatgtatataatatattttcacaaatggaaaacaaaacatggcagaaggatttgccaagaagttacttctagttattggtagcaaaaaaataaatcacctggagtgtgaaatatgctattgcttcaaagaaaaacattgggctcattaatttggtatcaattagtatttcaatatttgattggtagaataataggtctgtgggaggtgtgtgaggaagaaacatattgaagaaaaagaaattcttaaatctgttttttcattcaagagtctacttacaagtcatgttaaagtatttacattaagacaactattaaatattcttccctgttagtaatttattgtctgtctcctgccacaagaatgtaagctccattagggcaaactttttttttctttcaacttttattttatgttcggaggatacatattcaggtttgttacctaggtacactgcatgtcgctgaggtttgagatacaaaagattctgtcacacaggtactaagcatagtacacgatagtttttcagttcttgccctcctcttttcctcccaactctggtagtacctggtttctcttactgtcatctttatgtccataaatattgaatgtttagctccagcttctaagtgagaatatgaagtactttgttttctgtccctgcattaatttgcctaggataatggcctccagctccattcatgttgctgaaaaggacatgatcttgttctttttcatggctttatagtattccatggtgtatatgtaccatgttttctttatccaacttactataagtgggcatctaggttgattccaggtctttcctatggtggacagtgctgtgatgaacctgagagtacatgactttatggcagaatgatttttattcttttggatatacacccagtaatgggattcctggcttaaatggtagttctctttttagttctttgagaaatctccaaactgctttccatagtggctgaactaatttacgttctcacaacagtgtataagcattccttatttgcaggctcacaagcatttgttgttttttgactttttaataacagccattctgactggtgtgagaggcatctcattgtggttttgatttgcattgctctgataattagtgatatggaacattttttcttatatttgttgatcacttatatgacttcttttgtcttttgcccattttttaatgggattatttgggttttgtcagtttaattatgttacttataggttctggatattagaactatattggatgtggagtttgtgaatattttcttccattctgtaggtcatctatttactctattgattgtttcttttgctgtgcagaagaagctctttgttttaattaggccttacttgtcaattgtagtttttgttgcagttgctcttgggactgagccaaaaattgttttccaaggctgatgttcagaatggcatttcctaagattttcttctaggatatgtatagttttaggtcttacacttaaatatttaatctatcttgacttaatttttgtatatggtgaaaggcggggttccagttttattcttctgcatatagtttccagctatcccagtatcttttattcaataggaagtcctttccctattgcttattttttttttttttttttggagatcagtttgctgtgggtgccaggctttatttctgggttgtctatgctgttctattggtctgtatgcctttttttcttttgccagtaccaggctgctctaggtactgaagctttacagtattctttgaaattcggcaatgtgatgcctccagctgtattctttttgctaagggtcactttggatattcaggttcttttttgctttcacatgaatttaggaataatttttctagttctttgaaaaatgaaattggtagtttgataggaatatcattgaatctgtagattgctttaggcagtatggccattttaatgatattgattcttccaatccatgaacatagaatgttttttccatttgtttgtgtcacctattatttcttttagcagtgttttatagtactcgtcgtagagatctttcaccttggatagatatatccctagatatttcttgtggctattgtaaattggattgctttctcaatttgcctctaagcttgagtgtcattgatgtatagaaatgctgctgatttttgtacattgattttgtatcctgaaacattactgaagttgtttatcagttccaggagacttttgttggaatcttcatgtgggtaaactattttcctttattttattcattggtgtaaccccagagcctacctcattccttgtagaaaattggtttggaataaatacttcttgaaccaatgaattattattataaattaacaatgacctttttttacagtctctaaagcttatgacctctctgtaataactctttctattctttctttcacaagtttaatctgttgttgacttcgagttatactcagtgaactacaaacttaaggcagtccttcagaatgtaccttctgaaatcccctgcatgagatcaccagaaaggttttaaaatgcctgctactgagtcctactacatacatgcaaaatcagactttttggtgcttaggcatatgaatctgcaaaaagtactcttaagtgattcttaggcaaataccaatttgagaattttcaccacatggtgactcaataggtcttggaggaattccactcaagtacctctctcctattccttcctgtggactgggtttatttatactcaacacaggcttttagaagaatgaaaggatagtattgagttactacgttacattcagcaaatattgattgaattattaattgtgaatctgaaattaaactcccgtgaaacgttcattgaagttctgcttttaaccaaaatatacttgcaagattagttatcaaagtaatgtttttgtgataatttcagtacaatgaggcatatgcaaaaaattattcatatcactgtcaaactgcacacactctttattgcttcacatgtatgcttaaattcaaagtgcttaggtatatttttactgatggtcgttctttgaatgtgtctagcaacaattaattctggtacaaaagtaagtaatacctgtaaactggagatataactgcatttatgtccctttctatatttctatagttttgattttctttgcataaacttattattactattattttttcttgagacaaagtttcacttcttgttgcccaggttggagtgcaatggcaccatcttggctcactgcaacctctgcctcccaggttcaagcaattctcctgactccgcctcccaagtaacagggattacaagcactgcctccatgcccggctaattttttttgtatttttattagagacggggtttcaccatgttggccaggctgatcttgaactcctgacctcaagtaatccacctgcctcggcctcccaaagtgctgaaattacaggcgtgagccacagtgcctggctcattgcataaacatttatatatgctatggacagtagagaccagaaaacagctttacactactctgactatatcccacggaaggacattacttgaagtacatgtttctgtcatctaacgctggcattgtcactttcagcactattgacatttggggccagataaatctttgttgtaggggatgtacgggactgtcttgcgtatcacaatatgtttagcaatattccagacctctattaactagatgacagtagcgtccctcaagttgtgacaatcaaaaatgtcttcagatactgccaaatatttcctggaagacaaaatcatcaccattgagaacccactgatctaagggatctgaatgggactatgttgtttccttgagttatgttacaagcagtgacatgaacttatgacatcttatactcataaacttggttagttgagcccaaattaattgtgtgtgatgtttcaacaatttggttaaatattaatttactttattttacttattatgaaaaatgagatctgaaacatatcttcacatgtcacaaatttaactggagaggtagttgttatctaatgaacgcattttgcattgttagccaaatcaggtaacgctgtaagaactagagttattcatcatcattataaacattaaagtgatctgaattacactacccacacattatttcatctgattatataataactggcaaaggcagtgcaggcaatgactgtgagccagcagaccctggaaaattggcatactaactgtgtgatcaagttggcctcagtaccagaggtttacagattaatggtaggtacggatttatattgtcatgaggcaggagccatcgttaaatagaatttcagcgcaagttatacaggtcacaagttcctaggttgcagctatcataccaaaattgaagctatgattgtccatataaatacctccaaaggctatgtgcaggatgattatggcagtatattccagcagctgccaaatagtaaactcgagtgtgaaatcactgtatttcaaaatatctttatgaaatgaggcttagcatagaaatgctaagaaagacaaaccatccaaatctttttattttgcaaactgactgattcgtctctgaccataaacaaaattcagactgtgaaattaagtatcacaggaacaaaaacaatattgacaaagcaagaatcattactaatcataggctagtctctttatgcatatgatacaaaaaagatctataaagctacagcttaaaattagagccaaaggattaatcacaaaatattaatccatataatttttgatttgcaacctaactttggctgaaacctttaaaatgctactttcattaaggattaatattgacagaagtttatagctttactgaaaagtgaacgtcagaaagtcaaaatgacataacttaatagtataatcaaacatctatgtagaattttctgtgtgtctggccctgttttagaatacagaacatttgttcaaaacttcttgggataattttctggagttattagcattgactattacaatgaatgttaagagtaggaggaagatttaagtatagatttagaaattaagatacacatttttattctctctccatttaaagatataatttgttttaattttctgaactgaatttcttcgtatgtaaaactgatttttggaagaagtaaagagcatgattcatgtaaagactctactccaaagtctgatgtaccatatacacagactttatctaattgcttcccttccttcatttcagataaaatatacagcctttgtaagccctgctacatttcttttattattattattattattattatactttaagttttagggtacatgtgcacaacgtgcaggttagttacatatgtatacatgtgccatgttgttgtgttgcacccattaactcgtcatttaacattaggtatatctcctaatgctatccctccccctttcccccatcccacaacaggccctggtgtgtgatgttccccttcctgtgtccatgtgttctcatggttcaattcccacctatcagtgagaacatgtggtgtttggttttttgtccttgtgatagtttgctgagaatgatggtttccagcttcatccatgtccctacaaaggacatgaactcatcattttttatggctgcatggtattccatggtgtatatgtgccacattttcttaatccagtctatcattgttggacatttgggttggttccaagtctttgctattgtgaatagtgccgcaataaacatatgtgtgcaagtgtctttatagcagcatgatttataatcctttgggtatatacccagtaatgggatggctgggtcaaatggtatttccagttctagatccctgaggaatcgccacactgactaccacagtagctgaactaattcacagtcccaccaacagtgtaaaagtgttcctatttctccacatcttctccagcacctgttgtttcctgacgttttaatgatcaccattctaactggtgtgagatggtatctcattgtggttttgatttgcatttctctgatggccagtgatgatgagcattttttcatgtgtcttttgggtgcgtaaatgtcttcttttgagaagtgtctgttcatatcctttgcccactttttgatggggttgtttgtttttttcttgtaaatttgttggagttcattgtagattctggatattagccctttgtcagatgactagattgcaaaacttttctccctttctgtaggtggcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggatttttatggttttaggtctaacatttaagtttttaatccatcttgaattaatttttgtataagaaatgtaaggaagggatccagtttcagctttttacatatggctagccagttttcccagcaccatgtattaaatagggaatcctttccccatttcttgtttttgtcaggtttgtcaaagatcagatggttgtagatatgcggcattatttctgagggctcagttctgttccattggtctgtatctctgttttggtaccagtaccatgctgttttggttactatagccttgtagtatagtttgaagtcaggtagcgtgatgcctccagctttgttcttttgacttaggattgacttggcaatgtcggctcttttttggttccatatgaacttgaaagtagtttttttccaattctgcgaagaaagtcatttgtagcttgatggggatggcattgagtctataaattaccttgggcagtatggccattttcatgatattgattcttcctacccatgagcatggaatgttcttccatttgttcgcatcctcttttatttcgttgagcagtggtttgtagttctccttgaagaggtctttcatgtcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgaagccctgctacatttcaatgacctaaaaactgttgtggcaaggccttgatgacaggcataagtgcttagtactatacagacacagattagacatttaatagctgtgaccattgaacaaattaatgtattttggaaacaaagggaaaatatatcaaccagaagtgctcacagatttaactcatgtaataaatacagtagattattgagcacaaactatataccggacatattctaggtttttaaaaagggtatgttatttgaaatccaaatattccaatgtagagatttttatgattctctttttgcaaatgagaaattaagacaaaaacttatctaatatatataatatattgatacctgagatttaaacctcagtggaagaatttatacagtcttctagtatagtgaactttctccctattcaactttttaaataaatacaatttctttagtgttggtaaaataacattgcaagtatattgagtattaactgtagctccataaataataatccacaaatagaggccattctttattcactgtcactacatttagatagtttatagtagacaagacatcctgagaagagttgtttgagcttttttgttatataataaggaaaatattaatttctattctgctttagggaattttggggtgagagcacattgggatcattagttgcttctcagtgaaggcatagacacttcaataggttctcaataggcatcaaatcactattttgcatttttgtgataacataattgaatagacatgttggcattgtcttggtataatatagtaattaggtggtaaagctagaaccagtgatatctcctgtgttccaaaaatcaattaacttacttcagcactgcctgcatgacaagcctattgcacttaacagagatcactttagaacaaggttcttcctttaatgttggaatcatttagtcattacttgacattataaattcattgagtgttgattaatgtctaatgcccaatgtaataccaggaaatacatgaaggatattaaatcttaaaaatgctttggtgtaataaattgttaattcactgataaatttaaaatatcattgggaaagcctcttggtatgtttgacagtagtgtccactctaatgaaatcagctgtagcaatattaaaaatctaaggaaatgcaagatatttgcttttgtattttaaattcatgctgaattttttttccacttaaattctgatgtacttgtttaagatagattttgttccacagggattcacatttttcttgtagttgaaacagtcatctatggaaggcgatgtttccatagatgactgattatacttgttatagtggcaagtactatcatgtggtcagttatctttggttattatcatatcccagatactaaatagtgaacgatatcatttacaagtcacttattctctctggggtccaagttttgtattctgtagaacaattaatttcccttacatctcttaaatgtctaattttctaatgtgcacagtgtggtctgaagaaacagaatttgaggcactaaaatttgttcatatggttattttgagtgttatagatttccccagggtaaaacaattagacttgggaaaagaaactattgatagctactttctaaaattaacattttattaatatcagaaataatgataactttgccgatgccacaatatccatgaatcagatacatctctctagggacagagttatagattgccattcacctttgtgttgttcttcaaagctctgcatattggaaacaaaagtcatctaagcaattcaaagaaaacaggttatttatatgttttattttgctgtctcatcttcctccccatctgaatgatataaatgtttataaataatttactataagagaagagatgtgatctttactctgtctggttaattaagaaaatgatctaacataagataatgcctccaggtatacatgtgtgtggaaagtgtgtgttgagggagacaagataaatacatttaagtaaagttgttttaaatgtctagaagaaatggaggtatcaacaaactagccagtcagttatagaaatagtatcttccatatctttttttttaatgtgtaacccaatactcaatttacctagtaatttatacaataaatgtagatggcaacatttcaagtaaaatatttctagatttaaaaaatgaatttggctttctcacctacgtaagtatctctttggaaattgctgatttctagggctataactataacaattgtcaagcagagagaatcaatgccttctttattttatgtggacgtacaaatatgtagcctaataatccaatatgaaaacacagtaggaatggtaacatttttaaatttttttcatgtatggtagtaacatgtgttttccatacaacgcctaagtggtggttggaaagcttcctttatccatggctatatggagaagcttttgtgtcctgtcgtgaggaaaacagtgagagagataaatatgatagataaaggtttaatatggaattattttagaaaagcaaatcataactttttagatccaagtgactgaaaacttctatatgtaactttgatttacatttctttctctttcaaattgcatctttatcaggaccctcaattctcattttattcaaatagtcttccttgacttctgagacccatcattctcttgattctccctcctgattttctttatctctcttcacttcttacttttgttaccttgcacttattcttccactgataacttcatattgccttttgtttaggggccattcatgaatctctcatcttttcgtatacaccctttttatgcggattagatcattttcccagaccttaactatagcttatttgtcgaggccaggtatccttgagttctgctcctcaactgtcagttacttaatgagttgtttaaacaaacaaacacacaaacaaaaaacacacaaaaaaaccccaaaatcacatctccaaattaattttaaaagcattattccagaaattattttgaataatcatatttcatcaaccagtaacatttatcttatatataactaaattccaaacccaaatggcttaggaaaaaaaaaaaagaaaaaaacatctaatgtctcatataatttagtggcagaaatttacacttcaattaggagtgtataaacatccccctagacctatcatctcacaaacgcttgatattaaaacttttaaattacttttttcatttggtgagcataaaatattaacccattgtggcttaaagtttaattcgctagttactaatcaattaaattgtcctttctcaggattttgattctttatattttttgttctgtgaaaagccagttaaagtttttactgaattgatatttctttatatagtctatgctctaattcattggagacattgtgttgcaaataatttctcctgattacaatgaagttgaatatattttaatattcatcttttctttatggtttgtacattttgtgtcttcttcattaatattcttattatgatgctatagcaagttctcttaaatctcttttttttttttggctttcacatttaagtagagttctgtttatgggttcccttatatatatttcattaattcgtgatatggtttggctgtgtccccactcaaatctcaccttgaattgtaataatccccacgattcaagggcaaggctagctgtagataattgaatcatggcattagtttcccccatactgttctcataacagtggataagtagtgaataagtctcacgagatttgttggttttataaattggagttcccctgcaccagctctttgcctgctgccgtgtaagaatgacttcgccccttattcacctcccaccatgatgtgaggcctcctcagccatatgaaactgtgaatccattaaatctctttccttataaattacccagtctcagatatgtctttattagcagcatgggaacagactaatagcattcatttggccatatttacgtcaacaacgtatagccataatttccatatttttgtaataaatttgtataccttgttcttttttaagagtgtttgactcttaagagtttattttgttgcttgtacttctatgtgcattttaagattaacttgatacatttcacctaagatttttttatttaattttactaactacattggtcaatttgagttagttatttttagataattgactcttcccacccctgaatatgatcattctatttctttatttagattgtatgcactctgatagcattatccctcgttgctgtataatttttattatacatataatgggtatttttatattgttttcacactcgttcctcgtgtgcatatatgcagttgattgtatgtgtttactttgcacccagcaacttttataaaactcattaactataatagtttatctatggatccttccctgttgtctatatgaaaatgtattaacacaaatatacgtttatatatatatatatatatatatatatttggtagaacatatgcataggctctatgcattaatatatacatacacatgctcatcatatattgtgaaacaatgtttaaatagcaacctgttataaatccaaaataatatttataatttggcttttttcatttaaaagattgcagtaacacacagtggcattctaagtttcaaataatggttaccaatggtaatattaaattaatgctatattagatcatacaaagaaagaattatggtggactggggtggttgaacgttacttaatggaggaacttatgttgtagaggagagatgaacaggtatggatggataaagtattctagggaagaagaaacataaagacttagtttaaaaaaattatacttgcactgaataacatgaatattcagtgatgtattgctttcacgaaatagggtgaattctgtgaacttaaatattaagtactgccgaaatacatcatggaaactcagttgagaattatttgttatgagaaaagtagtcattttgtttttctccaatttggaaaattaaatcatgaggaaatagattttgcatcagtaaaatgtatctttacattaattgaagctattgctttggctaattttattttctgctacttacaaaggcagtgataaaagtagtaatatgaactatatttgtcccagattccttattactgaagttgaattgttgataccttgaatgttcctattttagtaattttagtttcatgataacaaaaatatctcagtcagagtatgatttatttcaatatatacatggaagtgtttaaatcaacagattttaataataatgtatgctatcatttaattaacttattgtggtcattgaatattattgacatcataaatttttctcatgttaccccaatattaacaaagagtaaaatgtgcttaataaaaggtgaaccctgaaaataattaaaaagcaggaggttgagttccaatatttctgtagggggaaaattaagcatttattttggccaaagaatctttttcctttgactagtatactattttgaacaagccgatgttttcttaatgaggtttagcaatgttaaattatgtggaaaaactaagatacttatccaacaagaacaaaatagaaaggggtaaggccaatatttgtcaagaaactatttctattatatatatattatacttagcaacatgtatagggtgagtcacctgtgcattacttgaatagaatagaacatcaaacatttgtttggtgaaaactgcagttaatattaatgccagaaaagagttaatgatttggggatgattatttttaaaatatatccagaaaatgaaacagttgatgaatagtaattaagcatatagttatttaactatatgtaacgaatagtatttaacatatagttactattttgggtgaacaacaataaaagttgaaggggataaattattgtgggtatttggaataaatatattttatgacatacaaagtgaagaaagcttttaccaacgtaaattctgtttaaagattttagaatgcctaataatattacactaatataattaataaattaattaaataaatactttagagtcacatatatgagatacaaatctaagattgctatcattttaccatatgaatttaaaaactgcaaatagatattcaggagattaacggaccacaaaaaaatttacatctatttgttagttaatgaaaaataaagagctagtttctaatttgaaagcttcatagtaagtatgaattaaaagaattgtgcattttttacaaaataaaaatatggtcattataattttgtaatatttatttatatattttatatatacacacatacatgcataaacacacacacgcacacacacacacacgcacacgcacacacatgcacacgcacacacacaccccacattgggtgctctttcgtttctccactctgataaagctttatacttgatatagttcagcaacagttctttttaaagataaggaatttaatagtgacaccctgaaattgtgattgtttaaatctataaagaatttgggagcaaaatcaaaaatgatcagtaggctagaaatatttctatcattaaatgacagatagtattttcttgttttacaatttctatgaagaacatttacaattagaaaacatattcaatatattctgagtttttgttacaaatcaaaaatagaaaataaaatgaagtgaaaaactattttatctggtgttttacccattttagaggttgaggacacattttctatagctttgatttgtttattatatatctggacatctagaccctttatagtgtatacaaatgtcaagcatttagatttttataaatagagactttctctggtcttactgtacaatttcttagagaaatgagtgttcctttgaattgaaagagccctgcagctgtgtttgatagaactgccaaaagccatctataaaactattaagagtgaagaactattacagttgaattcagcattttatatatatgttttgtttgaccacaaatagcaactggattgtaaagccttttagttatttataatgcatttatttcataaggcttggtggtgatattaataaaggatattatcaaaatagaatgctagataaaatactataaatatatagatatatttattaccaatggaaaatgattacataatttatcaaaaatatatttatgccaaagttttcctgtaagcaagggactcttttcagtggcttctattaaacttagggtacagcatataaaataaaattacaagaactacatagataatataaacagaacaaattaatgaaactgaattcacaaactatacaaaaaattattacgcaataccttctatgtgtttctgtggttttataacatctaccctacaatcacacatgaactctccttcaaaatgtttagaacatattaaaaaaaggacaagtaaatgtttgcacatattccaagatagatgcacaccttaaaaataaggtaatgacattatgatggtgctaaggaggatactaataaaaataatactgattaagctctttgcccaaatcattcagatgccaaatgacagagccagattcagattcgggtctgcatttttctcagggtctgttacatgtgttagagaaggtgcacatggttcagaagaaaggtaagaacagaacaaaatctgggagaattcaacaaatttatttccattctctattagatttaggaataaaaactctattgtttgcagagcatcttcacaaatatttactctggaaaaggtgccatgtgaataaaaccaggaaggaagggtaggtcaaattccatttcacatgtgaggaagtgaactgtcacaagctaagagcattgctcaacgttgcacaacctcactgtagactggtggagatgaagacatgtctacaaactgtttttattgctctttttactagtttgtcaaactatccatctttactagtttgtcaaactatccatacctatcttaaaaggagctataatttcatgatgagaacacttcatagtgattgttgcagccaatttaaagaacattgtggatattcattgatttttttaatgaaaaaaaggtgtaattttttattcatttatttttaatattgaaatggttacgctttggattctatcttagcaagttcagatttcaggaaagtagttgaataaatatactcatttctgaagccaaggcaagtttcatgaagactgtcttctaatgtgtatgtcttcatattatagtatacatacacaagcatcctgtaaagcatagctttaagagaaatgtaagaaagtggagaatttgggaaaaatataaacaaaagtatgagaggatcacaatcatacttttctgtattgttctaatgtttacaaagtaattatcaagtatgtcacctaattttttatcattaagcctctgaaagaagtatcattcctattttacgcttaagagacaagaggttgactcaccaaaggtcccacagggatagaagggaaatttagtgagatgaaattccttgttcttcatgctatatcacaatgcctttctccccctgaacacctaaaactgaaattctcgcggagttttgaaaccacatccatgtgaatgcaatctcaaatgtcccgtgtttatgagacttctcaaacaaaagagtgtattctttttttaactcctatttttggtttgggggtacatgtgcaggtttgttatataggtaaactcatatcacgggggtttgttgtacagattatttcatcacccaaatattaagcctagtacccattagttatttttcctgatcctcaccctcctcccaccttcaagtgggccccagtgtttgctgctcccttctctgtgaccatgtgttctcatcatttagctcccacttaaaagtgagaacatgctatatttggttttctgtccctgcacaaacaaaacaatatattcttaagagtttattattggacctagtcttacttattgtacctatgataacatatcataaatcacttatttattttttgatttacacgtgtcttttttacatactccatttacacaagttaaaaaattacaaaataaaaaatcattccctctccaagtatgcagagataataattaaaattcagcttcagagattttaaccacatgtaataaactcattcattataatggtaataatatttcaaatatgtcaaattatacgttgtatctaggttttttcttatttatgcatttttgctagttggggttacaaaaataaaaaagaaaattattaggggttgaatgtaaatttcactgtctatttagtcagtaggtaaaaagttgtgattaggaaaataggacagacactaagatataaaattattttataattacaaaaaacattctgtcaagcgtatttcagattttaaaattactcatatccaaaaggatactgatttgtgtttttttattaaagtttctatctttaggaattaaaaatttatagctagagagtaataggccaataagaaaaatttaaggcaaagtatagtattattttcgagttatgatataacactttgtttttaaagataagttaatgtaatatataatatgaatgaataacatacacacataatacatgcaaatagtattgtatatatgtatgcataaggtatcatgtttgccagtgcatttgctatgcacaaattatgtatccatttattttctgaatttaaacaaatacgatcacatattcttgctttttttgtatactccccctcttttccatgtaaataatctagtatttttcctctgcgcccttacttctaaaatcctatacccatatatgttagtatgtttacacataagtattaatattaatatattcacatgccatgttttgtaatgtcaccatttttttgcttaaaaagtgagatcatactaaatacaatttacttgtgtcttcattactcaatgacatttatctgcagtggtgagcaagtatagctccaattcactcctttaaattgttatatgctaatatatggcaaagaaaactcacaggtttttcaactgataggcatggtctttgttttgacatgttttcttcctgaactacagtaattttatttggatgggatatattctgaggacaagaactgttgagtcttggtttaaaggaatgtgtgtgtgtgttagtgtgtgttttatgtgcctgtggaaattgaaaggaggtttacaaaattgcttttgaaaataatttcacatttctaggagtattgaataagagtaccttttgctctgcacttctgaaaacagtccatgttataattttgtttatttcttccagactcatgtggtataaaaacaatatctcgttatttgaaattttattttctaggctaatagaaaaatttagcaccatttcatatattttggtcactctgtaaactgtctattcataaccttttatcattttttcacttttttaattttccttgtcaatttgtaagtcctttctgtattatataaatattaatcttcatctgttacctgaagcgaaaatattgtccctatatattgttttcttatagaattcattgttcataatttttatcatgcaaaagttttaaatctgtatgtagtctaatgtggctatctttttgtaacatctgggattcctattattgcaaacatagattcatatttcttaactctattaatttattgtttacatgtaagcatttcattcatttggggatgtatgtaaactgccttaaatatatatattttaagattttgtattttaattcttctgtgtaattgttttttgatgctcaatcaaatgtggatagtgctctttacacatgtacaatgcctccctcattaaagatttagaactttctttaagaaaaaatggaattttaaaaatatttttgttcacaggtgcctactgctaaaatatagaaagggtaaagtcaatattatgataatttttaaacacaaaatatctcttggaagtttacaatcatcaaaaggagattcttttatctcttcctttaaatgtcactaaatataactatactttgtttcaaaatttggtccaaatcattatttctgaaaacaagaaaactacacacaactaaaaattagcatcaaaattcttacttcatattcacaatcctcttgtttttagagaggcagtgtgtagaaaaaatatggtattattggatggttatcaaggttttattcacatattcccaattactagctatgtgtccttgactaatttaagccaatttgattgtctgtaaaatgaagataaagctgatctcatggtattatgttagtatcagtgggacttgtgagggcacttaggaatcctacaaatgctatgtatgtataacatcactgatgggaaattccaaactcttcggaagcaagatgtgggcatttgtttactcttagttgaatggtattgcatagctacttggagctacttgtgatgaatcagtatttatagataaacttaaagagattatagaatgatcccctttttcaattgtcaaaacttctatttatctaaaaatctaccatgccattatattcaaccagtaaaaaaaatgcagtcctaaaatacatgcatattataaaagatctgtaatatttaatagctaaccagtaatgtaaaactaatgaacacatacaatgtcacataccataagtcccatgaatattggttaaaataataagtaataagaaaattgaatcgtagagttaattgtgacatgtaattgagattttaaaattaaaatgtgtaattcttcttagacaatatcttcataagggcaacaaaatagaaatacctactcaatagcccctgtttattgggtttaatgtagtaaaacattgattgtttaaaatgtttgcttttgaagctattgtatctcctatatacataagagcaggtttattctgaatgtgttttgtttatctatatttaactgaaaactgtcagtaacctccaaaataacacaatagaaaataaaacaatttaacactattatctttgggctaaaataaatgctaatgccaaaatgctgaatccatttcatgtaaacaggggcgttgacacttgaagtgatattcccttggggttgagcagtgaggctcagatgcatacacatttgtcagttttgtggtgtaattttcataactaacatcatcataattaccctctttgaagataggtaaggtgataggtgtatttgaatttgatatcattctcttatacatctagagtgacttacacaaagcatgtacttttattacgacacatttgtggcataactttcagtacaatctgattgacatggggtctaaatccctgtaaattctcatactgtagagccttcctaagccaaatcatgagaaagcaaagctgatgttcagcacccctcgggcattccatctaccaaaggagtctctaaggatattccttagcctaaaatctcctaattgagcttctgaaattaaggtttatttctaatgtgaaccatatgcttaaaccatactggtgatcatgtagtccctgagattcatgacatttcctcctctcaatatttcctttaagcagggattaaactgtgacatttgaaagccatggcctttggagatagagtactgagatatgactttcacctctaacagtttttaactctgtggccctaggaaagaggcttaagctgcaagcctattttccctttttaaaaacagaccttactcagagagaattcatgatgaatgaataaaacaatctatttgacacccttaaaacagtacttgaaattaactttggaaatactttgtttttattattttgataatggaatttcatgatgataattattatgatagtaatcataatgatagctactattattgattgagcatcttctacgggaacttcttcccattatttattctctaagtttcacttattaatcaggaggacagcttttattttgtctactctataatacctctttcaaaatgttggcataattaacctccttgtcttctgagccaaaaaacatgtattgcttatcatagacttctttgtttctttttttttttctctctcttttttttgcttcattatattttacatacacatatggatgaataccaagtgaagtttatttatattaatgtttaaaattatgttatgtaaaaacttgttttattctgctttgtttttaagggcccctcttaattaaaaacgttaaattgaattcttttatttaaaatatttatgcatttcttcatatttatgagttagataaaggtaatggtaatggcttacaatttattctttctcctgcaacacctagcacagagctactttactgttgattcttaagaacacttcttaaggtgaaagataataagaaaggatgaaggctggatgggtttgaatattataactctcttttctttccctatgtcaaaatgaattttattggatgccatgctttccattacatagaatacatcagccatatgatccctaagtgtaaagaattaagtcagcaaaaagtcctattgtcttaagaagtcctctgaaaaccaataatttggttttctgaaatttgggaggtaattttgagcacaggcagatatatcagatggtttttatgtgtcttctacgctccttttcatgtaaggtgtttcctgtgtgatgccaacagtaatcagcacaattgctgacactaccctgatcttagttccttacttttatcccggagaaaaaactatccttttgaaaagttccattatgttcagtgatcaatgattgtgcatgtcaattgagctttatcgtcttcaaatcttatgaatatcaaaaacaaagttttaagaatctgacactaatatgcctaaaattgtacaaaagtctattacatgtgaaaaacctcaatatcttatgaaaaattggttttatttaatgatttttcaaggaaatttattctgattatgagacacatacattatagtatgaacatctaagaaaatttgtataaagataaagttggttcaaaattcttgctttgggggaaaaagggagaaaggaaaaattattttatttgatttttatttcttgaggcaggttcttgccctgtcacccagatgggagggcagtggtgtgatcatggctcactgcagccttgacctctggggttcaagtggttctcccacttcagccccacaagtagctgggacaacacaacaggtgtgtgccaccatgcccagctattaatttttttttttgtagagacaggttcttaccatattaccctgattaaagattatttcattttacttatcttctgaaaagtcaaattagctaaatactactctagttgttacccgaagcaaaatcctgtgcatatttgaggttaatagtctcttaactcagttaatcaataagtatttatcatttactttatatgctgtttacagttctggctgtatttttctggtacatttacatagacccttgcgattgagaatgcaggcattataaagaaaaaatatcagttacacacttcaataaaaatacagatattctataattttcagttacaaaatagcataactcatgctcacaggatacctatttctacaactatgaacaatgaagagcaatgattattttaaattttatacaagaagatattatttaatattatttaataatattatttaattattcttgattgtacctttcttagaatttataggctaaattacttacacaaaatttgtttggatattgttaccccttttttgcacttaattataattttattttgttgaaattaattaaatgtaattttaggataaaaacatctatcatatataaacctacaaacatagattttatgggaggcattgagttaaagtcttaccatcctcggattgtgagatgctatatttggggatctataatatgaattcactgggtacctggagcaggggaaatgctacatataaaagcagaggtaaaggaagacacacttggcttactccacagtgatgcaacatgaagatgatagattttattcaatcatgcaacatagtttgagaaaaccttcctttagaatttgttcaatcgtttggaattttcaagcaatgtatgcctaaagttagatctgttaaaaatcctctctcatcattaattttacaaagttcataaacttgatcataaactaagaagttatttttgtgtgtattagtataagatattgtccaagaacaatttctgcagtaaactaaaatttaccatttttccaagaaaatgcatattaatttatcttcatttttttatgttaaacttcaacatgacaggataggtaatattgctacttgaaaagtttgttatcagctaattttatgtttttataattctttgaatgtactgaagatccttagatacttttattgcaaagattgttaatgttagctacaaaaaacaagcacaatctccctgttaaatgtatttaagagtttaagtgaattaaagtaaacaattaaaacttaggtgtgctccatgtattattagaatgatacactaactttgctctttccaaaagaattaaaaaaaaatagtaacttgaaaaggacctagaagagtaaggcatatagagaaaaatttggaatgagaataatattgcagaaaaaatgtttttttcttcatgtagcactataaaaacaggaaatagtcacacatattgtagaattgtgtgcaaatacttttactgaatcatttattttaataggtatttagtaagaaagagtatagatttatcattgttatcattgcttttgccactggcaaaagggtgataatattgcaagttagtttggaactgtggccctattatttggtgctctaattaattggtttagtgcataatgaagctgaaagacaataaaacagggaaagacaacatatttgaaaattggcatgattgaagctctaggcaaaatgattagaggtgttgtagcttgcataacaaaggtagaaatatttgatgtcttgctgagggttttccctttctaatgttgaaaataaattgctgcttgatttttaagttgtaattttcagtaatttatgtgaaattcttatccagccccttcccacccaactcatatttatatttatatattttatcttagaaaacaaatcatccattacaacagtattacttattgcttactgctccccaccgatcaccataatccattttactatttattgaatgaaataggctttaaaataataaaatctcattcactcggtaagtagctgtgtctattatatactatattaagctctaagtttggcataaggtatagaatgataaatagaaggttaacattgaattactgaatttgaatttcaatgatagaaacagatacataaacagattgtgacaatatagcataatttattctatgatacaaatgtacaagatataggaagaacagaggataagtgattaagtttgtcagaggaagatggaagcaggggaagtataaaaataagttcagaaaggaaatggtgtttgatctgtttctggataaatcaataatatagcccactgtattcatgaattcaattgaccaacaattgacgatatttgaacaaaataaataaataaataagtacataatatcaatacaacattttaaaaatgcattataacatctgtttacttagcatatacattgtattagatattatcactaatctagagatgatttcaagtatagaggacaggccagttacagtggcttacacaggtaatcccagtgctttggaaagcataggtgggaggatcgcttgaggccaagaattcaagaccaacctagaaaacttggtgggactccatctctacaaaagattttttaaaagttatccaggcatggtggcatgcgcctgtatttctagctactttggaggctgaggctggaggattgcttgatcctaggagtttgaggctgtagtgagtaatcattgcaccacggcacttcagcctgggcaacagagcaagatcttgtcttaaaaaataataataaatgaataaagcatatgggaggaagcacattaaactatgaaaacattttgccaacatagcataatgtattactgtgacgtatattgcataatggttataagcaaagcctatgccattttttataagggacttgagcatctgcaaattttagtatggggggaggtgccctgaacaaataatgaggaacaagtgtactttgccagaaaggatgatgggagaagccattttcagcagagacagataagtatgcgcaacctcaaataacaaaaataagagctgcagtgtttttatggaattgcagttagtccaagtgctctggcatcttggactatggacagaaggaagatttaaaagttttgaatttaatcctaaggaaaattgaactgcattctgtaagtactggagaataagagaaggctttaaaaaaaaaggttgggagtatggataagacgtgaattctaaaacttcttaaatggtaataacatggagaagaatgaagatgaatgacactgataccacgaagccagctagacaaggatagaaataatactctgaagacttgactgagaccttaataagtcattgtctattgacaatagaattcccaatgctagggttgttcatagaaaatgcaaacttccaactagttctaacaatgaaataaccacgtgagtttgttagtttttttaagatgacaaaggtaaatggtggaaatattcttagaaatatggaaaatggaatgatgaagaaaatatctttttttcagttggtgtctttaatgtaaatttcaatctttctaacgcttatatttttggtatctatgttacagtctatgtgcaattcaaaaatgtaacacttatctttttctctcattatgaaagtgagagaaagaaatttaattaaaccccttcgttcatgtgatagtaggagccttgttagtttaattgatacttggtcaaggcaatattgatttgataaaagcaaatctatttctaaccccaacaattaaaacatttaaattggctccatcttctttttgatgaaagggcatacaaccattataagcttcccataaaatcaatgaaaaacattaataagtgaataagcatccatttcattgaattccatttgcttcatattctaatgcactaacacattgcagtgtatggattcatctgtgagttccagatattcatggtatccttgtatttctcttctatcacttatgccaaacttagagatctctcttattccctccttgtgctctctctctctttctctatcaagtaaacacacacacacacgcacacacacacacacacacacacacacacacacacacattatacaaaggatcaagtcttgtttgggtgcaagttgaaccaagagcatggtgtccacatgacagaggtatttcttatttagttaaggtatgtggcagtcctcattttaaatcatcactctgctgtttgctagctatttggttttaggcaagttacttaatctttctgagctccattatctcaaccaagagctattttgagattaaaaaatataaaacatataatgtgtttaagacagttcaataaacccagaataaaaagtagctattaaagaaaggtgcctagaagccaatggcttggactggaaagtagaaccaatgagttggagaatttataaaaacaaagccagaaacaagcatatcaacactggccaaaatgatttaaccatttccaaaggttaaattcagtttaatgagattatttttaataaaattgaaaattatgagtaaattagtaaagtaataattataatattagatcatatataaaataaaatataatggaaaattataaaagcattattgaaaaaatactgcaaaaaggtcattattagtccctacattgtttatcatgaaaacaaggaccctgaaaggtgtttattcattgcgttttaggtaaagaagtgagaagtcatagtatctttaatgtgcaagccaaaatgtctggtatggtagtatacataatcagtgaggaataattggatcaacacacatcacatcaaatatatttttgaacaaatatgtgctcaaatgtgtttatttgtccttacaaaaaatatggatatgaaataaaggcttagagtgtagttacataattccttttagagcattcgtctaatgattgtctaattccttttaaaggatgtgtttagaaaggccatggtatttagatgtacctacatttaacccaggtagaatttaaagagaaagccctgctgtgaaaggatagtaatctccaatgaccctaaaatcagagtagagtcttcttccgcaaaatcaatctcttgatgtaagcatttgacctgttttatgctgaagagctggatcacagcaattacaggcttgtatttcctggcagagagacaagcaaggatagatttcctctgttttatgtttgtgttaatttaacctgtcaaagttaatcatcctgtcgaagtgccaaagcaccatgatgttgggtgtggtagagctgcctggtgccttagtcttatttccatctctgctagagactcgttaagtgccctttgttaaatccttttctgtctctcattttctttgtttttaaaatagaaggattaattattatctcctgtgttatatttatgttacattttattactttaggtaatagtttaatgatatatacatgacatatttttatttgttccctgatttttttttttaaatcgtgggggagataaacaaactaataatataaagattgtttaaaaaataatgtactcaaaagagctgacctgtttgtttgttgcttggcatttaacactgaactgcatatagaacataccagtttttattctaaacaggtacgtgattgtaaacaagaaatgatcttgtactatgcgtgtggcaaggcaagtattttttaaacctgttttgtccttactcagagtcaatgtaaggtcttccttcatgtccagagatatcttatattaacaaaagtgttgaccaaacttccactggacacattttttcaatctaggagtctacacaacttgaaatataaatgtactataagataattgaaaatatttcagataagtcatctataatattataaacttacttctagggtaggattattttcataagcattgtgtctcttagaggaaaacaatcccacaagaattagatataaattgcagaatttgattttcataagtgactgttttatattataattgatactatgttattcaatttggtagttgttatgcttttcttctgaaatagcaaacactctacttgggaaaaaatgcagaagaaaaacgtagacttggtaaacatttacatgctatggactagccttacataaaacttgttaggattggtgtgtgtgcccttcttaatctctttatttacttaccagtcgtgtacgtttgtatcctgtgctcattttaaccctactccaccaagcccttaaaaacactgttccatatttttgtgttttatttcatttttaactgacacatagtaattgtacatagttatgagataaaatgttatgctttgaaatgtgtttattgagtaatacatgtattaagtaattttcaaaaccacaatagagtggatatttaaaatagtttttcattagggtatgcattttttatttttccaaattaatctacaccatcttcagtccttctaaataagcaaaacatccctgtcgttatgctataattctaaaaattcatgaataataatttttccagcaccttcttaaccttcttacctctcatcagtggagacctaaccccaaaaccttcgggaacagtatttttggtctataacactactcctttcttccatcagaattgggaatataactttgaatatattatgaatgagtcttttttctcgaatgtttcctaaaatagtctacatatgacctctaccagctctactaaggttcatcttcatttttggagcacaaaatgtttttctattaataaaattttgtgagttaaagtgaaattaataataggcatttagaacagaaactctctgccagccttcctaatattataccgacatgctgtcattcatgtatttgagaagaaataatactaattccaaatccactttgaaacatggtgccaatacagccatggtggctctgttctgtcctacataataattacatctgtgaaacagggactctgcatagaatgcatgtttgtattcaacgtaatggcatgatttggtaaaagtttcctgtgtgttatttagatgaaaatcagggttgttaccaacatactctcctagactaaaagctccatgaagcaaaagaatcatgtctgtcttcatacattacaccttcagagtgtagagctgtgtttggaacatgataaatatttgctagataaatgaatgaatgagtgtacaaactggcataatttacctagttttatagtctccatttgttgtgtaacaaaaataatcttatgttgatataaaattaatttgcacctcaggacataaaaaagttaatttaatcagacttatgaattctgaagtgggagcaattaagtgtgatgtgtaacattaatggaaaatgcatttttttatttaactacttcttttgatgaaaaacacgcacggtaattaaaatagtatattttaatgcatattttattaatgctcatcctggaaactgttagttctacttttcagttgttgtaaaacatctgaaactattttatttatgggatggggaaatacactttgacaaaatttattcatttttagaataaaattatcagtgcaatttagactcaaatcataataacacttgtattatttattgctacataacaaattactccaaaattcatagcctaaagcatcatatatttaccatctcacattttctgtgggttaagagtctgtgaaggactaagtagggtatttctggcaagaggttttccatgcggatgtgatccaggtgttggctggggctgtagtgatccaaaggcttaactagagctgcagaattcacttccaagagaactcacaaaactgtcagcaggtgggctcaggtccttactgactattgataaaagcccttagtcgcttgccacatggatgtttctttagcctagcttgagtgtcctcagtgcttagtagctgccttgcccagactgactgatccaagaaaaaagatagaagcctcaatgtgttttacgacctaccttcggaagtcacactcaagcattttcacgatgttcagcctgttagaagttactaagaaatgcaccacaatcaaatgtaggggaattagtctccactggtaggtgttatattttaaaactatcacaaaatgtattactatctttcagtcaaccctacaaggtttatacataaaaacttattcaattcttactgcaactttatgatataagggttttaattagtcgatttgttcacaagaaaactgagcacagagcacctaagtatctttcccaatgtcacaaaactaactggctgcgtcacattttgtgctcaagcaggttggtccaagaatgtatgcttttaaatattgtcttgtgctgtacctgtacttgtgtttttatattcaatggagatctatttgagtaagcagtcttttttttttttaactgcaaatcataattcactgatgggtcaacatagagttttgctgttaagagcttatagaaagataacaaatgcaaactttttaatctaagaaaaaatagtatttttacaaaattattttagccacagggtcttgctgtgttactcatgccagcctcaaactcctcgaacaatcctcccatcatagtcccctgagtgactgagactacaagtgcacaccaccatgcccagcaaaaataattatttttacttaattatattttacctaaattaagtataattttaattattttcttttctcacatttagatatatcctgttacataacatgggaactatggtgaaatgcacacaatttaaaaattaatctgtaccatgatacttacattaaacaaagtgttaattgtattcaaataaaacacaaacatacaccattccagtgtgaccacaggaagaaacagttcttttggtttccacatacacatttagttttcaatgtattaaaattcaaattaatattagcagaagcataaatataaactagtttatctataccagtccctatattgactttaaaaaacttataacatttaaagaaaatactccttataaaattttgtattcaaatcgaattaagaactttacattgagagagtgaagtataagttacatttctaacagagacactgaaagcctgtctaaacaatttttaatttatacaatacaaataacaatgattgtgtcatggggatgtccttggctttacagcttagagtgtcacggaaagaaaaatgagtaaggaaaaccactaattagatacgtaaatcctagagttatgaggcgagcggtctaaatgggaaaaagccaaaaacagaagggacatatgcaccaattcttgtttggagctcgggaagcctatattgcccatgtgattttactctctaatctcattcatgtacattaacgtcaacagaaaagaggaaacaaacttaattttatttaacatcttctagactattctcaacacaaaatgtcagttcacttaaacaaaatgttaaatgtcgttcaatactaggtccgcttctctagtgtatcccaacgggaggagtcagctttatttgtacagaaccatttttcttaggaaatgaaaagtactgatttatccttcttcctggtgtttgtctctctcttgcttctactttagtgaaagccgatcggaatgagaaaagaaattttgccctttcctagctaagatgtcacacgttcatgctgtaaaaatatattgttcccaaatctctgtatctcggctggtttgaaaatatattttgataccttttttcttgaagaaatttgggataattgagaaatttctgatttgttttgtatattatgtcattcgttgtaatttatggacatgattgaatttaataactaacataaagatcttaataaaaattagattccataaaaatctgattatacttatgattttttttttgaatagtcaaatcatcttcaaagcctacaagatataaaaatattttctgttttttatcagttttgtcattgactactaaaaaaatacattgcttcttaggaacttttagggaagaaaaagatattacctttcagaactgatcctctacacctgtgttgaccactagccacaagtagcctttcacatttacatttaaactaattaaaattaaataaaattagagatgtagtttcttagtaacactaaccatacttcaagtgctcagtagccacacgtagctagtggctaacatattagactgtgcagatatgtcaaacatttccatcatcacagaatgttccattttgcagtgctatttcatcaatttatacctggggcttaatagtttaggagcagtaagcttattatatttgctttgtgctattactttctcttgtttaagatccctaatttgaatctatgatatcgtggtgacagaagctaatctcaaacaggctaaatttttttgacttgtctgaaatatgtgttaacattctaaaatatttaattactctttttgtttttaacagagcattgtaccagtgttcagagatactaaaaatctggcttgctttaaaattttttgagaagctgttttttaagtacaacaaacctcaggctgatatcattcagtacattgtaaatgtgtacaatatagtgtttgatatataattagtatcttttgtattaattcaaatgttatggaaatataattaactgtgatttactttttatgctttcataacagtgaggtagcaatcctcatcttgagattagtatatcaataaaaactactatatatatatgaatacctctactatatatatatatgaatgcttcttatagtttgtgtgtgtttgtgtgttctaattccagctctgacacttcgtagctttgagacctaaaaaaagttaatctttctaaacctcattttccacattagtaaatggagaaaatactgcctcccagatgctgtaagaaaatgtctttcaaaaactgattacaatgctgccagtgctcagtaaatgctgtgtatagtaattaatattattaattaccagtagttgtagtatcacaataacttaaaaataaattacaacacatcaaaatagtattgatagtttataatttgaaagtacaaaataatgcaagtatccagggttttatatatttctgtatttaagacataacttggacatgaatatatatctataaatgtgtgtatatgccatagttaattataaaatatttacttatatataatgaataaaaaagtttttaagacccctagcctcatgaaatgctgcctcctctattgacttcattgacaagccaagttcattgatatataaaaaaaaactcaatcaacaaacacatcttttttcatcttagtgcttgctatcctttttgtccttgtctcctttctttaaatatatttccactccctaaagtagtcttttctgtgtggttaaaacacagaaaaatgtaagtaaaattatgattttgcttaccttttatactataattaaattatatatgttcatattttatctttctacctatgcagtgcttagaataatgctctgctgataaaacatgcctaataaatgctttttgaatggataaacctaccaatgaagtgattatacttgttaggtctttctccaacaaaacatctcaaaactcattaacttaaaataataaccatttattattgttaatgacttcacaggtcagcgggattcctcatgaatctgtgagcagttttgtgagtagggtgtatatatttgctcgtcttggcagagctctctcacatgacttgggctttgactggggaaactaagtgtattcaactgtgaccatatagtctgtcatcactcagcaggttagaatgtggttggatttatggcaaatgagcaaggaactaagatataaagtgcaagtgtgcaaagccccttgaggtttagtctcagactggcatgatatcatgctgcattacatttgaccaaaaaagttacaaggcctatccttttgatgggagatgctgcaaaaccacattgaaagaacatggatacagaaagagaaataattgaagccatatttgaacaaaaaaaaaatctaccacaggcagatcttctctatactcttctctgccccactcttttcctagaaagcccaacttataaattccagtgagggaatcctttgatcccctggggagttacaaaaaaactgctctcacaagttcttcaatattcccctgatttaacttttctcaattatctcattgggtgtgctgtctctttgattctgaaactctgagtgatacaggtataagatggatcttgcttcaaagttaaaacatttgtcgcattcagttgaaatgtctttactttagaaattaacattttgtcaaaaagcaaaacatgcccagatttttaaatatttattttgattccccaagtcatgaacgcagaaaaacaggtaacaaaacatatttatgttctgaaataataaaacatttaataattaaataatcaatgaatacttaaaactacacctcactaatttgaatttcgaatagcatctgtatctttcctgtaattttttaaaatttaatttattgagttcagatcccagcttcactcttgctttgtgatcactgggcaaactacttttctcatctataaagtggaaataataaaacaatttaccttataaagttatgagaaatatattaaatataaattgttaagaagaatgtcttagaaattttaactgcttaataaataatatctattagtgtaccaatagaaacaggaattgtagtagtggtaaaaaaagtaccttctgaaaatttttatttgagtgtatttttttatacaaactatatatatgtatacaaatatatacacacttttcacaaatattatttaagggctactatttctatcaagttttatgtcataatttagtcattctatcactgtgaaatattttaagtatttctaattttctcctataaagaagtagttctaaaatcaagatatttgcacataatacttttataattaggattattgcaaaagaagagtcaaaaggctgcaattattaggatatgtgatataaactttaaaaaacaactctactcatttatttctattacttccatttgcctgtttaaaccgttattactaaagtaagaagggcctcattttctaaagcaacatacatatcattttgaaaatctttgctaatcatatacatagaagaatatgctttgtgttgtgctaggtgctgagggagttgatttgaattagaagcaatacaggtacccaggagaagtttcattttttaaaattttaagccagacattcttccatatatttattaaccagttggtttttctctagtctgtcatcactgtttacatcattagcctctttatgtactgctccccagcagttgaatactaataatctagcttcatatcatttctcagtttgatgtctttatatagtcatttcctagacttccatgtgactctacccttggcaactcatgcactcacaccattgagactcactgaacctgaaatggcccttttagaagccttgctctctttgtcattaccagactgctatgtaaagaccagtgacagcttgttgttttatttcttgaattgtgctgacaacattgtttttttctgggacattgtgtttgtagttcatggcaagaagagacgtgtttctttttttatcctctcatttcaaatatgtaccatttttgctatttgcagtactgaactatatttataactcctctagtcaaagaggaaatcctgttgtataactcaaagaaagtttggcttctttgatttgtattttaaatataggttcctgaaaaacaacatgtattatagtgacttagtgtattttaaaaaatggagccattttaagaactacgatagataaaaagcgaaaagttgactagtgtcttctacagaagtatttgtaaaaccaagacagggtttacaaaattccctggatcacgacacaacaatgcagaactgggtaaatctaacattgatttacaaagagaggaagttctgattattgaggtcaatttttcatagacaggtatagactggagcacgggtttcaaatacaaaataattcacgtaagttgtttttacacaaagaaagcaaagcctgtttccgactcaggaatctagttgacttcattattaacaaactgatattcaggagccttttttcctcacacagtgtcagtgtttcctttagcaaaacgagaatctgttgtaacatggaaatgcttggaaggtctggggtgtacttgaatataatatttattatgtgcttactatgtgctaacagtgggctaggctttcacttgctgtattttattcacaagaaccctgtgaataactggtaagtttaacagatgtagtcatgaggatggagatgagtaaatatcactctaaaatcattgaatataaaattcaagtttgtcctttttcagaattcaagttttttctcactgaagcacatttcctaaaaaataagataatttagaaaaatttaatagattttcataaaaaaccatttcaaaattttttgtacttgagattaagtttggtataaaataatagagatgctgattatgatgatgatagtgattatgaggatgatgataaggagctaaaatattgaatgcctgatctttcataggcactttaatatatgctttatgtatgtttattttggaagagtcatatcacaaaagcattgctatccgcactttaccaagctgaggcaacaagagcttatatacctcatccaaggtcatctaactagtaaatatctcagatgaaattaagaagtaggacatcttcactcatgaccattaattagtataattttatgtagtaatctgtattaaatatacattattcaaatgtatctgaaaagcacatcccacagcacaaagcactttcactagttctacaacattcttggtagtagatcaatgagtcctgtcaatatagtggaccgttccattgtgacctggattccattcctaaacttgcctcagacctttcaaagaaaaatcagggccttaggtataatgtcaagtgaaaatattgacatattataatgaagaatccaggggattaaacaccactataaaaacatatactttgcgaagtactctatccttgccactctaacagtcaaccatttggtgttttgttatttcaatatttccactgaatacatttcggttatatttaatctttctgtcaaacctattggactcactgcctcctccttcgtattcttcaactaggtgtttctattgttactgaactctgaagtggaagctacaccaaaatacatatgtgtctcaactagtgaacctcagtttgctggttggctaagacactttcttttcattagaaacttaggttgctagaaatatttcactcttatccaccagagaaaaaacagttgaaacttgctatgctgcactgaattctaagacagactaatcaatctaattccatctaaacctatttaccctgtccaggagatctgctaatgaggaatgccagtaactcctagttcctgacactgctttccaaaagtgagttaatgaaccagtttaaagggacatgcttgacatttgcaaattagtttaactggcttgttggggcagctttgaactgcattggactgatatggttgtcattaaaccattccatcatgtagtatttttatacttcagtaaactttaaaagataccttaataattgaataagtccgtgttatctagtattttttacattgcttgattatgatgctgaagttcagaattttaaaaatgctttttcttcaatctccacgataatattgtgcaattttgtgaggatgccaatcaaaagtaacgcagcttttgcacaaaagtgtgtattatcagtaattacaggtggctcggtgctttcacctgaaagcacagagggtgggtttggtgttttaaatgtctgcgtcatggggaaagagggggagacacaatctgaggtttctaggcaacaaagcataatatatctgttctttacaatcgactcagaaaaagaaaaaaaatcaggatatttttaaaggtaatatagttttctttaattataagagaaatagtttaatttggaaatagggtatatttacaaaggaattgattcatccatttatgaaatgtatttatatacctactttattttaggttctgagctgaacactgacaatataaatacaaaagaaaaaatactatatattttttctcatggggcttaaattgggatgaagaagatgtaccctccaaaacaaaggaataaatggaattttgcaaaatttaacacatatgaaataaatcaaaagcaattgatgaaagctatgagaaataaatgagggctttttctatctaaattagaatggtgttttaatatcatcaaaatcgtttagacaaaggatcacaggtgacatgattttgagcctacctaaggtggaatgccaaaaccaaacctcaaataaagttatgaaactgaaaaaggtacacattcaatgaaaggtttgactagaaaaaaattcaattgccagcaagaaaaacaatatggaaacatatctgtttacctgggttctaggttaaaaaaaaaaatgaacaaaccaaaatctccaccctgaaattttatagctatagacccaatctctgatggctttgaggatctctgttttatacagtatacagtattatttatgctctctggaggaatgtattctcaatccaagccccaaagacttttcatatatatgaaccagtaataagccagttgcaagtacataatctaaagttaataataatcttttgaaagtaccaggacttaatggactattcatgaagtcagcagaaataacatatgaatgaattatgtcaccaagttattaataattattagttaatagttaatagttaattatattgaatatatttacagttatatataacaacatcaaggaatcaaggaaataaaaagagacttgcagattaaaaaaaatcacataaaatttctagtaaatcacaaaaatttaaaaatcagtgcatggattgatcaatagattaacaaccaaggattacaattactaaacctgaagataaatttgaagatattaatcagaataagcatagataacaagaaaatgtcaaagacaggttactgaatagaattaaaagatctgattaaggattcagacaggacaaagagaaagcaaagagaggggaatagaatgatcagagtttttatttaatatgtttgtggctagaaattatccacaaagataaaaggaattttcagattcagaaagcagaaaccccaagccagaataacaaaaagaaatcctcatataaataccatgaaacaaaactgccagatctagagtgaggcaagtgagatattcaagggctcaaaatgtaaaaaggcaatttctgtaacactgatgtaagtgcaaaatcagctaagagtgagtgcttcctcacctatgtccagagcatcttatccatagctcaggtggttctcactcacaggtttctgcctgaccctgcttgtgcaacacctgggaataagtgcatccttaaatatttctccctgggtcctgactgactcacctgctttcatttatgaaactcacggtctttataacttctatgtcatcattagctttattgcatctttaccagtagtttccctcttcttttgctgggttgtttactttatttcaatatataatcatattttattaagatattgaattttcttctgagtacagtttatatgttttgttgactaatatttttattagaactattttgaagtgttttattattaaaatgtttttacttcacttattcataaaatgtttagagtgtttccaggaaatgattaaagattgaaggattttcttgcactggtcatttaaagtaggacgttggagcctctgggcttggatttccagtttataatcagaattttcggaagtagaagcttctacttttatcaagctataagtagtctatctgtgctccaccaaatgttttgtttgtttttttgttttgttttactgtgtatgaaactacacaagaatgattctgagaaaaacaggtccccgttggtattgtctgctctggtgtttataaccggaaaattttattcacgatctgaaaaaaatgtgcataaactcagtacaatttttcctacaataagagagattgtctcgccttaagtgttgaaaacaaacaagaacataaacatccactaagcaagttaatatgtgtataatacaaatatggacaataagctattatgacagagaaaaagaaatagataatagcattgtggggccatgctgagtactacggtaaggttcactcagaagacaagatgatatctgagttgagacgtaaaaattcacaagaacaaccaaaaagggaataacatttttccatgtatgatgagggaaatgtgagctgctaggtatggattgatattccaagtaaaggaaatcttgagcaaaagagtagaggtgagagagcgtgcactggttagagagaagtaaagaaatgaagattatggtaaaattcaaggataatgggaaatgcacattcatattatgtctaacaatttttaaagtgacattcttatctgttgaaagccaacattaaatcctcgaataaatctggggcggtcttttggaaagcaaacacagaaaagttaccactgactgttgtgtggctaatgatttcagctgctagtaaagtaaactctaagtaacagtaacttaaacaggaaagcgttacttttccctcaacaaaggaaacccctacttagattcctgctggtattccttcagctcacagtaatgtcagacctgggagtcagcatctgtggaattatcaggggcctttccccaatggccattagatggctatagtcttgggcatgacatccccaatcaaatggaagaaaggctcatttttttttcctaaaatgtaggagctaaaataaagcctcctacaattcaacagacgtatcatatctcatttgccagaaagatgtcatgtggctaattcaaattcaagatatcctggggaaagagggcaagaagagcatgttggaaatagtccattggtcctttgattagtcaacgtaaaatgtttgccagaaccaccttctctgagttctcatgctgtgaccactacctctgggaagaatgactcttactctctcagtcctttctttaaagtatttacaaatggtttaatcaattattgtatcaatatattacctttgaaaagaaaagaaaggtttacacttctgaaaaattttagctaaaaatttagcactttttcgctaaaaattttagctaaaaatctatggtactcttcgtcagtgttgtttctctctgtctcacacacacatgcacatgtgcacacacacatgcacacacatgtgcttttgttttccccatctacgtatctagtttttgttaagagttgtaggaaaaagatctgaatagttttagaaagaaaacagaaaaaaagagaatcattcagtccacttttattttgtcaagcctaaattaaatgcctcaaggaatatatgacatagtgatacttgatgataaaaattctatttggtgcatagcattgtattacaaagaccagttgtttgctagtttgtaacgagcactgtgctaagcagggaaactattacacacttggaattgctgtaggaaacaaaatgtgatcatataaaaaaaagagtagctttgctttttagaaatgtccaattgccataggagaaaaatgagtgaatttagattcaactgtattggaatgaagggaataggaaaggatattaaactttggaagtgattactaagaaatcttataaaagggttaactgataccattgtctagaatggtttaaagaagcatgcctcatacgagcagtacattaaccttgcaagactgctttggacatatgtattaaaaacatatgcatctgatcttcaaagtaaactttagcgtggtaacaaggttgctgaagtcacataactagtgtaaatcaatgtatctatgtactagcaattgactctatacacattccaagatttaaagtgaattatggttctcttatcaaataatctcctaggctttgtcagtggagtgcttaacaccaggctagtctcatactagaggtgtaattgtttttggaatttattggaaattgagttcctttaaaattctagaacaatagtctctacaaacaaacataatggaatttaaacacacacacgtacacacatgcacacaaatgcacacatgacatgttatgggatatattttaacagttttagagttctgtcttgagaaatgtttattttaaattatatatcaagaaattattcaacactttttctgttatgctaattaaatctatagtaccaggtctgtggctccaacggtgacttgttttcttatttaccttgtaaattttcttatttaccttacctgtgacatattttcttatttaccttgtttaccagtggtctatttaggaccttaggaactcagctttcctttgataattatttcttggaagaactgtttaccccagagatgagtggtgtgtgtgtgtgtgtgtgtgtgtgtgtgtgtgtgtgtgtgtgtgtgtgtgtgtgtgtgtggtgtgtgtatgatattatgactaaggatattggcctagtaagttatagttagttgtttaaatgctagtcttccctaaaagactgagctgatgtcagctcttcataaaacatggataatggctacatttccagctacttttattttactttgaacccatgctgctggatagtagataaataggtggataaagatatagatatcatataggaaagaatgagcatttcttggaattgaagatgaccttctacttgccttgcttttggttaattgtttttcataaattcatcgttaaaaatatatcggacactttttgcttggattgctatatatgaatttctgtttattttatttttaaaattttttataaaatgtaaaatttttgtagttactttggaaaatctagatagtgataataaggaaaatacaaatgtgaatgtgtggtttcccctgtcacccctagccttccaggtaggcacctagtgagttctcagatttctactctggactcagatgtggcagataaatgagtttattttctttaactaacataatttgttattgcacgtctactgtactaagggaaagatctattggaattaaaacctgccaattaatttattttacttcctttagtgttaaaaatctccatttagaagcaattttattgagtaaataatgatactcctagggtttttctttttctgactccactccttccatcagccacgggtatctggatacagcaggaatcctgtgagatttcatgaggagggaacattgattcatatttgaatgtgtgcccttgttttgatgtctactaaagtagggtgctgttttttaaaatggaagattcagtaaagaagtccttgctcattaaacaagatttaaataagcagaggatacaaggaggagaagaacattcaagttaaagaaaaaaaaaaaaagaaatgaagattcctttgtattgtgctctagtagagaactagaatgtaaacaatagcagtagtcagcaaggatgatatgccacagaaggaagctgtcgatacacagaggagttcatagtaatgaaaaatgcatatgaaaagcagagaaaggccaggcacggtggctcatgcctgtaatcccagcactttgggaggccaatgcaggcagatcacctgagttcaggacttcgagaccagcctggccaacatggtgaaatctcgtttctactaaaaatacaaaaattagccaggtgtggtggtgggcacctgtaatccgagctatttgagaggctgagacaggagaatcccttgaacccaggaggcagaggttgtagcgaggtgagattgcgccactgcactccagcctgagcgacagagcaagactccatctggagaaaaaaaaaaaaaaaaaaagcagagaaaattgggtaacagagtcttcatatttttccatttactttcaatattatttctatttctttctgctttctattgttactatctgaaagaagcagatttggcaaaaatcttctgttgttatacaaaaagatgggagaggtacccgctctgtttcagttatcatcccctaaatatgtgttacacacacaactttgtcctgcactcaacctactacttggccctattattcagattgctgttatcccgtttccaactcatctaacatcctgagctgctaaggaagtaaaacctacagaaatagaaatgctgggagtgaggtaaaacctgcttcagcatgattttgaacttgacaaacagctgttcacatcagagttgtcttatattccaagatggataaggagaacgtgaagaacatattagttatggacttagtaggagacttaatgttaaaaatggtatttaaataagtctagttatttaagaaatcatttaaactcattaacacataggccatcaatgatgtctaaatccttaaaattttaggtcagtagatatcaaatataataacaaaagaagcctaatgtttacaaacctttgctacaagaatactttcttgtttcctggagctaaatggaataatccataaaaataaaaattgtttcacagtacatctggatttatagattcaagcaaacaaaataagcctttttagcataaaatacaaaaagaaactttataatgtaagaaaaggtttaaactaaattctctgaagtaaaaatatgttactactcttgaacaatttaaaaatataccacattttaaaaacttgcaaatcctaactaagctatattattttaacagttttctaaaacctgtactaaggttgttatcctctgaatttggaatatgtcaaacataactctttcaacaatacctttaaaattctgaagaaattgtgtatgcattgcctggaaagtgaagttttggggaaacatgataactgcctttcaatatttaaaaggctgtcatgtggaaaagacagcaaggtgacaagtgctctttcattggaaacatttaaagcagaagctatgtaaaaactcagaatactgtaagtagagcacttaggtggttgaacttgttgacattcatatttcatttcattttatcctttcaattaggaaatacattttatttaatgaagctgaaatagtattattatgtgttttcctggacattgaccagaagaggtgaagatgcctccttgagattttaaaagcatgttttaggaagttagaaaaattaatgtagctttatctggaaaaaaatagtgcctttcagattaatttctacttataagactgtctcctattattcaaacatccttctctctcattattcacaaagaccaacagcttacaggcagggaagttaagaaattgccatccttaaagctattgcttatccaaattatactgtcccaataatcttttcctactacaagtggattatatgagaatatagaggatcaaaacattataatatgattcagtttctatgaattactatgaggaatttagtagttgacactcatcatagtgaatagataatattgtcgtgtgtttctctgttatgcatacgattaggagccaatgaaaatgtaactctacaatagtatataaggacattaatactttttcaaaaaaaagtattctaatatgactaactcatgtctctctaacatctaaagtaaaataattataagttagaaggaggaggaaaagaagggggaggatgtggaggaataaaggagaagaggaaagaagataaatgaaaaaagaaggaaaaagaggaataggagtaggaggattgttgttccaattgcgacaatcaaatgctcttctcgtttaattccacattctcaaggacccttatcctcctcttcactttggtatgttcagtgtttttgtcagcactgtgctgcagatgtctatgcttacatggaaaaatgaacaagaaaaaatctgttttctttgtatttttccttgctgacatccatgcataagcaaaaatgtgtataagcaaatgagccaaatgattatgggtaattagcttgtggaatatatgaaagcaaattgtttgctatatataagcagggttttttttttacaagattatattatcattaaagcatatctggagttagccaattaggacactcactgaaatttagccaattagaagtcaactctgtgagcatgtctgcaagaagttttctagaatgttccaatggttctctggttttgaaaatgatgtaattttattgggatgttagtctactgatattaaaagaatgtagtaatttaatctcttgtaaatgatcatctttagattatgctctcatcacagtatttgatatcatcttgagctgtccaatgatgtaattgatcttagtgttattgtgtgtcaatttcaagatacataatttgcttcagtgtcatttatcacactttttaatcaccatggatgatgactacagctttaatgtagttctgtttttgattagtgtaatgtcatttctgagtttcattctctacaaaggaatagaagaattgtgtctctatgcctgtcaagtctcacacttaacatgaaaactaaattcacttcaaaggctctatgaaaacaaatttcattacagcacccttgcttaaataaaatgaactattattttgaaaaattacttataataaatatccttaagtgggtaatttaaaaagctaatacatctgggtcagtgtttcactagtttgtgagtatactcatccttatctataatctctgcagtatagaagcatctttactgggacttgggacttggctgtgtatttggttcctagatcctcacagagctatcataaaagagtagcatgtgaacaatcagatctagatttccttcccagttccactgtttactacagttttttcttaaagatttattttccgattctcaattccttgtctctataatatagataataaacacttagagttagtttttcagagttactatgatgtgataatacataagaaagcacctaacatattgtctggactaataaagattcattatgctattatcttccttcctctgcaactgtaccagatatttctttgtcgttacttatggttcattaatttttgtatctttattttttattgaagccatttaaatagtcacaaaacatattaattaggagggactaggcatagactgtttggctagaaaataagtagtctcttatattttaatattctcaggtcatctcaaatggaagatcacattactgggagatcagagtgtatacattgctattaatagttacctacttaatatcctttctctctcttcactggcaaattttattcacttagatgggcaccaatacactcaactaaaatatgtgatttttcctttcttattgtctctgatgtttgaaatattcttgtcaccttttatgtattcaatctactccaaattatgaccattctactttgatcatcatccctgtagagcttctacctccttttccagagcagcttttaatctttcagacccattttttatctcctgacatatgcttctcaaatgttcaaggacatttctcgacaagtgttgatcattgtaaaatatttatttttatattttacctggctatgaatgatttcatggaactagactttgaaatgaatgtgttttctcatcattaaatttggtaacacttagcaagactatgaatgggatagctctttttctacagtcatcttggcttaacatctaatgtgtttgcatatgcatgattatagtctcctcgtgaacttacattactaagtacttttaaaatacaaatgcttctctaataatcatattgataatattcctttttttaaattgtataaagacattctgctacatctgaagttattaaaaatgaactctgaatatttttaatacctccagaacactgtccttcttatttaaaattataacccccccaaaataaaataaacttaggacccttatatactgaatgcttattgagcgcttgccactttatttagttcatgtaaccctcacaaaattgaagaagaaattggtgttgtccttgtttaaaagtagaagatatggaagcttgcatagagacattttgtaaatagcagaaattgaatgcaaatacttgtgcttgtaattttaaaggagctgattatgattattctgtttgattactatttatattcatatatgaccagaaaaaaagccacacacctccaggaattcttaaaggtcccacaaaattgagtaaacacaagtactcaccaaagtgatttaaggctactagaaattttctgtgggcagcctcatcagagttctctgcaggtaacatagacagaggtggtgtttcatttttcattctacatttactacagaaagaggtatttacattattcctttgttagagctgaagatcaggtagggaagaagtgcattacttttctagcaactggcaatttattttatgtaagatataatgagactacatttccaaaatgattaccaagtatattcccaatcaatggaattgaaaggtacatcatcagtaagctttcagagtccatcttttgtatactacgaagattcttgttatatttcatatttaatttccatgtttaactgcttcttccagtaatcactgatgaaatgtcggtttggtgaaagtttctaacttttgctggtttcattaaagttatgctttaacttactttgataattatatatcatgtttatatgacactattgttatagcataactgtactgtacttgatattctatctaatatactctatgatgtgttagaatacattaataggcccctgcctaacaacaggtatgtgctgctaaacacagtgctgtgtccaaatgtaaaactaattcatgactaaggaacattgtaaaaataacaggcatgaaaaataatgggattctctaatttatttaacaagtgtaataatcatactataaaaatgtgagagactattttgttaaaatgaaaacattttctagtgaggccatatttggataaatacactgcacagattaatgtttctgtttctcactttcttcatttgtcttaataaaggatttaagaaagaagttttcaaaggcaacttcttacttaatattttatcaaggatggtatttttgcaaaaatagggtcactcatatctttattacactggaataacaacactggtagataaacataatattaaatggccaataaattgtttaaaacagcatttgctatgctgtgtcttataggagttgtcttttctaactacctttggcccagttattttacgttttagttagaaataaatttctgattttatttctaaaaaatgtgctttctacagacatgaatctacaaaaaacatgaaaaatatgatttgttaaaataaatgtgacattaaaataaaagtgtacgattatataacttatagctatacatcgtataatgtgtggttatctcagaaaagtgaatactttgttctttagttaataagaaaaagaatttagctgttctaccagaaagttcctacaacagaaaagatctgttttgaatgtaataaatgagcctgtagctaagaaatgcatgttgactgagcttagtggattcacactgagtctaacaacgccttttattgataatcttccaccatctgctctgaagatatattcatacaaagaaaaaaaagcaggtgagaagaaagaatgcaaataagtggcaatacttaaaatttgaatcatgctgtgattttgcaaactggattgatgctactgttgcttttaaaaacattacaatatttgatgtaacaaagttgatggttaacttccactttcggtccatttgcttacatgagcaggaaagtgctcccagaaatgtccgattcataaatttaaatgattggtagaaacagtactaatgtaatttacattttgtatagggatagcactttcattctggcaaaaataaaagaataatgtatatattgatggtcctctcaatagaattgaaaaggcctttgactaggtataaatagaaaatatatatatataaaagcttacaaagttaaaaaaaaaacacataaaaaacttccacattaatagtcccttgaaaggtagggaatcactgaaaggtaaaaatatggtaggtcaaagtaatactaaatctggggatgtaaaaagaaagactttccagtgaaatcaaaggaaagaccacttatgtgtaagaaaatagaggaaaggacgatttgctgttttcagttccaatttgaaaatttctttctcttgtcgaattgctctggctaggacttccagtactatgctgaataaatgtggtgaaagtgggcatccttgtcttgttccaaatcttagaggaaagggtccagtccttccttcccacctactttcctgctcacttaatccccactgagtgtgtgtctggagagtcaagcaaaactctttttaaattttatttttttattttttaaagagaggacagacatttgaaacattttctccaagtttccataaaaagcactttatgaaacaatctaggcttaccagccttgacattccccagctctctggacttaatcacaaagggagatgaggccaagccttgggaggtagagtagaagaaagtataggactcctttgatgccatctacacacattaaatggaccagccacttctctacattgggcctttatcttttaactattaaagcataaggttattcatgtataaggctggctgcaaaatccttcacaaatgaaagtataccctgtaagtgcacttaataggcccccctttaatttctattgttcatagtggcataaacaagggttttcaccattcaataagaagttaactgtgggtttgtcatatatgacctgtattgagatatgtgccttatatacccagttggttaagactttttttattatgaagagatgttgaatgttattgaatgcctttggggcatctgtggaaatgatcatacgatttttatccttgattctgttaatgtgatgtttcacattatctcacaatgtatgtatgtaaaacctatcttgcatccctgggatgaatcccagttggtcatggtgaatgatctttttaacatgttgctgaattcacttttatagtattttgttgagaatttttgcatctatcttcgtcagggatattggcctgcagttttctttttttgttgtgcctttgtctggttctggtagcagggtaccttgtagaatgagtttggaagtattcctcttcaattgtattggaacagtttgagtatacgtggtattagttctactttaaatgtttggtagaatttagcaatacagccactgggtcctaggcttttctttgatgggagaacttttattactacttgtatctcattgttcattatagtctgttcaagttttctattttgtcatggtttaatatttgaaggttgtatatgttcacaaatttaaccatttattctaggctttccatttttttggtgtacggttgttcataatagtctctaatgactttttgtgtttttctggtaccaggtgtaatgtcttatttttaactctgattttatttatttgggtcttcttcctttttgtcttagtctagctaaaggtttgtaaattttccttatctttaaaaaaccaactttttattcattgatcttttgtaatttttaagttttctgttttacttatttctgttcttacctttctcatttctttccttctactaattttgaatttggcatgttattgctttttttttagttttttgatgagcattgttaggctgtttatttgaagtctttttttatactgtaagcatttactgctataaactttcttcatagtactgcttttgttgtatcccatagatttgggaatgttgtgttttcattttttccaagactctttaaaatgttattcctaattttttaaattaattcattggttgtacaggagcatgttgtttaattttcatatatttagtggttccaaagtttctcttgtttgtgcccttgtttgcaaacgtgaccttctacttacaaaatctaaagacaccaccaaataattgttagaaccaataaataaaattagtgaaggtgcagtatactaactcagtgtaaatagctcattagcatttctatgtgccagcagcaaacaatttgaaaaagaaattaggaaagcaatcccatttacaatgagtatgaaaaatacattacctaggaataaattaaaccaaagtaatggaagatctctataataaaaccagtaatatactgatcacagaattttaaaaagaacacacaaaataatggaaagatatcccatgttcatggattggatgaagtaatattgttataaatttcatattaccttaaaaaaatctacagatccagtgcaatccctgtggatgttactgtttacaaaactgtaaacatggctatatttctccattatctgcaatgctgcgattttggttactctgccaatgagaacagatggaggtggaatgaggatactccttatttagagcatcacagacaccactgtcgacgacgttcagtagtttctcttgggcagttttcagctatttttgtggctttaactgattggcagaattctgaagttgcttttttcccctcacatgtccactcttttatggaaataataaatacactgagttggccaggttttcacttacatgagattgtgaccgtaacttagggccttagcaccactctcagttaccatcattttgggtttccagtctcagaatgtcattcatagtttacggtgtcctcatggtcacacatttctttcagctgctgtcattccagttgaagagagaccatttgactttctagagatggctgcacgcaaacatttaaaacctttgagagaatacagtgcaccagggaaatgaccaagagtttagagtatgctccttatccaggattcccataaaccgaaccaccaaaaaacaaataggttaaagaatgagctagctgaagtgtctactcacttgactaagtagtattttcattaatcccctacaactgaaatattgtaatctacatttgatgtatttctctataagccacaagtatcaatagctgcacaggtacttttctgtttagccaattctattatttagcataacttttacaagagaatttaaagtctgttgtgtaatgatagcctttaaagtagaatttgctgtagaacctattatgagtgagacatttctgaatattgccacttttattctaaaccatggaaaaagagcctaacaaatgatgtccttctagaagactgaaggcctcctggcaatgttctctttaatccaggatgtgggttaagagttttgactgattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccaggaagcagagcttgcagtgagccgagattgcgccactgcagtccgcagtctggcctgggcgacagagcgagactccgtctcaaaaaaaaaaaaaaaaaaaaaaagagttttgactgattatgaggcaacgtacgtactactaaagtttctcacctacattgggcctttatcttttatctattaaagcataaggttattcatttataaggctggctgcaaaattcttcacaaatgaaagtataccctataagtgcacttaataggcccccttttaatttctattgttcatagtggcataaacaaggaaaaaatattcaaagataagagtctcgtgagagtagaagccttgatctgtgatcttgggaaaagttgttcacatcaaggatgtcatctttttctggggagaagctttcctggttagttttaccttaagggttccgatgggtgtacagttccaggagtatggaggcacccttctcagctgtgagattataaacccaaggttcaaagctaacaaattttgctgtagtgtgaatggcagagatagtctttctctgatgttctcagaagatccaatcttcaggttctagattgtgaagagattatcctcagtaagccataaaaaagctttctttacctggtgaaaatacactgtagcataataatctacttttataataccagctctcttgcatggaaaagctgttatacaaccaaaaagcatgcactgcaaatgacaattgaataaaatctctttataaatatttaaatggctcatcaggtagccaaatgtacctgaagctttgattgtcttcccaggaatatggaaccaaacattggttttagggtggagcccttggaaaaacagggccaggaaagtggtttctggtgcctcctgtttttcccagggagtccaggctattagagcttgaatatccacttttaattaagctggtttttaaccatagtactctttaatgaagtccttttaaaatttcttattacccgattttagccaggccaaaaagccaatatttctggcttttgaattttaccaaaggtaacctcccaggtgcccagagaaaggaaaatttaagatagtgaatggaggagagactagacaaggttatgcagatattaaaccaagaagggcttacttcctaggtggggaattgaaccatcagtgtgaaaggccaaagtcttagctactgagctatagcacagggcagtctctattgtccttcccagaaggagtctagagtagttaaatttgaacttgcaaacgcttttaactactcaagataatttttagagctaactatgacataaaccctaacatttctgttccctggcaggtgaagactaatagaaaatactgccacatggttacaaggtcaagctcccaaggacataaaacaagagggaggaaggcaaaatgatcagggaagccagagaaagacccatccattgaagcgacactgaaaagttcaggtagctgcttctcagtagcaaaggggtctttcccagcagtcccatcatctctcaagtttccccttttagggaggaaaaggctccccatggtcagcgatcctgtacatccctaatcctgtcacccacagccatcagcacagagtgcaaggcagattaatccaaagagaagagcagatgacatgctgtagtgccaaacccattcttggccaagagggacttttaccaagagccctcatttttaaaatgtacttcaatggattgttgttcacttggaacattccactgtaagttatcattagtaagtttttgccatttctgtaagacttcactgccttccgggcctaatgaataaaccagaaggaactcagttttctagaaactaaggatcccatttttacctaaaatactggcttcgatctcaggttctcttgattaacctggccaatgatttttcatacctcagcatgcaagaaaaatgaaacaaaggggtaaaacacaaaaatccctgggaattttcaaaagacaaattttataacccctgcaatattagcgcttactaccagtttctttctctcccagtcagatgtaagaggtctctaactggatccaagccagttcattcctgtatcaaatccattcctggacccagtgcagtttctgttgcgactccaaacccagtttggatcagaaatttgctcaaagaaactcggagaactcaaaacacaaatccgtggagctcagaaatctgagagggagcttatccatgatctccagctgctctgagagattaaaggacccaagtgggccctgtaggtaccttgcgtgttcactcagtgctcctaggggtcgctagaagctccacttctggtaccatctgataaaagaaaaacttcagaattaatttaaaggagtttaattgagcaatgaatgattcgcgaattgggcagcccccagaatcacagcagattcacagagactccaggggtgcctcgtggtcagaacaaatttatagacaaaaaaggtaaaatgacatacaggaataggaagtgaggtacagaaatagcgagactgattacagcttggcttttgccttatttgaacgcagtttaaacattctgcagtctgtgagtggttgaagtatggccactgggattggtcgacactcagccactgttaacaggtgcatactattaagataggttttcgcatttgtctggctattaagctaggttacagtttaaccacaaggactcaaatatagaaatacggaatctttttaggccatatttagtttgttttaacagatggaagaatctgataccaaagttgttataatatattatctaaaatgtccagttttctggcagagcaggaacatcaccatctcagataggcactgccattttaagttccccttgattaaaaactgcctaaatccagcccaaaaaacatcaccctaatggctaatgtcagcataatcataaacctcaaaagacacctctgaccagaaacattccaaccctgagataaacccccctccaaccagagacatgccagcccctaggtaacttcccctccaaccagagacattccaaccctgcaataaaactctcctccacacaaaaacattttcagcctgtgaaaagctctcttcctaaacccttaaatacccttaatctgtaagagagaatgctcctgaccaaaatcagccagaagcccctcttgggtttattctccaaaataaacctgtctttgaattgttgatctgcttttcgtgtttcttttttctatcttcaacttcacattttcgataacaacataaacaaaatacaagacataccaaaaaataaaggaaaatataccacatatacagaaagaaaagtacagccaacggaaaacataccttagagggtacagatattggtcttactagacaaaagactttaaatcagctgtactaattatgttcaaagaactaaaagaaattatgtattatgaataaaaataatacatgataacagtgtctcaacaaatagagaataatagtaaaggaacagaagttataaaaaggaaccaaataaaaattataaagttggcaagtatattaacaaaaaaaattactggaagggctcaaaacagatttgaactggcaaaaggaagaattgaagaattgtgaacttagaggtaaaccaatagtggttatccagtctaagaaacaaaccaaaaaaaggaagtaaagaaaaataaacagagtctcaaagacatgtggaatggtctccaatgtcacttattgcccattgtatacccatatatgtccattgtttagcttccacatataagtgagaaaatgtggtatttgattttctgtttctgagttatttcactaggagtgatggtccccaactcaatccatgttgccgcaaaagacatgatttcatactttttatggctgcatagtattccatagtgtgcgcatgtgtgtgtgtttcacatttttttaatccaatcacctgtttagggacatatcatgtgactgctatttgaaatagtgctgtgagaaacatacaagtgtaggtgtcttttttatataatgttttctttcccttcagatagatatacagtaatgggattacttgatctagtgatagttctatttttagttctttgagaaatctccatactgtctccatagaagttgtactaatttacatttctaccaacagtgtataagcattgccttttctctgcatccttgccaacatttgttattttttgactttttaataatagttattctgacaggttgacgccttttatttctttttcttgcctgattgttgtggccaggacttccaattctatgttgaataggagtggtgaaaatggcgtccttgccttgttccacttcttagggggaatgttttcagctcttcccccattgactatgatgttgtcagtaggtttgtcatatatgatttttattattttgaaatacgtttcttctcatgccttgtttgttgataatttttatcatgagagatgctgtattttatctaatgctttttttaatctatcgaggtgaccatatgattttcatttttattctgttcatgtggtgaattacatttattgttttgtatatgttgaaccatccttgcatacctggaataaacccatttgatcatggtgtattatttgtttgatatcctgttgaatttagtttgcttgtattttgttgaggatatttgtatctatgttcatcaggatatttgcctgtagtttcttttcaatgtgttaaaagaaagactatcgatcaaaaattttgtattcagccatgctctcttttaaaaataagagaggaattatgatatctctgggtttaaaacaaactactgaaagaattaatcaccagcagatctgccctacaaaaatagtaaagagaatctttcaggctgacatgaaacagcagtagatggtaacagaagtacatatgaagaaacaaaaagggcaggtaaaagtaacaataaagagatcataaaagacagtgtaaacttgtaaaacatgatgctttcatcttcctgtctattcaaaaagacaatttcataaaataataattgtaacattattgtgtagaaggggttataatatataaaaatataatttttatggccctaatagtaaaagtggggagcagtacctaaggtatattggagtgattatttggtatactattgatattaagttggtattaatccaaattggattgcactgagatgttaattataactcctagcacagacactattaaactaactcaaaaaatacagtaaaatattaaaagagaaacactggaagtatatatttgacacaaaagtaggcaagaatctaagaacagaaataataatacacatagaaaacaagtagcaaaatggcagattcaaatcctacgttatgaattataacattaaatgtaaaaatgagttaaataccccaaagagcagagattgactgaactgaaaaaaaaagattaaaaaaaggtccaagatttacaagagagatacactttagattcaaagacacaaatagatcaactgtaaaatcatagtagatatgcccatttaagatataatcaagagaactggaatggctatacgaagatcagactgaattaattataagacaaatattgttactggagacaagaggggcattgtattataaaaatagtatcaattcatcaggaagatatgatcattataagtatttatgcatctgacaacagggtctcaaaatacctgaagcaaaaactggaagaattgaaagaaaacatagacaatgaaaaaatagctggagaacataaccccatttttaataatgtatagaacctctaggcagaagagaaacaagaaagtagaagacatgtacaattctataaaccaattagtctacacatttatagaacattctacccaataacagaaaaaatgtgcactcttcttaatgtacatgaaacttctagatagaccgtaagttaggccacgtgacaatcgtaaataagtttaaaatgattggtagcatgtaaagtatggactcaaaacacaatgtaattaaattaaatatgaaaaagagaagagagttttaaaaattgaatatttgaaaataaaaaacacactactaaaaaaacccgtgggccaaagacaaaaagcttcagtaggagttataaaatactttgaaatgagggaaaagaaaaacacaatatgtcaaaacttgtcggatacatttgtagcagtttgtagagagaaattcatagttataaatttctatattaaaaaagatgaaagatctcaaataaataatcttccaacttaaaagaaaaagaagagcaagctaagttaaaagcaagcaaaaggaaaaaaagaataaatattaaagctgaaaagtaagaaacaggaaatataaaaacaatagtgaaaagtcaatgaaaccaaaagttggtttgatgaaaagatcaacaagatgggcaaatatttagctaaaatgaccaagataaaaataaagaaaacacaatttaatgaaatcattaatgaaagaaagtcatcatttctgaccttatagaaataaaaagataagaaaatactatttacaattgtatactaaaaattagataacttagaggaagaaatggaaagtgactactaaatggtatgctgtttatatttttattgatacataatacatatgcatattttcaggatacatgtgataatttaataccttcatatcatttgtgagggtccaatcagtgtaaatggtacatccaccacttaaataattgtcttttctgtatgctagaaacattaaaaattttctaaatttagtttgtggtaactttgcaagccttaatacattgaaaatgagggaactgcatgctttaaatgggtgaatattatggtggtatgtgaaatatatctcaatgaagatttagaaaacaacaactattaatcctatacttgagaattctatcaaaaatgagaaatattgaaaaggttatctttggtgtttagaagtttctcaaaatggaatggaacactagacttcactaatattatttaatattaagtaaatattaatatttaatatagcttatacatatattagttatacttgaagaaacaggtatacaacattgcatgtacatatacctgcaatctataaatatttttcaggagatttcatagctcttaggagataaaacacacaaaattatataaataactagtcattattcatgtttttgcagtgacatgaaccataaagttttatgcatccagtgcatgtgtatttatatatatttattcactagaatccaattgaccttgtattacagcccatatgcattaagatgcttatcgattttagaagacagttaatttctaaatgttaggaaaatgttattatactatatgcatatgttgaaatatctggtatgctcataatttttgtaagcgcttaactcactatttaaaaaatgttctgaacagatagtgttacaatataaaatactaaacttagaacacatgattttaaatagtagatgactgtacaattattaattagtattacagatttgagacacatttatcttcaaaccaatttaatgcaaattagagcaaatgattacatggcagcataattatatctagcttgtgacctaccaaagataggaaatggcacacgagattaaaactggaggaaagaaatagaaaatcttgacccaaactaatatctctgtagttcaattacatgctactaaacactggctgtaccctctgctttctttagctgaaaacaccagtgctgtgttccctccagtgatctgtattcaagtacttgagaatttctcatcagtactagtgattctcactctgggggtgagccacattttcacattttctttggtgattgcataagaatgcctatggttgatatttaaagttctaaaaagttaacagggctgtcagtacttatgttgaggacatcacctcattcccacctgcataatttcttctttgaagattatattaatcctttagtaacaccatagtgtctaataagcaacatatttgtggaggcctaaaaaatggtttgaataatctcctcagcatggccttcatctgggggtggtccttcagaagtttcttccatgttaatgtctgtctcaacaccaagtcctttgtcttcatgtaccttgttgttgggaagtcacgacacctaaaatgatttcaagctaaatgacagtttttcttgatctgggagaataaatgacgagagcaaagctaagcctgagaaatttgtgaaatatattatgtttgtctttgaagtgccctaacgttcttcacacaggacctctctcattgttcctgcctggtaatctaatgcccccaccaaacactataaatggactgatctttccaaacctactttaccttaaacagtctcatattacagagttacttctcatctcctatagatccttccatcaaaaaaatatatatttccttagtacactttgtgtaaggaaaataatctgattaaaatcattcacatataaatcaatttgtcttagtactccatttgacgggacaaagaagttgacatttctttaagtgaatgaatcaggtctaataccaaactccttgcaaaaatgttctccctcctctgtattctggagagaatctaagagttattctggtaataattcaaattttcaaggtattgtttacaaatctggatgcagttcactcacaataaaatttttaaactcacactcactaccttgggtttgaaaatggcttaaccaccatcatcacagaaatgctttgaaatacgtttcagtgttgtgcttttagatggtaaattccttgatgtccagtgagattaaacaaattgtttgccgcaattcttactgtgaaacaatcaataacttcactcctgaagtatggtcatctctattgtgaggttcacaaggcctttgcccacagaaagaattgagaaatcaattttgactccctacgagttgtgactgtgtctctacttgactaaataaataagtagatcaagtggaaaagaaagaggatgtcatgctcagcaaaggttactaatagatatatctgttagcccacagatctggggtaatgatattttagatattacttgactttcccatgcctatccagtaacccttaagaataccctctttacagaacaatgtcaaagtggttgatttagaagaaatttccaaccataagcattccagaatgagggaagtacatcactctaggagcaagcaaactgtgttaccctcagacaaaagcaaaataaaacacagcaattagaacactgccttaataagggctttgtctctctgaatgaattatgagataaaaaagaatacatgaataaatcactcagtaaagtgtaaagtgtcatgggaaaaataggtactctattcctagtatattctaacagaagagatgcttgttaacatctgtttgagtttcacaaacagcaaaagctggcaatctgtaaagttttaattaaataaagcaaaaagaatttgtcacttggtaaagtttctgggaaattgatgcttaaaatgtatcaaaataaggaatgaaatttctaggtcagttttttctttgatgtgatatattaaaaatgtcctacctttaggctttttatatacggtctttcagataactgcaaaaaaacaatttttctctgtaaaataaatgggcaatttaacaatccacagcaatgttagtgctagtcagaattgccattttagcatttatataataagaagaaaagtgtgcagctctgttttttgtttgagagttttatcttggccaggtgtggtggctcacacctgtaatcccaacactttgggaggctgaggcaggtggatcacctgaggtcgggagttcgggaccagcctgacaaacaaggtgaaaccccatctctactaaaaatacaaaaattagctgggcatgttgggaggcacctgtagtcccagctactcgggaggctgagacaggagaattgcttgagcccaggaggtggaggttgcagggagccgagatctcgtctctgcactctagcctgggtgacacagtgaaactccgcctcaaaaaaaaaagaaaaaaaatagttttatcttgaaagatgtctagaagaactatgagaaagatacattgaagaactaaaatttcatacaatttcttgaaatgttgaaattttatccaaagctaccaaatttttcaggaaactatgtaacttaagtaatatagtggagagctgtcctttaggactttaagataagcaaaatgatattaagctttgtaacacagtagaagaactggatccaagtgtcagacaattggtttaaaatccaaggtgtgacatttattatctctggacattggggaatttacttatcaaataggagcttcatttttctcatttgtagaataatacttatcttttagggttattgtgcattcacacaaaaaaatgagatagtggacaaaaaaagttgtaattatgtaaggcgtatagacaaggtaaataaaaggtaaatatgagatatgtaaatgaggtaaagaaaataaaatacctaccatagtgcccaataacttcaattagctcacactgtagatatttccaatatagattatatattgtttcagagtttgaattgttaatatgaatttctctaacttttagatataaattaaacaaaaatccttaatctcttttttaactaaaaaaattcaggaggctgaggcaggagaatggcgtgaacccgggaggtggagcttgcagtgagccaagatcgtgccactgcactccagcctgggcgacagagcaagactccgtctcaaaaataatgatgataataataataataataataataataataataataatttattgtgataatatacacataacataaaattaaccatgttaatcatttttaagtattctgttcaatagtgctaagtacaacatattaaacttctaaaagtattaagaagtcataaactctcttttctgattgttgtaaatttatttgtattaaggcaaaacatcttcctgagaacaacttcagtttcccattctccactggtgtgacctatcattcctacattctattagcattcaaattagaagtgaaaatgagataataagtatacagattcgttttgatccctaatgaaatatgaaaagaattaacatgaattgttgtatggtctttccctgagtcttagaatagtatttaaatattttcctagtgcctcatatggcatacaagaaaatcaaggctaatgttcagtgatcactgtaacaaataattatccagcactagaactaaggattaattcgttcaagttaaatattctttctaaaacttcaagttgtctcacagtatttttttttcttttcatggtgcttttctttctattcgttggtaacaatgagatgactttctagtgtttttgttcttgttgtgttttgttttgtttttagtaagacaagatgacacttgttatttagttcacctggtgaacagtctaaagaaatctattcaaaaaatgcatattttctcctgaaaacattcagctttatctaactataatatcttggataattatattatacttctgtcgtttatcacagattcatctgcctatactgaaattaatgtaacagtcttctgtttgttgaatcagagctctaatatcatgattcaatctgtgagctgctccccatttgaatcaataaaaggctgagaggtcttgacaagctatattttttctaatattgatcttgatgaccaagctggtgcccttgagtctaaccattgattttaaatgggaggcctgtcaagttggaggccaattttttgctattaaacagatcgggtcttgtaattaaagaaaatgtcaggctgtcatattttacaagagggccatgggaatattttcacgcagttttcaagcaaattagaaagtatgcagacctgctggagccaaacacatacacccaaaccagcataggcttacacagaaactaaatcaatgttcaaatagtatgtgattcattggctttctattttcccaagactcaatgatttaaggaataatttatgattcctggctctaataacatgcactgctgcatcaacttaaaatgcatcaaactcttctgaaagaaagtaacattcaaatgaaaagctaatttactgtcaggataatggagaacatccaatccagtctctgcagcttttgcttcctgtttctttctagtactactggaaaccataacttcttactcctctttttatgatacatttcctttattcttccatcagttcaagaaatatttacagaaaagcaacaaataaagagctgttgaaagatcacattagtgtagaagaaacagaccagtaagcaaaacaacattatatttgttgtaatataggtatagtacaagtgccttcaaaagctaagaagtgaagggctaactttgctatggatgtagtaccatattgagcagagcttgggactactgtatgagaaattgagagcctgaaatttttatattggaatgtgataaggactcacataagtttgagaattgacttctgaggctagggatactataaaattgaacataaaatatagaactttcagaactggaaaagaaaatattaaaataccaagagaaaacatactaagaacacaaattaataattctcccaaaaggaaatatgaattactataagctttcaggaaaatattcaaccgttatttctccaaatattgattttgtccaataaatattgtcctaacattgtttcaataatgtcccagtcaatatctcttttattattctgtaatttctgttacacttatgttagtacttctgcccatgtgacatgatctaacttatgctctgttcctctcattcttattttttcctcccagcttcagtttgcatatttttattgacttgtcttcaaatgtattgatatcatctttgactgtgttgaatctgcttttaagcccatccaatgacttactaattcctaatactgtattttattccttatacaaaatatacatttgattttgtatatattgtattctctgtaaaaatatttcatcatctacatattttctatagtttttctgtttctttaatatgctagtcatagttattttgaaattattttctgctaactacaacatcaggagtttttataggcctgcatgttaataatcttatcactttttattaatatcagtcactttttctttttaaatatctagagtgttgggtggttttgtttttgctatttcttttttttttttttgtattctggaggttacaagtgatacttataaactattgaaattctgaatcatggatccttccttaaaaaaatgtttcactttgttctggtaggcaccttgatgctgaagagtcccactgttagctttgttaagatagtcctgtattagtttggaaagcacagcgtatccgctaaaatctttccattctggatgaaccagaaaaatgatttccctcccaacaacaaaagactcttgattcttcacttgctttctgcctcccagcagctgctgccttgtgaacttccatagtctttctctgtgcttttgcagtccagaaattgtccaaggatctaagaaatattttcaacaaatagatgggatgcttatccacattccgtctttgatagcagctccaacttccacttatcaataccactattccatgtttgctatctaaatacctacagtgaagcccagaataatatcccaagactcattttatgcatctcaactccaaaattccctacgatggttgcccaatgacagccgtcagttgttttatatgataatattaatcaaacaattgttttattaagttttttttaaaaatttaactattaatatacattaatctcaaagttattgtactgcgtgaaaggcaaacaaaagagattatagaatatagctcgattgtataaaatgatggaaaataaaaaggagtccatagtgcagaacacagatcagcagctaaaattttcatttatattatatgactttatatggtgataactttggagggaaagattccaaagagatatgaggacactttttacagtgttgactgagatgattgtttcatggtgtacaggtataattaaatgcaaaattatacaattcaaatatgtgcaatttagtgtatgccaattttgcctcaaaagttgtgaatacgcacgcataagtatctgcacatatttatatctacagaaagacacatacaatgctgattaataatttataaggaaataatatagtaattttaaagaaatttggaaatatgcatcaaatagtgaaaatttttcaacttctatgaaatccaactccaaggaaatgttatgaactataaacaaatatgttttcagaaagacatttataatagtattatttaaaatcttgaaaaacttgatgcgtgataaattatcaataaaacactcttaaatattgacatagtcacatagtgaattatggtttaattattacgttggtaaaatgtttataatacaatttacctttttgcccttctttacccttttatttgtttttaggcacattattacattgaaacacatctatatacacatttcaatgagttttgaaaaataaatacgcctataagccactatcccaatcaaaacatagaatatttctgtcaattgagaagtatttttgtgatacttttattcaatacacactataaacatgtagccatttcctgatttatagcaacaatgatgggtttggcatgtttcttaaattaatataaatgaaataatagactatatactattatgaattgcctatttatatgaaaatatcacaattcatatttggtgactctctattggttgaattatggcaaatatttttctgtgtctattaagatgagcatatacctttttcctcctttattatcttactgtaatgaattaggttgattatttattatttttttttttgagacggagtctcgctttgtcacccatgccggaatgcggtggtgctgtcttggctcactgcaacctctgcctcccaagttcaagcaattctcctgcctcagcctgagcagctgggactacaggtgcacgataccacgcccggataatttttgtatttttagtagagactgggtttcaccatattggccaggctggtgtcgatctcctgaccttgtgatccgcccgcctcggcctctcaaagtgctgagattacaggcatgagccaccgcacccagcctgattagtttttaagtaggaacaccatctggtattctttcccactgggtcatgatgtatttttacctacattatctgatttgatttgctaaatttctgtcaaatactttaatgtccatatataaggggttattgttctacaatttgcttttttttaagaataccattgtcatatttgggcttcagagttgtgttgaccttatcaaatgagttgaggagtgacaatttaggacaatttccagagatttcatttttgtttaatatttttcaccagttgtggttctttcactagggaaggggttctgaaacctcatcacaatgctctcctaaaatttgtccctagagtcaaagagtgctccagtgttattaaaccaaatgctcttactttgacctttgccaaaggtataaataatacttaatgtcaaatttattttcaagtggttcttgaaataagcctttttaaaaagtcgaactctttaaatcaatagtgttagtattttaagaaaattgtatcttttattttatgctagtttgttgtagtattaaaactgaccatattattaattgtgtatataatattctagcacctatagctctttgtcctcaaagccccagaagatgattaagaaatattttctttcagttgtttctctttccctaaaaattacttttaggcctgtttactatctacaggtataacttgccaaattctttgcagacttttatacctcctaagctactacctctgaagaaatcaccttggttggctgttttgttgactgctactgctggttagccaggagataaatttcaagtggccacaaattcattctttgattgtgactgggttgcatcacgtgatatgaaatatcagaaatgtagtacagaaaatgtgttctgataaaacatgaatatatattttgcatcaatccaacaacaaagcaaaacaaaaaataaattaaataatacataaacaattttatccatatcatttgcctcctcaaatattgcagtggagtggcagtgtttgagagggaaatacatataatatgaaacaccggggttaaagacaacatatgttcctctaaaaaattatcttgtcacttacttgctttttgaatagaggcaaattatatatcctgtatgagccttcgattctttatgtgttaaaaaaataatgctgacttctttatgggattgttgtaaatattcaataatagtgttttacacaatgcatgacctgcaagaaatacaattttttctccgaatggtagttaattgtttctgctataatatccttccttttcattcagcagaatgcattataatatagtcagacagttaagaaaattggttctattcagtctctctatgccaaattgtatggtattgacaaattatgtagcctttctatatctctgttctgcataggattgctgtaagacaattcagatagtgtgtgtgaaatgcttagaacattctgcaacattttagtaagtattcaataaatattacccattgttattatattccaaaaaatcctacatgataaatgagaagaaaaaaggatttaagagaaattaagtgattttttttttttccccaggagcctcagcaaataaatggcctaaacaattggaagcctagggatgtaattgctggtcttctattaaaaagtgaaggagacaagattttaatgaaggtactcattctattcataggctggacaaaaatagtggttttaatagaacgagctaataagtaagagataaaagtagaaaacccagagctacctggaattacactacactcaattatactcgatcgtatatagacagattagccttcctctcaggtgacatctcacgcaatccaagatttgaagttttttttttttttctatcactgctattttctctaggataatatattcaatgaatagaaatcaaatagaaatcaaatcggctttaacagttatgatgtaagattactccagtaaaataacttcacagatgtacgtcatgattcaggagtaaaaacaaattatcttgaaatatgtaaatcattgtgacccattttcagcttgaattatttgtgctttcacacagattttcacttcttttgcttataaaagtaatgttattaatacatttttatttgaatttttaattttaagaacaaatgcccatccactaacttattctagacttaagactttttttacagacagctgaaaatttgctaagaacatactaacattgaaacagcagggaaattctcacatagggaaagagaggagaaaattatttacttatggtttatggggatcctatctgctccagtgaatttaatttaccacaggaaagatgctctgtatacgaaataaaatatacttctttatctcaaagtgtacatttcaaggaatattttgtctcctttacaagaaggattaattcacataaaattaatatttagtaataattatttcatgattaaaattctatttaacaaactccacttaaactgtgtctataataatcaaaacaactgaacagcaaatatttattctaatgatttgcagctgcaatagtatatattgtgcttgcaaaaactttgccatcagtttatattgcttcatccttagtcgtatcgtagactttcttgacccaataaggaatttactgataaatgacattctaggacaagcatatcctaggctacaaatgaaggagaatggtgaagactagctgcctctaaggtatctgggacataagtcagaaagttcaaacctgagatttaaactcaaattagcccaaagggggttggtaaaaggtgacatgtgaagctgtttagacgtgtataaacaaatttcaatatcccaatagtcaacaaatattaattaatataataatgacagttttgagggtatatatagcttctgggtggcataacataatatataaaaaattatgccatgtaaatttgctgaacaataattaatacattgctagcccaagtaggatgtgcatactggtgtgttataaaatattttaaggaactgaaatattttagctatccatatctcacaactatacagatgcagtttgatagaaaaagtatgttctattagtctactacatgaagcattctgaagtgccatttcatttattctatgggtgtgcttatgctgtaccatgtacacttggacatagagcatctcattccaaataactactttcacttgttcggtagtgactatgtaaaggctagttttattttcatcattaaatagtgagagattttactgtctagacaaaggagagagaaaaggcatctttctatggagcaggtgaaaccaccggattgaaaggaaaaatgcaagcagttgattgtcacacagccagaggaatgggttaatacaataactcctatccctactactgctattaagtaacagtgagtgagagaatagggtagggaaaggagaaagggagaggggaataaggaaaggaagagaggggaggagaaagaagaagaggatggggaggaggtgcacatgtgtaattaaaatatccataacactttaagatggatgctctagtaggatgtgaaaaagatatagtgggaagataaagaagaaagtagcttcagagaagagaatatttgttgtatataataaacagtgggatattgtaaaaattgcatattcttattcagtagctctgtgggtggggggacggggtgttgacattctgtgtttttaactaacaagctcctaggtaatgctgatgttgctgttcttcagaccaaactttaagtagcaattaaagtaattaagtaattaagtaattaagggtagagaagacattgatatttattctaggcagagtgatgaataccctctagtagtcatggaagaataaaagcatttggtctggctagtagttcactgagcataaatagttcactgagcataagtagttcactgaactatcagataatgatttagaaaaaaaaagtattacaaatgacctcaggctaaacattctgaacattattttgtgggcaaagggaagcctacaaatgcttctgttcctaagtgtgccactgtaggcttgttggtaaggaaaccataaacatgttatagtttaaagggcaagatggaattagagaaagaggaagaggaagaactgttagcagacttcagccattgccagagtgaggaaagcaccaggttgaactttggagatggaaaagaaaattccagatttggcacctacttctgagtcatcaacagaacatagtcaattattagatggaaatagttgggataaaaaaataagtaattgacaaggaacattactttatattttgtgttgttttatttcgctttagccaagaatgcataggaaaaaatagataatattaaaaaggtaaaaattatgggatggtatgaaagcatatagaaagtctatatgggtatattgaatagacaaagttttagaatgtaaatcgcggagtgggccatggatattgaaaattagaaggtgacagggattacacagggattgaatatatattgcaagccagtgattttttttcatagagtatttcttttaattagaaagccactggtaaccttagcaagagttgaatgatagaaagaagagacaatagaatgacacaaattatagagtcgatagaatgacgcaaattatagagaggtaaatggatttgtgtgcctcatgggtatatgtgtatgcaaatatggaaagtggctgtgggaagtaaagcccctggtagttgttctttaatttggatgataaaggtggcatactttttgtttctagaggaaccattcctgttttctgattatgaacgcgggtagcagatgtccttggaaagaatgtccactagatttgctccaaggccaagggcatcatcctgtagattctgataaaatagttagttaattatcgtatccaagatgaaagctgacaactacaaatcataaggcaattgatgatggcaggaagtttgtcaacattcaaatccctcgagtcccatccctcgaaaaagacatattcttcctactccttagcagtgatagcgttgtaccaatatcaaatcacagatttttagagggaaatgggtataataaaattgcctatacatttttatagtaaattctagaatttcttaaaatctgagaaattatttcaatgacaatttttttctacagtatatctaggtaatgatcgctgagactcatagagtgatgaaaataaacatttaggtgttgtatatctctcatatgttttaataagttttcaggtgtattttattttcagtagacgacccttcggtggaggattggggaacaaattttaattcaagccattttctcccagggcacacatgctaatgtattacagaaagctgaaccataatattctaagcacttcagttagtcttcacttttgaaattactcttttgaactgagtcaaaaaaaaaaaaagaaaaagaccctttcatttcattgaagtgaagcaaatctctctgctttaattaagagcaatcggaggaaatagtgataacagaagtccagctccgagccgtgtataaagaaatgatcgcgggctctggctgccagccaggctgccaggctgtttttcatgggtgttactcgactgacagtaccttcctgacatttgtacctcgacaccagaagtgctaacagctgcgatgccagtggtagaaaagcaaggaagatctttttcagctttagttgctctcagattctcagcaccctaagagaataaagtctgttaaaactgacttcagttggctatgtcctttgcgaagatttttgtgttggtgtctgaaaagcagttttattccatgacattgggcttaggggagattattttttcaagacagaagacacatgtggtaaatgcgtgacaaatggcagtaacaaagttgggctgggagttcatggttttatgaaatgaaatatttcagcaaccaattccgtgctctgttacttgctgcagacagcccttttgaccctacactgaggcagccaaaaaggactataggagaaaatttctagttatcttgaagttggatggtattcttaactaatagtgacagatgtagcaatatgacttctagtgcttgctgctaatggcagagcttcaagccatcaggaaatgagaaaggtcagaagacaagtgcacatatgtgagaaacgagttcagacgataaagggtgagatgtggtttttggaaaagctcattttgggaacctttccagtctgtcttggtggtttcaaggtgattcttggcacataagcgtatccctaacattttgacatactctagagaatcaaggtcctgaaaagaatataacactgcttaaatatcaaggagccacgatgcactgataacttgtttcgtacatttaatcttctttatgattttagcgttgctactgctttgatcttaaaaataggaaaaatgtttagcaaaacataataaattttctaaaatttaaaggatatttaagagcccttctacaataattaacttactgtaaaaaaaaagaaaacttctataaatagttcaattgctaatgctttatagcagatgagttttttacaaaagagtttgtatttttaattttataacaactgggttgtctccacatgcacttttctgtcacctccatatttcagacaaatctgggcagattctgggtggtgtggtcctagactgaaaactctgtttcaaaatccaagtataaaactttgtctttaatgacatttcaaacgtttcatatacacaatgaaaagatttttaaacagcataaaaacccataaatgtaagagaaatatcttcttacatgtacattataagtattcttattgagagaaataagtgttctattgataactttaagtaaataaagccaaaaggacagaagaaagtctataattaagcacaattcaatcattgtggccatttaattctgttgttttcatgtataatctgaagtccagagaagttaaggaaagcatgtgattttatgcagctaattaatgattagaattcagtatgccaactcccaatcctggggttctttctagaacaacatccctggacatgctcagaaagcaaaaatgtcagaatatttttctttcagcactaatgctatgattcatgtcaaaacaaaaacttcagctgaagaaataaagataaattgatttaatgtgatggcatcacatcatagtaatttcaaaaacttttgagaattattttttttttttgtaattaactctccaatcggcaatggcagagaggagcatcatccaaaacatctacagggaagtctgcatatttttttcatttcattgctaatgagccattttcacctggctcctgctcccactactcccccatgaagaaccagctgtcagtttccacagctgagcaggtttggtaccagacaggtggcagcagggtggggaagaaattgtgtcagtgggatgtagttaatctggaattatggtgatccacctggtatcattaaacattgactccatatcatgaatggttcactacaagacaatcaacacttaaattaaaagttaaagttttaaatatccttgaaaagacaaatatgaaggtttggtattaattgaaaatctgcagtcttatacacattagatcaactaagtccatttagagatgacagaattttatattctgtttatagaaaaggtgaattggactgtgctattccagattctaacattcactcactctgtaagctttttatgctataggctctgtgggggaaaaagcaaaacaaaacaaaaaactatcttgacatcagtagcactgggttgaagcttaaatgggttaatatattcggaaggattttgtaaactgatacttaatatgtgtgtaagtatggagtctactgttatcattggtatttacttcatgattatttttaactctcacaataacctagaaaacgtccttaatgtgtcaaatgatatggccaaccacatgactcaactgatctccctggtcacaatgatagtcgcccattggtgtttgattcagttcgtatttttcttcaggtggaagtcacctccccataaaagccttctctgaatgctcagtaatgggctggatgcccttcctgtgattctatagcacccgagctgacccctattagagaacttatcacacagcattggaattggctattcaccagtttcattctcccactggaccataatgtttatgctcagagaccttatgttgttcactttttgaatttccagtaactggtgttgtgtatatcacataatggagactcaataaaaattatatacattattgacatcaattagtttcatgtatacaaagtacaaagcacagtatgtaaattttttaaatttatataaatttaaaaaccatatctagacatttatttgatttgcaatttgaaccaccattctggcttcatcatgaagaaaactttgaagtaggccgacagtgaaatgcagggagaccaattcaatggtgaatgcagaaaagatgctcattcaaacaagagtgggagtggaaatggagaagaaacagacctgagatatatacagaggtcaaataaacatgatttgataaataaattcatgggtgaggaagaatgagatgtcagaaatggctttagcatgcctgtaatcccagcattatgggaggcagaggctggtggatcacttgacgtcaggagttcgagaccagcctggccaacatagtgaaacaccgtctctactgaaaatacaaaaattagccagccatggtggcaggcacctgtagtcccagctacccatggtggggctgaggtgggagaatcgcttgaacccagaggcagagtttgcagtgagctgagattacaccactgcactctagcctgggcaacagagcaagactccttctcaaataaacaaataaataaatggctttaggatatatggtttatacagctaggaagatgatgaaagtattgactgggattgagaacagtggaagacgagatgattattgttaccattgctgttggaagggacaatgaaaggaagcaggcatagttcctagtgtcagttttacacatgtaattttgttgtgactttgaggaatccaagggaaaaaagagacataaatttggaagttttttgtgtataggtggcatattgaagccatggattgcctaggaagtgtttaggaattaaagaaagccagaatcaaacacggaggaattcaacacttaagaaccttctaaggcacagaaaaagaaaagtgaaatattgagaatgaaaggtatataacaatgggaaaggaaaaagtatgatgtataaaaaggaggggagtaagtacagatatctttttttattcaatatagttgtactgtttaagaataaaatagggcaaatgttgaagggtgatgtaaggttaagacagtgtgatggctaattttatgtgtcaacttgcctgggccatgggctccccagacattgggtcaaacattattttgggtgtgtctgtgagtgtttcttgatgaggtgaaaatttcagtcagttaaccgtgtaaagtagatggctctccctagtgagagtgggccccatccaatcagttcaagtcctgaatagaacagaagggtgacccacctgtgagtaagagggaatgtcttctgcctgccagcttttgatctgagacattgcttgtttttttgtttttcttttcttccttcagactttgaaacgtcagcttttgctgtgttttgatgctgccagcctttggactggaagtacgtttttggctctcctaaaccttcagcttgccaattgcacatcttgggacttgtcagctcccataatcacataaactaattccaattgcatacacacacacacacacacacacgtgtgcacatacaacacacagacagacatacacacacatacatcctactggttctgtttctctggagaacactgactaatacagaaaggagattttatattatatacatatatttatatacattatatatatataacatatatatattcagatagagaggacttaaatgtattcaatactgtttttaacattttaatgtatttaaatactgttaaaaataatcccattcattaggcttctgggtaatgtggtatgtaattaaaccagtgtatcctgtgatcatatgtccactgatgtacctcctttgataataagtatggccatcagttctatgtaatgttatccaagttctgtgtcagtggatcaaagacttggttacttcttggagagtgctgctagctgaagagatgtgggcaagaaagggaaacccacacctaagatatgctttgattctactcaaaagctattccttccaccttgattgattgattgagtagaatcaataatatcatattggtgaagggtagtgggtgatctcagtgtagcgctcagttgctggaaggttgagatttctacagaggtagtaggtagatcagcttttgttgaacgaggattcatgttttgggcaccatgcataacctccatctctgccagcgtggccacattgttaatgtgtcagtgtgcttatactacaatgtgctcatactacaatggctgatgaaagagactggttttagtttgccaagccattctgtgcactggtttgtttagtgcctcttgcttaccaaattgtagagtgtccataaacttgtatgtctattccccagatctccttgtccccagttgtattagttttctagggcttccataaaacagaataccgcagactggttggcttaaatgacagaaaattttctcataattctggaggctagaagttcaatatgaaggttgcgccagacttggtctcttgtgaggcctttcccccagcttgcagtcggcggccttactcctgtcttcacttgatcaccacactgcttgcacatgtttctggtgtctacttgtgtacccaaatttcgtcttcttataagagcaccaatgatgtatcacttagtgttgggcaatacatttaataaggtaatttgtagcaagtttcagaagtagaaagaacacaaaaaattatcaggaaaacttttttaaaaatctcatatctaaaccaggattttaacatgaatagaagctcttcaggtggacaggggtggcaagcggtcatttgaagcatagggaacagtgctgaatactgtcttgaagttactatgttgttgataaaaattaattatcaatttaaggtttaattacaaggttttatttcatgttaagtttaaatatttgtttttctggtcaataacacattaagaatagaaaattacaggcagagtctattcaagacagccactctaggataagggacaaatttttgtatcccagcctaataaaagagagaaatgagataaactctaaaaagaagatacagatactgatgatgatttgaaatagagggagttatgattgtaaaaaagaaaataagaatatcaggtgattacatggcttttacaattttaggctatttttccatctgtaaagtaaaattcatgttagattaaaaaatcacagcaaaactatacaagataaatgtatgttgacctatggtgtgtgaagcaaggttgtgaaataataagacaacttaccttctttttcagtaagtcgcctacgattatttatttagatttggtctagctttcaaagaaatggagagaaaaatataggttggcaaaggtcattctttttcataaagtgtaacttgaggaataacaactaacatatgtaaaactttcagtttaggaataattttctcatctattatttcttaagatttttattataattccttgagcagacataggatctgacatcattacccccagaaatgctaaataagtgtttaagatctaagcataagtatatggtagaaacttaaagaagtctgactctgactgcaaatgaagtagtctcgtcatcacaacatactgtcttaaagacaagcatgagtttattccagagacaaaatggaaaagttttgcttctaagaagcaaacttgaaacttgaggaaggaattggaaaatgacaaccatcaccacaacaatacagttcattataatttttttcttttgctatgttagttcataatgaaatgtgaaaataattagtgatacttcttatttgctcaatatgtgctagacatgttggtaagctttttatgtgtattatctcatttaatgttctcagtatttccatatagtagggaaaaatgatgcactgtataattgctaagaagtaatggcagtaaaaagaacacaaaattctgacttccaaaaacattcatcttaatgacaatccaagatgaaaaaaacataacttgtcaaatcctaaaatgaagatgtgctgtttgcttaagtaactatcattccgcctaagtttgtaaacctcaacaaaattcctgccttttttagtttttaattttgtgcaagaaggcataaagcagaaatgtaaaattgttacaatattaagaaaagaatgaagggagaagaaaaaaggaagagggacaaaagcgaggaaaagagggaaggaggaagaaacagaggaagagacagagggaggaagcaaggaagacaaaaaggaatctatagttccttctgttcacaatttgtatactacaataatatctataatttagacttgatatcagaaatgcaagctgagattaaaggaaatcttaggtcgacatatttaaaattgctgatatttcactacttttgtttaacaaaaatgtcaatttcctgaagttccaaataatataaatagaagtcataaaggtcaataccctttggtagtgacaactacaagcaactgaaatactttttatcaatctgatcatgaaatatgtaccttaggtttccctggactcttggtagtattttaacatggaatcttacttgatggccttcaatcactctgaggttatcaatctcaagttctaaaacttatattccttaccttgattatgtcaataagcataaatgctctataaacattctggaaatattattaaagagaaaaacagtaaaatatttgtcctcactaaatttttagtttgatatgaggatggcaagttcatgaagatagtgtaaaattgctgaaaacaataagaaatatgttattagattcttatttgaaatatatgtatgggtagctacgctaggttttcaatcctaatacatcaataatctaccaaagattaaatttaatggaaatatgaatttcagtgtatagagaatttcattaaacaatgaacttcattagaaataaagagaatagaggtggccccattcatgcctatccttaatggagctcctaacacaactcacggttactgcaagctccacctcccgggttcacaccattctcctgcctcagcctcccaagtagctgggactacaggcgccctccaccacgcccagctacttttttgtatttttagtagagacggggtttcaccgtgttagccaggatggtctcgatctcctgacctcgtgatccgcctgcctcggcctcccaaagtgcctggattacaggtgtgagccactgcacccagctgtaaattcttaaataaaataaataataaatttaacattgcatatgctaggaatagcatagaattttcatattattgtcttataaatattaagaaaagcttggaatggtggtataagttagtgtgttaaatattctaagctattgtagcccatgtaagcttagagtgacattatgttatattattaaatataaattataaaggaaaaatacatctgaaaaagcaactacataaatatacctaattagaagctgtatgtgtttatatgggtaaaaagcatagtgattgtatgtataactaaatagaacattgatctaaaatatttaataagatgcatgggttttggtcaagcaaagttgaaaaaaaggatgatttttatcacaatagtatatattatttcttaacaggtgtctttaaaggattgccatttaatgccattcaagatctactaagcatcatttttgcatgactactgcaaaaggattactttacagataccagttcctttgtcaagagcatactttggaccctgttttcagaaagcaggtatggttcatctttattaaactgcctataaaattgaaagacatgttgaaaaaaaatataagattcatgcatatccttaatggagctcctaatacaactgctgaatatgctaaagcttaatatgttattttctcaaattaagtgatttgtctttgaattgaaaacaccttgattgtgtcagtaacataaatgctctataaatattctgcaaatattattaaaagtgaaacacagtaaaatatttgttcttactaattttttagtttgatatgaggatggcaagtaactgaatgtggtataaaatggctgaaaacagtaagaaaaacagtactcagatatagcctcctgttccatgatatctttctcaaccgacatataatgtgctagtggatggcttttgtgctttttgtatgtgctcgaattttaagacaatgcttaaagttaaataagcaggaagtcatgggtggagagaggtagtgtcatccccaccagggaacggggatcttctgaaggcagacgacttttatgcagtttgcacaacagctccgcattcttacatatttacgtaaccaacagaaattactaaagagtgattcacttattttgagtgaaactgggcattgtgtaataataatcctttaaaatgaatactctaaaatactttgaaatacatcaatggacatttattatttacgactaagtggcaccagtagacgatcttgaattaaatccattgtgtgctatttaactacaatacttctgatgtactttttagataatcaaccaagaaggtcaatacactatgaatatagaatgattatctttattttctgcttatttataaaatgttgacaatagtgtacccaatttcaaggctgtcacttgtttatcctttaacttgttaggttaatccaggttaattgattcaaaataggagaggagtttcctcatcctactctatgctttcagtaccttcaagcttgaaaattagcattaaagaagagaagttactaaatgtggatgtgagagcagttcttttggaagatgtaggagtctgaagttttaccacgatatgtgattttactttctactagccacactcaaattctagcagctcgttgcagaaaatgttactttccatgtgtcttttattcatttcattaaatcatgccagtctgtcattttgattgcaggccctaactgtaccaggtatctctaaattaatcttgtgaagaaaagcaaccacataaaagaaaaaaatttaaagacaaagtataaagaagggaaggggaagtatctaacagtgaaacctcaaatcatgggaaaaaattgagttccatataaattaatccattgctatattctaacattagacagattgtaagccaaattttgccatcaaagttctatttgttacaataagaatgatttaagaataggttacatacacaaaataataataataatctgtattctgtctataaacgtaaacatcttggaagctgttatttcctatatataaacattttgttcttaactcataatcatggacgcaccttaacaaatcaaactctatatttttttttacttctgagatatctgtgactactagagataaattaaatctaagcaccttaattgaatttagtaatgttagaaacaagttgtttatgatgcttgtgacattcaaagaaagacaaccgaaccactgaacacagcacagcagctgtatgtaagagggtttcagatctaatgctcacttccagatggatgatggataagcaatttgaatttatgctagacacatcagcagatggaaatagaatagagtaaatgtcttggacacctgtgaactggtgcattctatcaattaccaaccaaattgtattaaattcatgtaattcaacagaagtctaattaattttttagaagaggctctttgtcaatctattaataaattcaggtttcaagttgaggatgtagagtgtatttaactgtacagagaacctgtggaatcaggtttggcagagcaaagtgcactcttattatgccatttttgttgttgctccttccaactaattgaaaagcatattggtagaataggaagcaattgaagcaaatgagacaaactgagcactccaaaaagacataagtgaattagaattgatgattctgacaagagtggattcacagtgtcattttaaataaaacgccatttcattcatatacttgcacctaatctgtcactgtaacaactgaaaacattcagcggcaaaactgacagtttcatcttgacacaaccaactcagttcctgccataataagaggcaatatatattaaaagcggtcctgagttcagcctttgagaatgaaatgtttcactcaataacttatacaactcatccaggagacactggctcagctccaagtggaagagctttatttcattagagaagagtctgaatggctctaggtttatagatttttagcattgccaggattctcatcaattcatgaagggaaacctctaagtatcaatgtatgcatctcttagagagtattacagttgataagaatagagtagaatgtgctctgaatttcaaaaataggaaatctaatgttcatctttaaagctcttgacaattacacagaaatttgaagagaaaaaatttctcatatcgtttgcgacataagtattgtgtaaattaacagtgctactacttgctaaaatgtttacagtgtggccagaattgacaaaataatgaaggaaggtggacggagacagttttgaatgaatactcgaaagaatttcttagcaattagagtgtccacagcaatctttcaagggtcatgtgtccagatgaatgaaaagcgtaatttcttatcatcaggaagggagatggaacagttccacacaaaattgttattcaacaacaaaatcctgattaattttgaggtggttcttatagacatctgtgttttactacttgcaaaaattggttatttattttaactacacatatagttttttgtgttttagaaaatattgttttccagtattttataggaaaatttgttatatgaagtataaaaatgcctagtaaggttggacatggtagttcacacctgtaatcccagccctttggaaggccgagatgggtggatcacctgaggtcgggagtttgagaccagcttgaccaacatggagaaaccccgtctctactaaaaatacaaaattagccaagcatgatggtgcatgtgtgtaatcccagctactcaggaggctgaggcaggagaattgcttgaacccaggaggcggaggttgcagtgagccaagatcacaccattgcactccagcctgggcaacaagaacaaaactccatctcaaaaaaaaaaaaaaaaaagaaaaaaaacaggaaaaagaaaaaaaaacctagtaaggtgaaactaaatagaatggcttaagtaaatacatgtataagttggtgtgaaacattgtaatctgaggctgcatgaatttcttggacagcatttatctctatctgccagttatggtggtgggacggggtggttcaagttggatatcgatggattattttcattatcagcctatccataggaaatatgttggtgcattaatattttccaagttgaagttcctaaggagatgtaagaaaactgaatttgcccaaagcaagaggaagaaaaataaggaatatattttagtgtgataatgtaacagatcatataggctttctagtacataaatttttgctagtgtgacacaaggcatccacaggttgaaaacatgcaaacactttcattaatatgaatgtatgcaaaatatctcctatatgatacttgctcagcaaatgttaacatttatttaatatttccgttgtggaaataactcatggaaacagaggaaatatttattttctggagtaagttttgagtataagaaaatttccatccacctctgctcacaaacaagaaatggaactcttagtctgaaggctcagtcacctgaacacctcaaggctgtcctacaacataagaagggctctatctcttcattagatgggtctgaaattcagttcatctctctgcgctaagcttagtatacagagtgaatcccagacagacaaattcttaactagatacagacttctgcttagaaactgtcacatatgctgagtgtattgaggcaattctaacaaatggaaagattataggctttgaaataagttaaaactaggattgactctgtgctgtaatatttgctgactgaagatacttggctgtatctcaatttttataaacctcaactttcatttgactaaaaaagtgaatactatctcatttttgtaagggtgcaaaaagttcacacaaaatcgatcttatctatatctgtacatatacaagcagtgacacacacacacacacacacacacacacacacacacacacacaatcccttatatttaaagcttggtatctgaaaagtgtttagcagatggttattattgtcatagaataagtagcatacatttttaaccaccgagtggactgaaacttactgaaagtctcgtaagacttaaaaaaaaaaggaaaagaagtacatcaggaaagaagggaagaaaggaagaaagaaggaaacaagaaaagaaaggaaggaagggagggaggggagggaggagggaggcaaggaggaagggaggaaggaaagggagaaggaagggaaggaaggaggaagaaaggagggagggaaggagagagacagagtaagggggaagagcgggaaggagagagggaaaggaagggaagaaaatatagatttggcctttgggcattaatatttgcattctcgggctcttgtgggatataagactaacaaagaaaaatgatacattcctatctatctgtcataaatgattagaaaatggaataaaaagagatctcatacataatggaaataatgattgcgtagtattgtgctggattttgggttagtacacagcaccctttcctaattcttgtgctctccagaatgttagaaggccagggactctgataactgtgtttctcaaaacacctgttagcaggattcatgatgaggtgccactcaatgggagatgtacaagagatagggaaaatgtaagagaagcagccacagtggcctcagatgcattttttagtatcatatgcctcagtgctggaagctgtgctaattgctggtagttatctagagttctgcaatgacccactctttgaaaactctcagtcattttaagatttagcagtggtctttcctgtcatttgtttcttcagcttttctaacagtttaaaacaagttgatatctaaatttctttttaattaaaatacctaaaaatttatttttatttttctgacctaaacttgataaaggagatgcctaaaaataaacatacacacacacatgtgcacacacacacattcagacacacacacacatacacacacaaacacaaatatatatatgcaaaagcctactgagatgcataaaaatggagagatatattgtgtttgtagacaggaagactcgattttcaagagtgttaagcttccctcaattggttttattttggtttaacttcaaaaagttaatttagcaaaattaagacagtgtgttttggggacagggtagagccttgcagtaacctttggaagatactagaaagctcagagaacattttctgcctctatgaaaacttgatatacaagtgatgtgataccgaagaccagtggagaaagaatggactatgctataaattgtgctagtaaaatatattactcatcaaaaattaaaataagatctctcagaatgccatacaataaataaattaaaataactatagatagatgtaggacttaaaaggcagaactttaaattttagaaagaagaaattggtaataatttaattacctcaacatgcagaaagatattttagacccacaaaaagcagttaacaaaatgacagaggtgactatagtggaaaataaatgaaaaagaaaacacaattgtgacaaaacaccttggtgcctagacttttaataactttcttttacctgtaaaataataataaaagaaaatatttagcaatcattacttttacatatctgcagtagatcaactttccaagtttgcagtttaacattttagtaaattgcaatgttgtatttaattttttaactcttcctatctctgcacattcagtgtctgactttctagctcttctcagcaaaggaataaaatatacctacttgattcttgactttgggtttagccatgtgacctgctttgaacaattgaattaacaaaaggaatagtataccagctgtgaggtcaggccttaagacacaatgcatatttccatgagccatgttgctcttttttcaccatcaagagaataatgaataaaaagagagacgtggaatagagtcatcccagatgaaacatcccagccaaacccagccacaatcagctgaccttcagccactcaagatgagttaatgataataaattactgttgttttaaaacataaagttttggggtgatttgttatatagcaatagctaactgatagaactattattcacaaaataatttatattccactaatttttgacaactcattatccccaaatatgcattttactttccttcactaatttctctgtttatattttaaccctatctggcatgccctatgctccaaattattccacttttcatgttaaaattaagatcaaatcctactatttccacaatgtctcagtctcatcttatatgaaataaaagaaacatgctgcataataactgatagtatcaatatttgttcttctgcttttattttctatacaataattttaaagcttggtattgtatcttataccaatctgtgccccgataatgtcttccacatagtgcattttaaactaatatttgaagaataaattacataagtaacagttgatatggctgatagtcacggttacaaagacagttttttttatcatatacatacgcctgttttatttacaaattatttctccagattgaagtttttctcttactctattatggtgtacaacaattaagggaaagagagagttaaaatgtaaataaggagaattggcaaccacgcctctacaaatgttaggtcatcttcaagtgatgatctattatcatcagtgacaagatgtcaaaattaggaagcagaaaacccctgcagctaatgtatggtaaattaactaattagtctattagtatccaagatcacactgtaaatggtttccaagtgtcagtatttaccttactaaattttaagaggcgatagccagaggttcaaatattggaatgttatttcatgaatgatataattcacttagcgcaaccgtatttctttttcctttgtaaataaagttaaaatatccatactttcatgcatcgtaatttagaagccgctacctatatatgctttttagtgataatttcatgtgtgaaaaagcataataaattgtccaaaaaacttcccgggtagcttttaaattgcacattgtggcacaagatcagtgtttagtcaaatctattctattaccatgattgcaaatgtcatttgtaaaaagttttatgcttttattttaatgctacatttggcaagctggtatgtttactattcaaacaattttttcttacctaattttcttctgatatgttgaaaatgggaaaaaaagaaacacatttttggatcacctgtgatttaggtgacttttggggctacacttacacatacaataaaacagataggtttcagggaaattagcttaaaaattgtagttgcttatacttataaattctcatgcattctttttgctttatagaatggggaaaatctgcaagacttagcatgaccaccacttcatagacttaatctacaaacaatatccatattttattgaatatttcctactatcgctatgcttcccaaatagattgattacttaaaataataaaacattttataattactttctgaaaataacttttaataatgtattaataatgtatttgatactaagctagcatgtggaatagaaaatatatttcaaatctctgagattttatttggggttaaaaggaaggtgaaaattttctgttgtgtctatatgtcactataggaaatcatattctaagatttcaatgatgcatggcagtggaaataacagagatgaatacaatagactttcccatagactgagttttccaggtcatttaactctctctagtgtcttcaaaactctccaacagagttaatgataacggattgtcatattattgtcctcatggtgacctgcttgggtagaagataaaaaatgctatactctcaaagctatgggtaaaaatatagtgattatcaactcatcaactttctctctctctctctcacacacacacacacacacacacacagtgcattgtatccttttattaaaaatataaattatcaagaatgaaatcaagagctgaaaattaaacaaaaaccaaaactaaaaaggccagcacatacacgccttgagtgataaaaatcctgtcctttgctcttaaaacatctcagactctcactcacaaatacacaggcatctttgaaagcaattcaaacaaattttattgtctggcttcacaattcatgacagggtaaaaatagaatgtgagaagatagatgggcctctagaaatacacacaggactattcaatgaattgagaattgacagccccatagtagcagctaaggaaactgtaagcatattaaataattctacttgcaaagaaactttgaaatagttcataaagtagccaacaggtgggaggatgtggtgatggatgtgatacttatcttaatttgatcattatacaatacacaggtgtattgaaataatagttacccataaatacgtataattatgatgtgtcattttaaaacaaaataaaactttacatacacacacagacacacatacacacatacagtattggactgagccacttcctaagcaatattagtatattgttaattaagtttgtactatccaataaagatagctactagccacatgtggctattgaatccttgtaatggggctagtttgaattaaggtgtgttgtgaaaataaagtacaacacaagtttccaagacacagtatgaaaaaaatgtaaaatattttattaataattatcatttcatgtagaaattataatattttagatatattgggttaacaaaatatattttttaaaataattcttttttcttaattgttactattattttctttttaataaaacatgaaatatagttctaatacacattgtttctgtattgcctgatttgagtaggagttatttgactttctggccctcaacctaactatcagcaaagccaaatagacatgcttgaaacaataatggacattcagtgtattcctcagcaatacttcctctggaagtcgtattcactggcaccagagctgtttcaaccactgcttctaggccaaattggaaaacctataataacagcaatagcaaatattcagcatttgtttgtgaagtgtcagaagctgttctatgattgattctcacagcaacttactagttcaagcttattaatatctctaggaatttaaagcagtgagatcaagaagtaactagttgagggagtttcaaacctctgcaatcttgttctaaagtctctgttttttagccacatctctcttctgccatacagaagtcttcaatcttttaatcctgcttatgaaaacataagttctctggagtcatgttacctatatggtgcccatgctaaaaattctagacattttttataataaaattgccagactgtttttggaagttgctttagtctggatttcctttaggcatacaatgaaaatagtttaacaggaggtgacctgaggaagcaagcagaagtgagagggtagggaaaacaagaccgagaatggagaaaagtcgagaaaggacataataatgagcaggtccacacatgcaagtatatggagcttcatcttgctccagcttcttgtatatcttccctctgaggtttcatacaaaacatacctcagaattctcacaatgatagatggaaagctggggtaaatatgtccctaattaggctcatgggtgagggttgactttagggctgttaacactcagattcctttcaagctgccctgtacttggttgaacaagcctccgtggtgctagagaaaatcttgaggcagagaagcaggatgagactcggaccctcgagatgagacaatgagtacaggaacagtcctctatgcctgcaggtggactgattcaccattgtggactggggcattaacagcatctgctactgaagtgtaattaaaatatagtcagattccctggaaacacagagaatcctacaagattctgtttgagccttcttcagcctaaccttattcttggataaaaaaaaaaactttttgtttttagattgctgatttagcctttaatttatcggaggggtatgtttgtacacagtagtaaattcaataaatgtcaactacattattttaactagtccctctaacactaggaaagttcagtcaaaaatatcaatcaaattagctattaggtatgaaattgtcaaattggttaagagaatgtttcacttttttgtgtgatgagcttatagcttggataaacaacctaagggtataatttgtgcactctgagttgcttgaatggcatggcctcaaacgggtatgccacgcaggaaataatctgttgtggaattccttaaataacatttattttactatttgtcttatatttctaatactattactgtgaaatagtaattctgtgtaattcacagtaatagtattactgtaaaatagaaatattattgtgaaataaaagtgactttttttctatttattccacaattttcttaatgtcttataaactagacaagaataagaaataggcctggtgcagtggctcatgcctataatcctagcattttgggaggctgaggtggtcagattacctgaggtcaggagtttcagaccagcctggtcatcatggtgagactccgtctctactaaaagtacgacaattagctgggcatggtgctgggtgcctgtaatcccagctgaggcaggagaatcgcttgaacccaggaggcagaggttgcagtgagcctagaccacgccattgcactccagcctgggtgacagagtgagactctgtctcaaaaaaaaagaaaaaaaaagaataagagctaaaatgtttactaaacagtagatatagaaagaagatcactatgacagcatgacaattcacaatagtaaaagggaaacatgcttggtgtacagatttttttttacaaatgaccatgttctaaagaaatttaacaagaattttgaagtcacataaggacacatacagagtatttcttcatgccttttgaagctagaaggggaatcagtgtatttcttaataatttttctctatatcttgtcagagaagggacagtccgttcaattttttcctaatattaaggtgtatgtgaaatgaagataagcataatcttagaagagacttttgaaaaacatgttgtagctgtggaatttaagttaatttataaatattacagttaaatagtgcagagaccagctcggtcggggagaccctaacccagcagcgctagaggaattaaagacacacacacagaaagatagaggtgtgaagtggaaatcagggatctcacagccttcagagctgagagcccggaacagacatttacccacgtatttattaacagcaaaccagtcattagcattgtttctatagatactaaattaactaaaagtatcccttaagggaaacgaagggataggccgaattaattgcagcaggaacacgcccttaagacacagattgctcatacgtttgtttgcggcttaagaatgactttaggtggttttctgccctggacggaccaggtgttccttgccctcattcccgtaaacccacaaccttccagcttgggtgttatggcgattatggacatgttacattgctgcagagattttatttatggccagtcttggggccagtttatggctggattttggggggcttgctcccaacaaaatagtaagttacatatttttccgggactatctattattttccacttgaggctattcaaagaaaaaaatgtataagaagtctttttttggaatattgaaagtataatgtcagtagttatttctatgttctataaaagtttaaaaaaatcaaagcagaataaatctgtactaaatgttgttttctttactattgaaatgactactatcacattaaaattggaaaaattattcaactataggatatttcagagtattatatgccatattacatgctttagtttaaattcataaacttatttgtaaaaattaaattgctgtaaaatagaaaattaatttttctatatatgtcttttggaagtggttccttccatttacattagcattataagtaggtgttaattttatactgttatgaacacaaagcatctttaaatatgcaacacaatgaaatatctgctatttcattcaataatatctactcatttaaaaatgtttgacttacttatctttccacccagcctggtcaaacagctctatacttgagtctcattctttttctttcataaaactgcttttattgaattgcattttggtctttgctatttatttttattgaggggcataataagattcagtaatactcaaatcacaagaatgagtagggcatggtgtccaccatgtctgacagggttccattagggggttggaacagaatgaggggtggagaatgtctcttttttcttacggcagagaacagttgttcgttttggggataactttttttgttgctgtttaattttattttgttgctatttttaacattcagtgagaaccagggtgtgtatttattttaatctccctgattctgtaaaataatgtcatttatagtatttcattctgctttggctgatgtgaggcttaaaatcaaattaaagccaaaatgggagccaagaaactgtactaggttttatgatgtcttccattttcttttcttattggtattttctctatttgtatatgctcatttattttatttgcttattttgtttatatttatgtaaattgtgtcaactttagttataaaatgtgttaaataaataatctaggaaaatcattataacatcttttttctaattttctaagagttttgttggtgcttaatcaattttatgtattttgttcattcacagatatatatatatatatatatatatatatctgtgatatatatgtgtgtgtttgtgtgtgtgtgtatatatatatatagtgtccattatgagtgaactagaaatatagccatgaatcattttattagtccttatccctatagataaatgctgaggggatggataccccatctctatgatgtgcctatttcacattgcatgcctatattacaacatcttatgtactccataaatgtatacacctactatgtacctacaaaaattaaaaatgaaaacattaaaataaaaaaactttatccttttgaaattcactttctagtatgaaaataaaggtattaaattaatgaataaattaaaatgcaaaatatttttaagtgatgaatgtcttggcagaaataaatctcagttaaagggatagagaatgttatggttgggtggttttttgctttcgtttttctgggagattctggaagacctttttgctaagccaatgtttgctctgaggcataaagaatgtaagggtgccagtcatgtggattttttggtgacagaagggacatcaggtgaaaatgtcctgaagtggccaggctcagtggctcacacctgtaatcccagcactttgggaggccgagacgggtggatcacgaagtcaggagatcgagaccatcctggctaacacagtgaaaccccgtctctactaaaaaaatacaaaaaaattagccgggtgtggtggcaggcgcctgtagtcccatctactagagaggctgaggtaggagaatggcgtgaacccaggaggcggagcttgcagtgagctgagattgcgccaccgcactccagcctgcgctacagagtgagactccgactcaaaaaagaaaaaaaaaaaaaatgccctgaagcaagaatgtatttgattggactagagaagagtgagtgagatggagagtgaaaaaagtgagataagagagctggtaggataaaaccaaaatcattttttagaaaaaaaaaatacatcagtgtgagatattgtgtggactttggttttcaccctccgtaagggtatatatagcaagctggtggagagttttgaattgagcaatgtcgtgatttaatttacattttaagcaattattgatggattagatatgacatgtaagaaaagggaaagcataaaggacgatcccagtattttgttccttaggaactagagggtgggagttccctagacaactagaaacaagattcttcttgttgagattgggcaagtgtcagagaaagcagtttgggatgggaagattaaggagatcatttccagacaggtgtggggtgcgtatttgatatactagcaaagatgtaaaatagttagcaggacatataaatttggagtataaggaagctgagttgtctggagatataaaattgaaagtctgcactggtgtgtctggcaatactccaaaagaagacaggaaaagtaaggattatagggaccaaaacatagattacagagatgtggataattaggggggaaaaaaaagcctgagaaggagcagctacagaaattgaaagaacaagtgaagaatggtgatgtagattataaagacttaaggaggaaatgaaaagccatgacaaaagctgctattggttagataagaagttaggagtgactttttatttgttttggtgttactgttacttgctaagagcttttgcaatggcgtagaagttatggttgaactgaaagcctggtctgagtgcctttgagatcaaacggtaggagaaaaagcaaagaaagcaagtacagatagatttttctctaaagcaacaattactaatagaaacaatcataaaaataattctataaaataatttaatgaaagtaattaattgcaaaagctatggtattacaattacataaatctacattaaacatattcatgaccacaaaatataattccattgattttcttagaaattatattttcaggctgctaactgtcaatattttgggtaaacttttctgcttgattctgctgcttctctaatctcccccattttgaactgcctggttaaacagtaattcattaaaggtcatactttgggtgaccgaaatacttgatatcttataaagcatttgctggcaaattttattattatgtttgcatctcataccttttgtaaattagataaaagcctaacaagagatgaaacaagaattcaataccatcttgtaactggaagagaggcttctctatgaaagtatgtttattctaatgaataatcatagcaaactgaaataatttaacttctaatatcacaataaataaaacattgaatatttatttaaaatagatgtaaatatgtattacaaacaaaatacaagtttccctaaatgaaatatttggaatttgttttcagactaaccacatgtgaatacaaatagtttacatatataatctcattttatattatttcaataatttcatagtatgcctttttgaagcattaaaacttagaggtagtctgcaagtatgaaattatatggaatttgtcatcaggaagcacgagtttgaatcccaattctagtaattcaaactgcatgatttggagcaaaccttcattttctcaggttcttcacctgtaaaattggaataatcagaatatttaccaaactggatcactgtggaattcagtggaatgtgctatggtcagtaagtcacatgtcttgtactctttgtggaaggggaagtatgttatctacaaacaacaaaaagaggaaaagaaaagaaaaaggacaaacttaaagcttatatttaaccttacaagaacgttttttacttgaaggtcattaatcagtctctgttaagttattgaggagacaaaattccagtgatagaaaccttcatgaacaggccttgagtccagtttcttgaatttgcaattcaagaaaaattaaatgacaaaccacggctgaagaaaagtactgtgagagaacaaaaatagtaaagaaaacactgatgtaattagcatccaaggaggaatcactacaataatccagatttgaattctaataataaaagttatgatttaaacttgattcaagagcatcttggcctgcttaataaaataataagctatctaacatatctagtaataaatcagtgtttatttgtcatgctgatcttttccatatttaaaaatagtgttagtctcagaaagatatggaaaaaatagtcttaaatatcagaagcaaacattttacttgctatttgtaaataagattttacagactttaaaatattttaaaatttacaatctagtgtgtgtaatttgactcattgccacaaactatttctcataacttgattcagagacaactgtgtgaggagagggatatatatgggaaacctgaatcaatgctacaatgataaacgccaaggcttttacctataacataaaacaaagtaggacaatcattttaaaaattatttatttttttataaaatttgaaatggtgtcattttattatttaagaagcaggcaaacaggcgtagtgactcatgcccgtaatcccaacactttgggaggccgaggttggtggatcacttgagtccaggagttcaaaatcagccagggcaacatggcgaaaccccgttatctcaaaaaaaaaaaaaaaaaaaaaaaaaaaaaaagcagggcgtggtgacacgtgcctgtgatcccagctaagcagctaaggtgggcaggatcccaggagatggaggttgtggtgatagtaccactgcactccagcttgggcaacagagggaaagcttatctgaaaaaagaaagaaagaaagaaagaaagcagatggatattagtgcccaaattcaagtgttattatactgtttatttttaggactataaaaaaatctttggatacaattaattagaaccagacaaacttaaggtgttgttctagctgagatattagtaatattactgagtctgtgtagaaaataacttcaatgatggtcatttgtcatcagattaaaaaaaactgagatatacaaaacaaaaaacaaaacaaaacaaaacaaaagacaaaattttgtaaagtggaaagggagcattagattgctatcattcaatagttgtgaagcttggatccagaatagaggatgctgcagtgtcattgtgctcttttcttgtcaggcctcatctggaagagaggcaatagcaagctgcaggtggctggaaagagaggagggatgacgaatctttatcacctgggaaatgatgaaagaaattgaggatgtgtactctggaaagcagtagatttagacagacacaatatgtatgttctcagatgtttaaaagtactgtcatgtggaagatggattagaataggtatgtgttgctccaaagaatagcctgtggaccaagactagctgtcagaaaggtatttcagctcagcatgataaaaaggtttctgactctgaattacatagtgttagtgagtgcttcattataagacgtatcctgttctgaaaaagtagactaggtatgatatccaaggtcacttctgacactaagaaatctttgatttttgtgaattaaagtatattttaaatgtccattctcagttttagtaaaaagccctgtgcatagttttaagataatctgaaaaatttatattattgtgttatacgtcgatctctgtatctataccttctaatatgtatctatcttttaaattctgcttaaagcaagctgctttaaaatttttcaaggagcatttttgaaaaacttatattcttaaaatgaaaaactcataatgaccagtcattcatttaaaacatttgaccacatttcgacctacaaaaacagcagtttcatataaatcaatcagatactatgggtcaaataatgtgttagaggtgacaatgaaacagggcaagtaaatgtgtaattacatagagtgtgctaagtgaaacaaaaaaaaatttacagacgcttgtgaaagcctcatttacattcataaaatgtcatttcaagaaaatccaacatttgaaaatgataaacctaaaaaatacaatgtgactatttataaaatagccttctcatatagagataatacctgataaatttaattgccaaacttacgggaagacaattgttttgtgactaagcacacccagccccacatctcctcaacttcaaagtgcgtaagttttcggtagaaagtctatggcacgaggaagctttcccagttagtgctaagagctttataaggtaggattttgtccaccgatagatcgataacttgctgataagtaaaattaaggatctgtattttcaaaaaccttttaccagacatattttggaggaattacctttctcattgtttacctcaatccttagttaactgaaaagaataggaaaaaaattgatcctcactttctttcaggttttgattaaagctgtcaaaagagattcactcagaaaactcttgttactaatcacacattgtttcattttttaaaaatcctgatctgacagggtcttcatactaacgtttatctattatgttaaaaataacaatttttattacattaagatatccatcttttgaaaaatagatataaaattttttagttcaccacttttctgaaaaagaaagtgaagataaatacatctaatgtagcaaagcagatcatataaataagagcaaaataagtaaatagaatggctatagggtaatagaaaaatttaaatcaaatgtcatcagtgaagctcgtgatctctgctccgaaaagcatcaaaatgagcagcacactgcttggtgatctgcacagacaaggggtgaaatgactgactttggagacccagctaagggagcattcaaaaataagaaaagtatgtttaaagaagaaatgttacaatgagctgtaaggccccttaaaatctagttaattgcttgttctccaagaccatagtatattttaagtcactacccttacaagattagacatttctggacctcttattgggtagacaaaagaaaagttggaaatgtgtagctttctgcatctgaagggcctgtgatggaacagaaaacataatggacatagtcaagacccctggacgtggaacctttttctcaggccaatatttgaattactcccacttgtactgattccaagtgttaaattactcaaaagggaaatttaggactcctgtaaagcaagcatataagccatatgaatacatatatatggaagtatttcatatttaaaataaaacatacactcaggaatactatgaaaacataatatgggaataatattgctcatatattagcgctcagtattgtttttctaatgaattatacactgttgttgagggggatataatctttttagtgacgtaaactgaatctaatgacttattaggattatgtggtttactcagtcctttcctttcaactatcccattcctatcttcacctttgtacacaggcatcttaaaggcaacttaaaataaatatatccaaaccaaaacttatgccctcatccctgtggtggattgaaacatttttctcaattcttaaccttgaagcacccaatgaggaaggcgttatcactcaaattttacaaaaaaggaatatgaggttaaaagaagcaacatgtaccatgtcatataacaataatagctcaagatcaagatttgatccgatgtctaaagagcgttaatacctgtgttttccatctgagaagatatgttaagaatgatatgcttggaaaagactttcagtcttagttctattaaaatgtagattatatatatttgttgctatgcatatgtaaattattacttaattttcctcagaataactgtaaaatatgcctttcattttgtatactttctcctggcccctttgaaatagaattattaaaaattgattgtatttttcccaaaggtaagagtaagtagaaaacctcaagtatttcaatcaaaaatttcaaaacaaatcaaaagatacatgagagattaattacatacattaatgcatatttcataatattgaaggaacaaaataaagatgaaaaatagttagcccacattcacaccatgctaacataatactttttaaagcttgtgttttctttcagtttttgtccataggcgtaaattcctatcattattatagcacagatctaattctatatttgactttttcactccacattatgtcatattgtgtgaatactgcctctaaatattgacttccaatataaagtatatagaaagtcagtagaggtgctgagaggcaagcaataattctgcttaattgatgatgatcaacaatcgattgattatcaacaaagaattgaattaattttgaaaatgtaatgcaaaaattgtgaactaatgtattttcaaaagtgtctatatggtattgcaaacacctgcctttcttctctcatctccaccaatactcagcctgttttgtgtccagaaggccttgatctcctcaggcctggtggcccttgtgacagggattatgattacttcgccatccctggagagagaagcctaccgaggtctccactactgtggtggaggaggtgtcagctctcccacaaggtgtaccctgctggcaatagtcacagctccagtaaggagttgaacctcaccagagcagggtgcacttgtgactaagaaatagctgatatggactgaatgtttgcatttctccaaaattcttatgttaacgcccttattcccagtggtattatatttagagatgtgacctctgggaggtaaggtaggttagaataggtcataagtatgaggccctcatgatgagattaatgcccttatgaaaagaggaagagacacaagctcgctctctcctgtgtgaggacacagcaagaaggcagccatccacaaatcagaaaggaaaccgttaccagatactgaagctgctacacctttatcttggacttcccagcctctggaactgtaagaaataactatttgttatagaagctacccaccctatgatattttgttatagcagcccagactgacaaagacactagctaaatgtcattgactgatatgagacactatgttgttttgtatgcaaaatctcatttattcattgtatcagatctgagaggcagagagttttcatgttcttccagagtttttacatctttggcttaatatccctgattccttcaagtagtccttgtgtcccagagtttcaagttcaatcacaatcctggttattctctaggccatgtctttatgctactgaaatagtcctgtcacgtggatagttgtggattctaggaaaatctctgccttttgtgtttctatactagcacaaaaagattattattatcaaagggtaaaacaatgacacagggcgtgggaagtgttataaaacttccaaacaaagaaaataaaggattttatgaatctcaatgtttagcttctccactcactagaaacaaaagtaattaatataataacacataaactatatagagaaaaacataggctcaaataacataatagctatattaaaatttctttgttttcttatatctaataagagaaagcacatatcatatcacttttcttaggctgttaggcagttcagtcccacttttcatgagtctgacctgatttcaatttattttgcactttaattaatggaaaaataagaagggaggttaagaatatgtgtaacaagggtgcacagtgtgtttagtatgcgttatttgcatttttttggtaactaaatgacaattctaccatgatattagccccgatatttttcgttctgaggtgggtaggagttgtttctgtcagcagaactcctgctaaatgattcactgtcatttctccccaatataatgtgctattaataattttctttactaaaaaggcactactctgctattgaaaataagttttgtatattactttaaaaatacgatcaaggtgtaaagtttgttgtaggcaaaaatattctgcttcagtttttgaacaaatgcatttgaacagctgaatttgtttctttatatggttgaattatcattaataaataatgttatttatttaatgaaaataattcattagattactaacaaattaaatttaaataattgcacaaaagatcactgctactagcctatcttcttagcggatcacgaggtcaggagatcgagaccatcctggctaacatggtgaaaccgcatctctactaaaaatacaaaaaattagccaggcgtggtggcaggcgcctgtagttccagctacttgggaggctgaggcaggagaatggcgtgaacccaggaggcggagcttgcagtgagccaagattgtgccacttcaccccagcctgggcgacagagcgagactccgtcccccccaaaaaaatacactagaacagtcttctgaagtaattcaagtatgactggttgaaactttaaggcctagaacatattgataactcttctactaccatgtagttatgatatttttgattatattgaaataagtctgctgaggttaagttcggtaatctggatttaaggaaggttttatatctaagcctgccaactgcaaatggagaaactccaacctacagactgccttcggatatttttttaactccttagtttaatcacttcttctggatagatggcatggtcccaagatccttcagatccatctaccaccagttagacatggtctactttggttcagataatcttaagtttcttaattttccagttgacagtgtgtatgtgtgtgtattatatatcacatatattataatacatgtaagatctgtggttttaaatcattacttttagctttggaagactccttggtgtgcacagcactaatataaaactctcccctgcaatgtcacccagtggtgcctaagtgctccatgtgttcaatcattgatacgtgcattccacaaatacatactgagcactctgtgccaaaggttcactatagcaggttcagtatagccaaataatgaaacaagcaacaaagatccctacggtcacaaagcttttattctagtgggtgatttcaaccaacacacaaaatgagtaaataaattacatggttattagatggtggtaagtgctatagagaaacgtgaacaagaatgcagtgatctgggtatgagatgacaatcagaaacaccatctgaaaagctaatattagtctatggccagaccaccctgaatgtgcccgatcgtgtctgaaagggcaatattacagtcacaagctgaacaaggggaagctttcctggtggaatttaacatatgcttatgagaaacccaaatttttcaatactcctccatagtcatgctataaatttttttcctggccgtctgccagaaaatatctggcagagatatagatagattggccactcttctccccactacccttaagtgaactgctgttcagctccatggcatttatgacagatttttttcccctggttttggtccagtttcttggcaagctgaatttaatctgacttagtccttacgttcccattgccaaggtacacacaacatgtttgggcatatggtcttgtttttatgatcttttaacctttatttattataaatacaccatggtgtaatggatcatttgggggaattgaacacttggaatgacagcaggtccggttgaggccatctggagatgttagaagggagaagtttgcttccttgtgaactaaacttttaaagggagttaaataaaattaactggaaaacttgtgataaactcatttaagaacaggatatggtggcatgtaacatagatgagtgggttgaaggatggataagaatgtgataaaacaaggatacatctctattctggaaactaatattctagaataagccatcagtttcctaccactgatctctctgattttagaaagaagatattctaatgtgtgcaaaaatgttgtcattttcttttcattttagacgtggacatagtgttctcacagcctacctatatacataattagaatgaaggtgatagaaggttgaaaaaaataaatgtggaagaatatttttttcaagttatattgccaactaaagtcccttttaatgtttactttgtgtgttttgatggtgagctgtctcctagttataattaggagttttatttttaacactaaaacacctttaactacaatgtattttagcctaggtgactgatgtactttcccttccctagtatttttttcaccttttaataattgctatgtatatgaaaagtaagcaaattaacaacggaatgcctaaaatacaccacctgaatgcctaaaatttttttaaagaatgaaaacaccaaatcctggcaaagattttagatgttggaactcacattcattgttgtggagactataaaatggtctaaccactttagaaaaactttgtgcgtttacttataaatgtaaatatagatatgcactgtgaaccagcaatttcactcctaggtatttacccaagaattataaaacatatgttcacaaaaatatgtgtacgagaataaccaaagaaagtttattcataattacctaaaactaggaagagtcctgctgtctgttaaaggtgaatggataaacaaattgtgatatacacaaaagaatactactaagcggtaagaaggaacaaactactgatcatgtaacagtatgagtgatctcagaaacactgtgctgcatgaaggaaacctcagttaaaagagtacatacagtgtgattctatgtctatttagttcttgaacagaaaaatgtcatgtatgataaaaagaaaacaatcagaatagtggcaatctctgaggatttcggtaggggatgattgagaagatgtgtatgataattttctgtagtgggaactaaagtgctttgaaaatcccagcagaaatggattttactagcattttactttgaaatatgcaatatttattaagttagttcctaaaaccaagcagaaagaattccattttatgagagcaaatggacccagggaggggatcatcacacaccaaggcctgtgggggtgggggcctaggggagggataacattaagtgaaatacctaatgtaggtgacgggttgatgggtgcagcaaaccaccatggcacatgtatacctaggtaacaaaactgcatgttctacacatgtaacccagaacttaaagtataataataaaaaaaggtccatttaactccctgttatactagtaattattgaactctattgtgtactgatatagaggaagccaagtactatcctaaatattttgcctacattgctacacttaccactcccaataccgtgaggtgagaattattggccctgttttgtagatacagacactaatgcttacagagtctgaacaactttccctgccaagcttgtgcaggctctgtgggatggaactgctgtttaaattcaggcttgcctaactcagaagtaatagttgttgtggtatacaaattcctccttctatgcttacattttatgttcctttcattttaaaatccttcctctttcatctaatttatagtgtttaattataacatatataaaatacctaagcattagtattttcagaaataaatgatggtataaacgattaaaaacacaaacataagattcctaatttggtcccaatctacctatacagtatttctcttcatgatagatttcccaaattgattggaatatttaaggttctccagtgaactactatataaatcaaatttgaaaatatggagttcaatgttactgaggctgtcatctgagtaggaaatgccaaaagattacaaccatcttttttgttctcctgccaagtagactaggcatctgccaaggaacctcagatctccaatgaagcatagttgagtttgaaaacacagagttaaatacccactgtggctggaacctgattagaacgtaccaaagggttataagattttttattcttctgccaaatcaactttgctcctgcccaggaaattgaaatataaagcagatgacattgacaagacaaatgccattaatagaaagaggtatgtaccatgcatgtacaacacagattaagacagtaaatgcccagcattgaatgaaactagaaagtttcgaattcttcaaagtgtcagatttgtacatgatagctgtgtgaatatccaggaatatgaatagacctgagtgatttgtggaggagcctgttgttgttcccacaaagactgctttctaaaaacctgtggagtgacctcacagcattaaaaaggcagtctgcaactaaatgttatctatttaggatgcctattagagccaaggtattttattctgtaaattggctgtctcattcatagacaggtattttgagagtattaatgcagttgaaatggtttttatggttcctttccttccccatcatatatttatttttctgacttggctcttataatttacataatagcaaacataacttgtgtaggaagacagaaatttaatcatgatgagtcaaacataccaaaattttcttttcttttttttctataactgatctcatgttgtttggagcccctattcctaaagttgaaacaataaaaacaataagaaaattaaacttgccaagtaaaacccagtcttccttactttccacaatttctgtgtagatagatattcagttagctcacagaactccctagcaggcattatcttcccagccaagaggtatcatctttcattattcctttccaagattgtctgggacaaggtgggagcttatataaccttgtgttgaaaagggaagaggaaggctctggcctacgtgctgtccttggggtcaagggccttgtcgcacttgtcaacatcacttctagtcttagttgccaagtgtcaacacctggcacaaccctgagtgtgttttcctgactgtcaatgcatagagatggctgtctgcctcactgaccaggcaagccagctcaggctctcccttataccacagatcctttgagagccgggcggtgaatctcttgtcgttcctttcttctgtgccatcattagccacctgccacttgcccctgccacttgcccccatagctccagtaaacttaaggatttcctataagccctttcagacagggaaatagaaagacactatacaaggcccaatctagctatttctctccagcagtactattgctattttcaagttactcaataatatgaggaaaaggcacaaaggcatcttacctgccttgaccgcctataaatcccacgtttttataaagtattggtttctcattcaaactgatgtaagtgtacttcatttacatttatgttccaaaaattattagtagactacaaaattttttcaaaatagaatgacacagggaattctgggtgcttgagtcttgatccagttgagtgtatgcttgtccaaactagtatttgggaaagtaagagcggggaatggtaattttgtcctggcctatccatatgtttcactgtaccctgcatttacattgtatttgataattttgagactgatggagtgcaaacaatccagttgctactatctccagcatatatctagaaaagattgaatcatggtcagatttaactttgcatatgtatggctaagtcaaaagaggagggcctccttcacacaggcttaccatctataactcagttccactaatgaggatagccaggactaccaagacatttgcagatctgttgcctaagaatgaggttaatttctctgctgtgcatcctgattgtcctgacttttttcttttgcctttaaataaaccttgtttgattacccacatcatagctgtgtttgcactcaccatcattttgaatatattattgacatttgtccatacagtggtgttcttgtttataagtaactgctccaaagaaaaaaacgtttaccccacgtgaaggctgttcctcagttgcttggttgatttagggatatgtgtagtttggccagattggcatgatgatattttgtcaatccagtagatggtctaaattcatatgctatataattcatagcatttttagcaatcttagcgcatcctaagacatcaatcaaaaggaattaacgtgatacctcccttaactacaggtttcttaagaataattaatcataattggctttctctcactccacaattatgtattttcaatatagtaaatgctcatttagtataacatgaatgctacattatgctacatgaacccacataagcatgaccagataaatcacatgctatttaaagtatattaatacacctgtgaaatatagtgatatgctgccaatcatcatttgaccttagaataggggttgggcatgttttcagtgtagttggtcatcaattaagagttcccgggaccttgtttagatccagataagcctaaaattttttgaagaagttctttaagtccagctgaaactggagattgctataaggattttaacacattttatagatttatgaaagacaacactagtcagttgaaatgcggataatttttctatgatgttgtaactggaaataataaaaagcaaaggggagacatcagcgacccctctttttctcataccccgtaatcagtgctaagtgaattttaccagcataacctctaacatattccacattatggtggctgttcaccctctgcactatactccaaaccccatgatctctctcctgaaaaatcaccacctaactggcctccctacttccaccattgcctccctggtctagtcatcttgaagcagcaaaagtgattctttgaaaatacaaatctgagtataacagttccatgtttaaaaccctgccatagctgtacatcacacaaagtaacaagcaattcttatcatggcccagagaaaattcacaatctacagtttctggcgctctttccatcctttagccctacccctctctcctaaatactatggacagacaggcccccttgcagttccttaaatacacttatctcagggcccacaaaactgctgttatctctgtctggaaagaccttaatcactggtaattttgtggcttgctcccttattttatttaaatccgttttgaaatttcacctcctcagatcagactttcctactgtgttatcttaactagcacactttctactttccattgattgtaacatgtttcgtttttcttcccttgcacatatcaatgcatgtattatttgtctgtttactggatgccttgcctgatactacaaatgcttcataaagtcagtaattcttttttgtttcaatagcatattgttagcctatagaacatatgtcctcgaatactaaacaatgagtaaatatatattgaaataaatcattaattaaagcataataaaatggaccctgtgctctaagaaatctctctgggaccagtttcacatgagaccccaaaacaaggataactttaatccataagacccctcagtgcaagtagaattggattttgagccatagtgccctgaatttggaaaggttagagctgcagagtctttctctttgacacacaccacagggcgttctgtggatgatggtggtggaggggtggtgctgtcatctagaaaaagtagagtgtttttgtgctcatgcttgtgataaacattaccaaaattttgaaaagtggttttcttcaatgacttagtatcttaatcaggttttagctcccaggtacctaagtctcctatgttatgggtgacccaagtcctttttagacagcctataatatcggccttaactagtttattgtcctcatggtcacaaatgcatctgtcatggtttttttttgttttttttttttttgttttttttgagacggaatctcgctctttcgcccaggccggagtgcagtggcgctatctcggctcactgcaagctccgccacttgggttcatgccattcttctgcctcagcctcccaagtagctgggactacatgtggccaccaccacacccagctaattttttgtatttttagtagagacggggtttcaccatgttagccaggatggtctcaatctcctgacctcgtgatctacctgcctcagcctcccaaagtgctgggattacaggtgtgagccaccgcgcccggcctctgtcatgttttatataattccaatacggacattttttacactatatataatgccttaaccacccccccccaaccaagttttagtgtggcttgtggggtttctcaagttagaaacaattttaaacaagtacacttctagatctctacaaatcatatgtgaccatgtatcaaactaatcataagagtcactctttattgagcatttactatgtgattgacactcagcatttaaccaggcaggaggaaaagcataatttctgcttcacaggtaagaaagttggcatggaaaggcttatttatacagtatgtacaggattgctcagtcaatcttattagtccacactcatatatttacatacttttcagcagcatctttcatgtataaccctcctcaacatcatcaacaaacacttttgaacacctacgttgtgcagtgcaatgacttcgtttttcaaacacttaactggaagaagtctgtccattattctgtcaaccctcttagagtatatttacctttaataacaattccagaatgattaagagtcaataaatataattctgctttttaatgtataataaaacaaaatcacatttgatgaatgttcctaggaatacgaaaaagaaaatagaattatatttagtcaggcatattaatagaattattattaaagtcaatgggatttctaatttggcagggtttgattcaggaaataattaggttctgtatttggaattaaactgggcttctatttttaaagattatcttaccttaacaattggaagaataaagatctttacttaaatcagtgaaaaacatgtgtatataacaccaagtgtcatgattgtcaagtatagaaaaaggaaactaacaataattaagcaaccatttcatgctaagctcttaatttatttttctttagtataatgttatgcaatttaataacccagtaaggtacattttaatacttttattgataggtggcaaataaagagcctaaggaatttgatcagggatgcttcgctggtcaaggatggcagtggcgtttgaactcacagatatgcgcttttaaattctctcatattactaacaccttgttgcttcttaaaccttatttgcctctttttaaaattctcagacttcaatattcccctagtattcaatatagccaccagcgtatacctgagatccaatagttattagcaactgaaatagcaaaagggtgagttattcgcttagagattttcttcataactgaaattaaataacaatattatatacttgaaattacataacaatattatatacttgaaattacagaactcctttgcaagcttgaaaacacacacacgctcctccccacccccaccacacacacactctaaggtttattttcgacaaaataactaacacagcattgataatgataacagagagaagaataatcctctatggaatattaaaactcagaaatggctctatagcatatgcaaaataagataataaaatttcatcacagtgagttttggctcacttgtagaaatcagatgagatcatgtgaaaatggacaagtgttataataaatttaagttaacactgctattcttacctgagagtagagaacatttacaaattaggtatagaaaattaggttatttcacttccgctcctgcccccacctctcatctgttatttatatctatatgtgtccaatattaagactctactagtgtctcctttgaaacactttcaacctgtagtcccagctactccggaggccgaggcaggagaactgcatgaaccctggaggcggaggttgcagtaagccgaggtcgcgccactgcactccagcctgggcgagagagggagactctgtctcaaaaataataataataataaaataaataaataaaataaaattcatcataagaatgaaattgaataataaaataaccttcacatcaaatgctctaccttttcactagacagagtctcgctctgtcgcccaggctggagtgcagtggcgcgatctcggctcactgcaagctccgcctcccaggttcacgccattctcctgcctcagcctcccaagtagctgggactacaggcgcccgccaccacgccctgctgattttttttttttttttttttagtagagatggggtttcaccgtgttagccaggatgatctcaatctcctgacctcgtgatccgccagcctcggcctcccaaagtgctgggatagcagccgggcgcggtggccgaaaccctgtctctactacaaaaaattagccaggcgtggtgatgtgcacctgcagtcccagttaccagggagcctgaggcaggggaatctcttgaacctgggaggcggaggttgcagccagccaagatcgcgccactgcactccagcctggcgacagagcaagactccatctcaaaaacaaaataaaaataaaaataaattgtcattcttaatttactatgagtttcaggccaacattaacatgagacaccaataaacttaaaggacactgaaaatcagaaggcaaatattatttcaaaattaaatttaaaaaattcaggtgacaggacatacatttatttttaccaagtgctagattatatatggctacatagaacttcagacattcagtttactaatattacctgtcaacattgattatttgtgttattagaaaattagattacacctaggaaactcaaacccctcagaattatgtatgcaatgattgaaaatatttcttccactttataggaaaaaaaagtaaagcaaaattaaacaaaaacaaattggtctgtttattcatttaaaaagtagaaataagttctaagtggaaaattttgttttatatttcagtgttacatttcttgttgaacattttcattttatttgtagtttcatcacacaattcttcaattacccctaaaatgcagttgtaaagtgaaaagttatattgtattctctacatttaaaacttttcaaaatgtcaaaatttagattttagagccaattcaattgcagtcattttcattgaaataaacaaatattgattacacaatatttcccattcataaactttttaaaactgtaaacggcagtacaaccaactctatatgtccttataaccttctatggtggaatgggtgaaaaaagcataagcttccctcaaaccctttttctaaaggcactactcccattcatgagggcagagtcctcatgaccgaatcacctctcagagaccccacctcctaatactatcacctgagggttaggtttcaatatattaattttagggggacacaaacattcagaccatagaattccatccttggctctacaaaatgtatgttcttcttgtatgcaaaatatgtttattccaccctgttagctcccgaagtcttaccttgttccttatttatatatgtaaattaccttattatatatgaaaaaatatattatatatgaataaatatatttatttatataaatatatttattccaccctgttagctccacaagtctacagtccaaattctcatctgaatatcagctaaatcagatatgcatgagtctcaagatatgatttattttgaggcaaattgccttacagctgtgagcctctgaaatcgagcaagttacgtgcttctgaaatgcagtagtacgacaagcatacaacagacattctattccaaaaggaggaaatcagaaggaagaaaggggtaactgaaaccaagtatatatgaaaaaaacttaaaggcagaatgaacaacttggattaaaaatcaaagtacatgaggggatggattcctcatttgccctgatgtgattattatgccttgtatgcctgtgtcaaaatatctcatataccccataaatacatatacccactacatactcataaaaattaaaaatttaaaaaatagacaattaaaaagaaaacctacagggcaaacaacattaaaccgtaagacttgagaataatcttctttggttccatggcccaccttccagacacagtggggcaagagttggacccctgaaggttccagccagccttgccactttggctttgctggaggcagttcatgtagcagctctgacacattaaagtcacatgtctgtagcgctcctgggctaaaatttcatactgcatattagcttctctaatgttctggggtctcaggagcagttctccctcttgaagctccttaggggattgctctagtgggtctgtctgtagcagcccccaaacctgtgggagttctctgttcggctccatggctctccagtgagtcctttgaaatataggtggaggcagccatttcttataattcatatactctctgcaccagtggagatggcaccacacatacattaccaaggtttacctctggcagccctggtgaggtagacactggcctggagtgcaccttggcccaatggagtcatacttgagttttgcctttcgtcatagttttgttccccaggccttggcattctggtcctgggaagggagtggcagctccgatgctctccaaaatgctattgtggtccctcttctattgtcctgattagtagcatcaggcttccacacaagcatactaatctttttatcaaaaggttgcttggccacacccttggtgttctctcctgaacatgcttttattcttcacaatatagccaggttgagaatatttcagatctctaagttctaattcttttttgattacaaattttatcaattcatttctcttctttctcattttacgataagcagtcaagagaagacatgccccatcttcaacattttgcttagattttttttggccaaatatcctaatttatcactcaagaatttctgctttccataaagcagtaggatacaaacacaattccaccaagttctttgccacttcataaaaaggatcacctttcctccagtttccaataatatgttccttatttttatctgagacctcatcaaaatggcctttaccatccatatttctatcaacgtcctattcacgacctcttagaaaagctttaagaagactgaggttttctctatagctcttcttttcttctgtaccctcaccagaagcacctttaatgctccattcactttaaaattcgtccagcctctatccaatacccagtttaacacattttgttatagcaaccaaaatggactaagatgccccttaaagagcttttgtgtccattagacaagagttagacacctaacatagtatctgggactaatattgtatttaataaataattgaacctgtgatttgatcatatcagggatttgcaaatctcattttgtatgtgtgtggtaaaatatatttaacataaaatgtatcattttagccattttaattatgcaattgagttgcattagtttgctcataatgttgtgtatctatctccacatcttttcagactttttcatcattccaaacagaaaccgtgtccattaaacaatgacttcccaatttctttttcccccaacattttgtaccctctattttactttttgtctctgaatttaccttctaggttcctcatataagtggaatcatacacacactagcttttcttttgtgactgcttatttcacttagtgtaatgtctttaaagatcatccgtgtcatggcatgcatcagaattctattcctattaaaggctgaataatattccattgtatgtatataccacattttgttttttcattcatccaatgaaggacatttgtcttgtatcaacctttttgcctattatgaataacactgctgtgtccatcgtcatacaagcatctgtttgtgcttctgcttttaatgaattgctggataatatgattattttatagttaattttggggggaacttccaaactgtttcccatagtggctgtgcctctgtaacattttgtattcccactatcaactcacaagtgttctaatttctattcctaataacacatgttatattctattttattttatattattttttaataatagccaagcttatgggtataaagtgggatctcactgtggttttgatttgctgtcccttagtgactaaagatgctgagcagcttttcatatgctgctgattatttacatatactctctgaagaaatgtctgttcaagtcctttgcccattctttaattgggttgtttattttgttattgttgagttataggttctttatatattctagataaaaattccttatgagatacataattgacaaatattttctccaattctctgggttgtttttcactttcttaatggtatcctttgatgcacagaagtttttaattttgataaaaaacaatttatctattttttttagttgtctatgctttgggtatcatatctgaaaaataattgacaaacccaaggttatgaagatagctttatatgttttcttctaagagttttatagttttagctttttttttcttaagcatccttttggtgaaaaaatgttttagctcttatgcttaggtatttaatacatttttagttaatttttgcatacgatataaagtacaggtccaacttcattatcttcgatgtggatattcaatttttttcaaaaccatttattgaaaagactgtcctttctctgaatggtcttggctaacttatcagaaacaaattgtgcatatgtgtaaagtttatttctatgctgtctattgtatattctattctgtaggtctgtacttaggacagtgccacactgtttttattactgtagccgtgcactgttttaaaaccagaaagcatgagtcttccaactttatttttctttttcaagattgttttggctattcaaagccgcttgagattccatgtgaattttttgatgtattttccagtttgtgggaaaaaaaaatccgtaggattttgataaggattgtactcaatctatagattgctgtgaaaagcattatcttcttaacaatattttcttccaatccatgaacacagatgtcttccatttacttatgtcacctttaatttcttttagcaatattttataattttagaaaataaggctttcatctccttggtgaaactatccctacgtattttattctttttgattgactagctcttttacaagtcttttactgcttaagtaatttctcaaaagtttgttaaataaaatgtagaatctgacataaatttctaagttgacagaatatactattaatcaacttttactaggttatgctgcaagataagaaactaaatgttacaataccaagtttatttgatactcacatttacatcagatgtgtgttgctgcaggagtgctggggtctgtgagattttcaagctgttccctatttcttctttctctagcagtcatgatgaaggacaaaactgttgggaacatgatgttctctactatcagaggacagcaccaagaaggcaaacagaaacaagcacaatttttctaatccttttcctagggattagcctactaattgtaccaaagttgtccatatttcacgggtcaaacaaaataaatcccatggccatgctaaagatcagtagggtaggaaaacaggacagtgagaaaaaagcaaaccaataattgtgaacaaataataagtttcattgcagttataagtaagcaataatctttcatagttatgaaaattcgtttttccaagatttatcacttgctgtgttatcttgacgctatcactagtcctgttttctttccttgagaaacagagaacaaaaattctctttccctcacatgttcaaataattagagtgtaattataaaataattggagcaaaggtgaataaaagtctatcaattttcagctcattttactcactgaaaagaatcaagattttttgtgttttaaaataacaaatatccatctaaaaatgccacagaaattagacagaaaggaaacaaaataagctttgataaaatttatgactgatacaataaagagaaaaaggttttttataaattaagattttaattcatgtgataattgtgtttattttttaattagatggtgttagctaaattaaatcactcatttgaacagctcagaaatatcaatatgctatattaacttccttaagtatcacagttcactgcaataatacattcatattttcactcaaatactcaagtggttgtaggattagcataatatgctaatttttgtagcttatctaacatatatttagcatattttgctcactgaagtacacacagtgttgtttaaatgttttcatttaagcttacctccttgctaaaggtaactccaggctcttatctaaaatttggtcaggggaaatggattagataattgagtaaagagatatgagcaagaccttgcctttctctatcatccatttagttcacagaacaagcaaagattcaaaactatgttacattttaaccattaatactgttcataatatcaaagtataaaggttcgtgaaaaaattgattgaaaattttaaaaaactctccatttatttcataagaataagatactttcatttgtcggtacgattaaatcattgattatggtagtgaagttgctggaggagaaatggagaaggaagattggttgagcttcatgaccttggcaggagttaagtgagccatgtagaaggtgagtatttatactttgaggaatttctcctcctaaaagatccacaggtgctgttgaggggtttggggcagcagtggaatgtggtcagattcacgtcttaaatagatcactctggtacctgaataaggatggctttgaagggaaaagattggagatacagagacagtactatagaggctgttgcatctgcttaggtgcaatggaataaaaaacctaattaaggatctaaattagaccaacaggaaaaggccaagtgacatgaaagttaagagcatgcctgagtttggctgtcaaattgatctggcttcactttgctccctagctctgctacttagtgctttgatactgtacaatattcttaatcactctaaatctcaattccttttcccatctttaaaatgagtatgataacaatacatttctcatagagtggctatatggatttgttgaaaaagacatacgcatttagcatcatgcatagcatataataaatatgccacaaatgagttaacattgttcaaacagacaaaatagagtctttccaacttcatacttttagaaagtggtatagcacaagcctacatctaggcctccttattcaaattttgtggactttttactctaccatgctgtttcatagaacatgtggagagaagagaaaacaattttagagaggcttagagccactccagtattaaagctgggaatatgctgaatgatctggccaattcatttcatttcatttcatttcaaacagtgtaataaatgctctcttggtataagaaattggttattatctgaactgtaattctgatagtatgtttctatataaacaagatataatatgcagtaactttaacttcttaagaacacagattgtttctcattcattttggtatttccaatgcctagtttaggaactgaaacgtaacagtctcttagtaaacatttagtgaatggatatattatgctatttttgagacacagctcatcaaacatagtataattgatttgaaataaaaatggcagatcaatgaaaatagcaatgagattatgatcagggagtgcaagcaagttttctcctttacttttctggtgatgtgttatggatggttttccttagaaattattttctttcaggatcagcctaagggaaagagtattacagaaagttttagcaacagtgtcatgaacttaaagttgtcagaggaaagccctgaggctccagcatcccatccatcctcatcactaacagatcttccttgtaaaaccctttggaacctggcttcaatacaaagtggaattaccgaaagccttaatattgttgctggtttgctcactaatgattattttgtttctctgtttcataatgccttgcctggaaaatcttttgcaagtgagtggccggaattataattcttgtaaggaagtgatttccacatgtggttaacgattttgctactgctcttctcaaccttcacaccccttcattcctgcccaactcatttggttatggatattaatcacaatcacagaacaggaaatgctttattttaatgtttaataagtttacaactctcgaaattgattcttgtagtatgaatgttggtaatcattacactttaatgccataggcatttcagaaaagactggggaaggaaggtctccactgatatcaaagatgaaatagcaaatatttttgcaaaaagacaaaatgtcctttctttgactttaaagaagattaatagttataattaaaaatcacccatcagtgtgtatcgccaaagacccagctgagttcagtgaatactgctcacaggccaaattcaactctgcatcttggtaaatgcttctgtgacgtcgccacagggagttggcatctctctacattgacagaaatgaggcggtaattagaagtgagtgacaaggtgcttttcatctttgataaggaaagattttttgtgtcaaaatatctcgccagaggagtaattttctctgtgtgcattttttgtcctgaacgcattttgcatgataatagaaaaggggaaattgtttctgaatgttgcttagtgacaaatagcagattcggtgcctttgcagttaacaagtgtctgaatgctgtcatattgtgatatcgacagatagggctcatcgtaagctggggatatttatattggaaaaataatttgtttttgatagaatagaatcaaagatattaaaatgtttttatggtattatgcctctaaaggtttaaaatgatctgacaagatttaatcacccaattctaaaatacattttaaggatttaatcacctgaaatttttagcacagtgaggagacaaataaccaatataatgtagttgctgttttacagaacctgccttgtcactcaacataggggctgctgtcagttcagaacactttcaaacaattcataattatgctggaaagtgaaatccattgactgtactaaattggaaaatttaaaaacaactattcatgaaatttaaatggtttgaaacagttttttttttaaagaaacattaaaagaaacctctgtaattatagctttgcctggcattagattctatgaatgtgaaaggaaaattctgccttgaagttggaattgataatgttaagagaacacagtgctttctttcattatttatttttgtgtgtagggagagcattttatgggatgcaatttagcatacaggtcagatatgatagcaggtggaaagaatgacagtgcttatttgaaagaatgaatctgatactcattgttatctgagtaacattggcatggaaaatgtagtaagatcagtaatttctaaagaagcaataagtaacattatccagctagctataggagaaaacttcagagtgtacctgatcacaagagaaagagggaggtaggatgggtggagagagagagaagatttaatgaatattggaattaaaagaagaaattgaatgaattaagaacaccagtacctagctatgaatatcataggctgtgactcatttgaggtaattagaagaaatgtgaaggtttcaaagagttcattgccataatacttagataacaaataatggacttggctttttgttaagcactttattaaggctatcccaattcctgaaatttaattttctgaatacctctgttaaattaaagctaatgatattctctgatagcagcttgcaatagacatttggaccttatctttcatctttcaagatcctattctctaagagattttgatgagactacaatccttgaaaaaactggaatcataataatattgttgcccaaatcagatggccacaaaactaattaaatttgttttcttccccccattttactattaccatattcccctttatcaattcatttagaataattgtaaaaatttaatttttattaggttattctagagtacccttgagtatgctactcagaactctcagacagaagataaaataaatccacattagttttagatgtacacagttattttaactttgagattatttggagtcccggtgtggtggtgctcacctgtaataccagcactttgaaaggctgaggcaggaggatcacttgagcccgggagtttgagaccagcctggacaacatagtgcaactcttgtcttaaattaaaaaaaaaaaaattgaaaatataagctttatcttcagtcctaaacaatcactcaatagaagatcatatactgacaattatttcataagctttattaaataagttaataatcagtgtttataacatattgaacactgtgtaggttgaggactttacacatataattatcgtaagactacagcatacatacttcctgttgtattagtcagaaaataagtgcttagaaggaaaacaacttgttctagttcccatggttactaaatttcttacatgggatttgtgttgccaaagcaaatagtgcaccagacataattaaacaggcgacgaagaattattcaaggctattgcaataggggagagagagtgaactcacatcgctgtaacaaaacgtaagagtttctaagcagtagggtgagttagtgcaaaaacactggagaatgtcagggaagagggtggggaagggaatgtgttcagcatgttaaattaatccacaattggcaaaagtttttgtctaagattaggccatctgtattttggcacccatggaagttagacccttccctgccacagagtctgagaaaaaggaatgctatcctgcttgctgattatatttcaaagacatgattccaagtcctccacaaagacgttcactgggtcataaaactgacaagaggctgggagaagaattatatatatataatatatataatataacatataatatatattatatataatatatatatatgtatttcaaaggagcagataaataaagtgcaattgcaaattttctaaaatatatgctctaaagtagatatacagtcaagaaggaacctttgtaacatttagttaagctgaaagtaatgttaaggccatcttggtcacagtccatgtctgtcagacacctttgtagtcactcttaaccctggcattacactgaatcctaattataccagttttccaacagtaattgggaatattaattgcttgtccatagaatggcagtttatttgctgataatatgttcttccaaacttgatataattgtaagatactctcaatgaatatgtatttgcctaatatattataaatataaaaatagatttaaaaatttggataaattatctcaaaatacagttgaaacatttgaaatttgcttattaaaatacaccaaagtaatggtagaaaggaggtaaaaattatcccagaatcccatagtccttattatttttccattatccaaaataggtggaagttgattattttattcagcaaatatttattgaatacttatatctgccaggcagtatgctaggtggtagaaatatattagtaaacaagagaatcaatatttcttttggaatttacaatctagaaagaagcagatatttactagctaatttaaaaaaaaattacaccagtgagctatgcaatgaagaaaaaagttaaaacttctgtgaggacagataacaggccaaagttatgtcattacatagtgtagattttcctgaggattcatctgggacctaaatctaccaggtggagaaaaaatcttgacaaagcagttgaaaaggtgttgaagagtttgattaaccaaacagaggaatttcatatgtgaaacaagataaaaactatattttagattatttggaggaatcaaaagatgtagcaaaatgaagaaagcctgagagtcaggaaagcttagctctgtcataaactatttctgtggaattgagaaggcttggtatcaattttcctgtacacaataggttatctttggattaattttctgaaatgtcaccattgcactaaatgtttttgaaaatcatcttttggattgatggagaaacattcaaggatcgcaagtttttaggtcgcaaagaaaaattttgtagtcacatttcaattgactaaattgctgaaattattcacatactgtaattgctatgcttgactcttaagaagtattgaacacttcccaaattccaaagtattgaacacgtaccttcaaaagataaagatttgctgctgttgagcaattcaagtgttcgtgctatattatagaaatgtcataaaaagttacaatatctttgaagttctttgtctttgtttaaatgtaatcacatttactaattgtcacatctaattatcatttggatcagagagttggcataaaattacagaaatggaatagataccctctagagccaggcatgagtgagggtgaaggatattgttgctactctctgtcacaatttacacataataattggtggttatatttggtcaggtccagtttgtaaaagactctcgtggtaaagctgaaatgagtttctgaactttggagaagactagaatattatgaaatttagataatggcaaaagataataaaagagtagtgcctgtgggtctttgtttccctactcattctcctacagtgtttgggagaagaagcctccagggtattcgtggcacttgatttccagcagctgtcagagaggcagggcgctgctccagatcgggaatagcttgctctgctcagggtaattggctctgcagcctctgttgaagagaggcagtctgactcatcaagtttctatttttgctcatttgtttgtttttatgagaaaggagatgcatgttttttataccacatatagatccttacctagtgaagaaatctttgttgaaagaggtaagaaaagttaactaataaagattaaagatattttaaagtaggtatcattctatattcaaattatatccatttttaatgtaaaaattttaaagattatagcataattatatacacacaacttaaaaatatatacatatactatatatatgaaataattatacataagtccctgaaataattatacatatgtgtacttgtgtgtataaaacatagcctatattgattcctaagattcactgcaacaagtgtactttgagtaatgactcatagtaagttagatctgagggtttattatataaataaaatgttgttactgttcagtgatcttacatgacttcagtaatctggagtaaggactagatgggctaatttcttagtggagaactaaaatagaattaaacgtatttgatggagttacagattaactttgatatccaatattaaggagaaaaaaaaatattactctgcttacagagatcagtctgtcagtgtcagactttttccaaattttagtttcaccttgagtaatttttattttagatcacaagctatttttaactttctttccaaatggttttagtttacatacatttaatataaaacacacaccccataccaaaagaaaaatgtataaggcatgaagcataatttctacaaccttcgatactgtcattttccctttagacagctaagtttaaacaggcttctgcccattttcgatggtgtgtgtttgtgtctttgagtatacaaatttatgtacacatggttaattgtgaagtacaaaatgctgtaagtgaggatgagaccctacagaattattgacaatacaagtggagcgaaagagaatccacataaggtagactagagaaaaatacatttctatttattgttatggaaaatggctgaaacaagcacagccttccatgcttatgaaaaactaatcttacagcatagcagttcacatcactgtttcacaaacttatgatacatcctattggagaacatttaatcaaaaagcttattcagttttgatctttatgtatgtgagtttccattttactatattttacccatttaaaacggttctgttttttctactttgatcaccgttacatcattattactgtgatcaaagagagcacacgtaaagaaacaaaaaaaagtggtaccatttaagctgtagtgcaaagaaaatgaaactactgttttagagtgtaacacacatgtcactgaatcacaaagtgtaactgaagtgatgctaaacatcaagacacagagtgttaaaacaatctaaaggaaggtagtgaatatgccatgtacctggcacaacggacaacctcttggagaggggaaaatctgggataattccccatctgtgtgaaaactcaccagtgatggccagcaggcttgccatttaagaccatgttgaaaatgtgaaaaaaaaaagcttggctggaaatcagtgcctaatgaagctatagaataggacgcactttttttctttattatatatcttgtgatgttctgatttaaaatgtctaattcatattgtacacacgctatgcctagatttacctacaaaatcctcaatcaaacagtttatctaatgttataaagcaaaaaattgcttacggcataaagtttttattttgttttgttttgttaccaattacttaaaagggaaatcaatgtccagtgttatggcatctgagagataaaccagttgaaataaaaattgacaatgagggctgggcccagtggctcacgcctataatcccagcactttgggaggcccaggtgggtggatcacctgaggtcaggagtttgagcccagactggccaacttggtaaaaccctgtctctactaaaactacaaaaattagcggggcatggtggcacatggctgtaatcccagctactcaggagggtgaggcaggagaactgcttgaaccctggaggccgaggttgcagtgagccgagatcgcaccattgcactccagccagggtgacaagaacgaaactccatctcatatagttcaggttataatttgaggttcttgtcctgaaaagcctaacaaatagagtacaaaactggatggactattgaaagcagaagataagagaagaaaataatgaagggtcaatagagaataagagtaggtggcccaaagggacatcttggaggctgattaccccatatcctatgctccatctttcatgtttccccatttttattcatttgaaattaaaaggccgggcgtggtggctcatgcctgtaatcccagcactttgggaggccgaggtgggtggatgacctgaggtcaggagttaaagaccagcttgaccaatatggagaaaccctgtctctactaaaaatacaaaattagctgggcgtggtgatgcatgcctgtgatcccagctacttgggaggctgaggcaggagaatcgcttgaacctgggaggtggaggttgtagtgagctgagatagcgccactgcattccagcctgggaaacgaggaaaactccgtctcaaaaaaaaaaaaaaaaaaaaaaattaactgatatttttcatcattcttaatttcagaaactaagcataaaaacaaaataatatatacaattatttcattaatatgtccatattttgttaacataataaaatataaatttttacattatgattacagtttttaaaattcacaaatacagttttatctttacaagcctcaggaatttaaccatatgcttcctctgaaacatgcaaaatattacatatcaaatcaaataacattagtattactttctaaattcaattttaactatcagtcatataatccagaagcatgaaaaagtaatatttgaggaagttatcgaaacatttcactgtttttcagaaccctttagaaatcagatcagaaggtcatttgcaattcgctaactggttaatgacacaattgaatttaatagactctaattctttttctctaatgaccaatagtcagaggtccaatttcagagttgaaaaatgtctgctattttcagcacatctatttctaacttcacatttgttttctctgcaagataatattaaatttaaaaataaaataaagtaaatcattttgactaaatgaacagcacaaagcctttggcatcagatacatcggaaccttggctcaaacatttattttccttgaagctattcactacttaattaacttcccttggtctcagtttttcaatgtatataaaaatgtaagatttgggaggccaaggccggcggatcacgaggtcaggagatcaagaccatcctggctaacacggtaaaaccccgtctctacaaaaatacaaaaaaaattagccaggcatggtggcaggtgcctgtagtcccagctactccagaggctgaggcaggagaatggcgtgaacccaggaggcggagcttacagcgagtccagatcgcgtcactgcactccagcctgggcgacagagtgagactcagtctcaaaaaataaaaaaaataaaaagtaagataatatggaacttaatgtctggtcggtgaggtaaaaaggaaatgagtgtaaaagagatatcatttgtgacctccagacttagatcatcatgtaaatattggtgccaccaaatgcaatagaaaactctgaaagaatgaagaaggccaaatgaatgtgttgatacacggtgaaggttttgatgggcaaatggccatggaacatccacgatactagcaggaaaatggttctggtgctcaacttttgttttcaggctggaaaagtaaagaagaggaatcaaaaggaaactagatctgaagaaaatggagagctaggccgggcgtgatggttcacgcctgtaatcccagccctttgggatgccaaggcgggtggatcacttgaggtcaggaattctagaccagcctggccaacatggtgaaactctgtctctactaaaaacacaaaaagtagctgggtgtggtagtacgtgcctgtgatcccagctactcgggaggctgaggcacgagaattgcttgaatccaggaggcaaaggttgcaatgaatgtagatcacgccacagcactccagcctgggtgacagagtgggagtctgtctcaaaaaaaaaaaaaaaaaaaaaaaaggagaaataaagtgatgaaagtataatagaaaatggaagaattaacagttacagcaggaggagtgaaatatttgatgtgaaattatcagggatagaagagtctagataataacaagttagagagtatagtcaggagctagtattgaggaatgaagcttaatgagatggagtttattaaagaacaataaatcaaagttcttggatgatatttttgttaatctattgttttgcaacaaatatccctaaatatagtgacttaaaaatacaacagtgatttacaaaattacaaatttacaaaattacaaaaatataagagtgacttcccatgtatctggaattctggaatttggggttggcttttgtctgagaaaccctgttttctccctccagtagtctatactagcttccttacactgcagttttagggcaatgttccatgttggtgaagtcagaagctgcaagacttcttgaggtctcaatcctagaaagcacacatagtcacttccaccatattctgttggtcacagtcaaaaggccagtttaaattaaaaagctgaattacttaataaaaaatattttaaaaattataaccatatttaatctaccacaaatggaatatcgacttggatcataaaattacctggattgcaactggatttgagttggaaaaaaataacaatgacccatttaccaaagatataatgaatatatcaaaagcaccaaaaaacttgcggatgatgcaaggaaaaagagatagtttcagcgaggtaggatgactcacaaaggaacaaatattattgtacgattataaaagttataatttggatattgcatatgaagaatattgacctcatgttccagtctcagtgtaccttttgttccagggacccaatgtatcaatgaccttctgctgacagaatcaacaatcccaaaatataaggggcttaaaacaatagacatgtatttcttgtttatgttaactgaggaccacaattcactgaggttctgctccaaaacatgatgaaggtgagatctgttccatgcatcttcttcttctaagaccaggttgaagggacactcctgtcagtgacgtggtattctcttggtagtgggaggtaaaagtgtttaaaactgaacattgaagttcagttttataaaattatacaggccaattataaaattgtccttgtagtttacttttgaaagcaagttatctcagatgtctaacaatgacaaagtctagtcaaggtatccttgacccactttatcagggattatctgcccatgttgtggtcagaatcctgtacttatgccaaatggcaggaagtgatttccagcacagtaaatagactttaccccagtcgcttacccctaatgtgagtacaaaggaggaagtaacataggtactgaactgagattgatgcccttattcgatgaatgttataaaaatagcacctggaatatggtaattaattcctacatttccaaatcagaacagaggcttccaacagttaaaaatcctttctattctcatgatgcacaatgacagcttgttttacatgatttagctagtagtgaacagaattcgatttattaactttttgcaggaagagagacaatacaccattgtgatctgtgcgctgtcttactaagaaagagttgaaatgtacttaacatggtgtttgggcttttgctgagtgatataaggaagggcttaagaaaggttgggagggtctgttttggattaaattctgtcaggaagcgggtcaattatccttttgaatatttatacttcttaattggaaactttaaaatgtttttggtctaggaggtgtgaggaatgaaacagagctagaattgtccttggtaaaaaagaaaaaaaagcagtagtctctcatattttgggggagtggagattttctaatagtattatagtatctttatatttttcttatattcgtatatctttatagagtggtcttgtttttgcttagtgtcatcatgtcacagaatgttttgccttattattgttaaaagtctatgaaattgtttatgtctggtagagaatgctgctgctgttttgttatttcttttgtatttatctttctcaaaggctttagttttttttaaatattgtttgtattgtcctatagtcgttattcttaacaagtcctaattggctttcttaattgtaactttttctatgaattagaaggcctcactttctatgatagacttattaattggtttcatcatttagacttcctttaaaacaatcgctgatattgacatatcgtaacttcatcgctactctcacaacctccatttacaaatatgagactacttggcagtaataactgtagtgctacatattatttcctctttaaaaaagtgtctggaggtacatctttggttcttctgaaaggcactgtgagagcagagatgtacagattagttcctcacttagtcttagagaagaccttgcaattttgccttttctctggctagctaatgaaaactaagttcttcacccaagtcctttacaccctttatgcagcacaactttaacactttaattttaacaagtcccatttcctcatttggtctcttgaaaatatctatgagaaaggaaaccttgctttgttcacatcacagttcatattgcaagatagtgagttcctagatggtttaaagataattttagggtgtataatcaacctaattatattatcttttggatacaaatctaagaacaaacattacatataacatgtctttggttttggaaattacataattttgtttcttactttacccttaaaatttgtgggaacactactcttaacaatgctttggactcgtggtcttctgaaatcttttgtcccactctaggctctgtttccagctgaacttccttgttaactcatttctattttcgtaaagctgtttcatgttagcatttcttcttacttagacattcatttgctagtcatcctacccacttttatttttcatcagctatatttctctaataataagaaaaaactagtagtcataactgtcaaactctgcattaggctattttccagtcagtatcactgtatatgttcaagtactgtattcacatgcactgtcttggccaatctcttatacaggaaaggcaagcattgaagattgggttttactagatgacctttgaatctaagttcaatgttgagactctatgattcaaaacacagtgatagaaaaatcataattttgcacagacttcatatatatactttaccaccctatccaagagccctttcttgattttcttatactaatcagcacctctagaaaggataagtaaaattggtgaatgtactctgtagtatggatgactatatgcatatgtagaaaatcactaggctaggtttaaaaaaaagtgagaaaggaaataatatctataggttcactgcaattaaatcatcctattaaaatagtttacaagaacatatacaaacagtatgatatacactgaacatattataatagttgcttttagataagaatatggcaatgggagagtgaataaatggaataaatacattaatgaaacaagataagagcaagacatatcaatgagatagtttgacatgaattcataagtctttttttagtcttctgcacatgatattcaataaaatacatacataaaatagcactcatctctatgcctattgcctatttaattttctagtctgtatttatggtttctaataaaaagttaattaatttattctttattatttgcctctgctaaccttttctgaccagcaagttactttcctaagaggagataattttgtttctttttttttttttactgttgtatcaccagtaccaaaaataatacctgacatctactaaatatgaaaatattaattatattaattaattaattatacgaataactatgatgaagttgattttttttatattatctctaacttaaaatttaaaagtaagaatctgtaatgggcttaagttattcatggtagtgggaagatattttaataacgatcagtgggtgattgatttctggttcaatacctttctcaattgaaatgacaaatcaaattagagttttacctcaagtgccatttgaaaatgaataaaatataatcgatatgacatgaaaggagatattcattattgaaagttgtattctgacccagagaaaacactaactgctatacccgtattactaacttccagcatgagctatttttaaagttttaataaactgaagagaatcatcttgcctcaaaaacatgtggaaaggtagaaaaaaatatgtgtattgttatatatatacacacatgcatatatgtgtatttatgcattctataattcagctcatggcccctccagtggggcagagatcctaaagctttggtgggtgacagaatctcttgcaaagctgcttaaaagtgaacattttggccaggaacagttattcatgcctgtaattccagcactttgggaggctgaggcatatgtatgtgtgtgaatacatatgtgccatataaaggtttaaatacacatatatgtgtatatatgtgtatatacacttatgtgccatatatgaggttcatatatacacatataatgtgtatatatgcgtgtgtgtgaatatagttatgtgtcccataacaatgttttggtcaacaacaaatcccgtatacaatggtggtctcataatggtgtgtctgtgtgtgtgtgtgtgtgtgtgtgtatggtgtgtgtgtgttaaataaatgctactcttgaaaaacataataaagtcagtattcctgtggccaagtaaccatttgaagaaatatttgtcctttgtttggtgcaaaggaccaaatgatgtttatactttttttcagagaatactacacactttacacatctcagcatgaaattagtatcacaaaatctttctatttatttacagttttatttaactgcctgatttgtccaaaatattctcaaagaagtgagcaaatagaaatgatagtgtttgttgtctataaaacctttttgtaaatgagcaatgatcattacactgtttctactattaacttaaacaagaacatttgtcagatttgttcattcaaatattgtttgtagctggggatggtggctcacgcctgtaatcccagcacttcgggaggctgaggtaggtggatcatctgaggtcagaagttggagagcagcctggcccacatggtgagaccctgtctctattacaaataaaaaattagctgggcgttgtggtgtgctcctgtaatcccagctactcatgaggcaaggctggagaatcacttgaacccgggaggtggaggttgcagtgagccaagatcacaccattgcactccagcctgggcaacaagactgaaactctatctcaaaaaaaaaaaaaaaaaagaaaagaaaaaagaaaagaaaaagaaacccacaaatactgtttttgaataccacctgaggaggaccagacccatgtatagatactggggttacatcagtgagaaccctgattattttgagtttcttatctgatgcagtggatttcaaacctgtttaaatattggaaacgtccaacggatttaagaagtaccaaaatctgagtcccattccaggccaaaaaaatagaaatatctggggataggactccaacatttgagtagttttaaaggatctccagatgatatcagtatggtgcccaagtttacaactgcttgtccaaaaagtgacatataccagcaaataaaaaaatttcttcagctgagctaagcctagggaaaaaaaaaacaaaccaaatttctaatcactgcggtaagtgctacaatataaaattccctggagccaacagggacaagaggatcattaggtgagggaatggggggaagagacatagtttcaaaagtcttctcacaggaaatatcaattaaactaggatctgaagaataaaagaagttggtgaaagtcaatggagatgatttattcagatttttttaagtatatgtaaagtccaggagttaaaagatagcatggcttattttaggatgtaatagtattttaatgcaattggcattgaacttgaaaaggacaaagaaatggctgtatgcagaaggccttataagccatgttaagaaaaatgaactccatcttaagagcaatggagaagaagaacttcataattttcaagattagtcagaagttgtcttttgcctttctcacagtactttttatatatttagaatggtcttttctacttaattttaatgtatgtggcatagtgtccctattatcagcagaaatgcacagtcaagtttcttgaataaaaactttctaggactcctattattaatgaatctaacaattttaatggttttcttagagctcatatttttagctttagggcagtggttctcaagcttttttcaggtccaacatgttagaagtaatgactaattatagcaattattttcaagaaaaggggcagaagaagggactaaacagctcacctgggtaatggtggctgctgtagcttgaaagtgatccacccatcttcatctgatgctcctcgagggctgagagaaaaatcgtagtctccctttaaaaacaaacaaacaaacaaatcaacacaaaaaactgcaagctcttgaaattagaattaggggtttaaaaattgccttcaaaatttacaaatgcctcagggaaaaatcatatttacatccttggtatgagagtacaataatcagcgaaacttggttcaagtgtcctatgcttgacctaatgaccttaaagccaggaaagataatagcatccttccagaacgtgttgctaaggctgagaaagaagttgtaccctagaggaagcatagatacaaacactgagaggactgaatggcacgcagcacccccacattttggcttctacagaaaataattatgacctagaagtgaaatctgctggacagaaattggctagacccaaactcatggggaagcacggacagatgcagacgcagagagaaaagtgaaaatatcattaaagaggcctttgttgttaaataaagattaagaactgccactctaccgcacaatttgacagcctccaatttaaaatgtgatttacagtcacaatagttcctattttctttcttgcattttgtgaccaaagaaaacaaatacctgtgtgtgcttttacgagacttatttgttctttttctccacatccactcgccctctcttgtatgatattatgaataatccagtgccatgacttgaactcctgagacttatgacacaatcagagacaggtgatctggaaatatcctatttggtttcttcactgtcctttaatgttttcttatgggaggagaggttcttccatttttgacagaactcagtaacacgtgtttcattcgcacacaagtcagaggagccaggcaaagcacatctcactagtgtctctaaataacttttttttttttttttttttttttttttttagacagagtctcgctctgtctcccaggctggagtgcagtagcctgatctcggctcactgcaacctccgcctcccaggttcaaacaattctcctgcctcagcctcctgagtagctgggactacagccgtccaccacgacggccagctaatttttgtatttttagtagagacagggtttcaccatattggccagcctggtcttgaactcctgaccttgtgatccgcctgccttggcctcccaaagtgctgggataacaggcaggagccaccacgcctggcctctaaataacttttatttcactaaatatattgttatgaaaatgaagtggctatcatttttatcagtagtctcttttgtatgtgaatatttaaagctctcaaagaaataggaagaaaagaccaaaagaaatgatgagttactagctttgtttctctgacagactggtcccatatgtctatggttatgtgatgaacagaagaaaaaggaaagaaatacaaaatattttagaaattggtttgctaatgatagcatgtactacacagaaaatattgagacatagactgtccctaatctctagttaagttgttggttgttttcagattctgagtgatcctctatatgaacagtgatgccatagtggcaagcaagttattaaagggactcgatacctgctcgtggttgatactcatttagttttcatatatttaggttgagaagctgcttttttttttttcttttggcattaaactcacataactatagaaattatgtttgtattctgaggagtacctataatttatttaaaatatttttgtaatttcccatggctattataatttttaaagtatgctattaagaaatgcttgtcttaacagggcagaagctgctttaccctgggtttttccacatggaggattatctgatgataatgacacatttcccacagtggcagggaagctactagagacacagaaggcctgcacagatgtcaggactgctgggtacagcactgccatggttgatgcactcagagtttaaagtctctttaaatttctttcacataaaagaagaaatttgaagttcagcctccaagaaagagtattaaaaagaccaggagggttttatccaagttccacgggtgataaaacacatcagtctgaaacattactagtgcgttgctgattccctagtcattcttccatttgctgtagctgaacaatgatagcactgttccatcaagggaaaatgatccctcctcctttcaaaaagctttttacaaggcaaagctataaagtgctagatttattaacaatttccatttcaagagagacactgtttgtacggccgtaaagctgtgctttaatgcaagcctgttttcctaatgccttcacaactcctgtaaataatgcatcccttggtggcatccttcacttttaaacaatttgggcaaactggttcaagttgtaaaaatacaaatatactttctgtaatataataatagttttgcaaacactctggaatttgccaatttacttttctagatctgattgatatttgattgccaaaatgggaaaaaaatgtacttaggtgaatttcacccccaaccgagggactcaggacaccagaaaagtgaagacatattccaggaaattttgagcaatgataaaactggtccgtggtgtttgttgacaagagaaaaagtgcatccaagttctataaactgaaagtgtcacgagaaacttctttatctcagttccctatgttggatctgtcaattcaaccaggttttattgaactattctaattatcttaaagaaacctgattaaactttattctattcttgaatagtccttcccctttactatatgtttgcttttaaaaaaattaattgacaaataataattgtatatatggaatacaatgtgatgttttgatatgtctactctgtggaatgattaaatcaagctaattaccatatctatcacctcccatacttaatttttgtggtgagaaaattcaaagtctacccccctaacacttttatataaattattattaatatgtttgccttttaaaaaatactattaaatggcaatgtattgattaaaaaataaaaatcattcaattctcaaagtgtttactattgggcagataataaatgtttgtttgtttgtttttgtaaagcaccagaaaattattttatggtaagctatgtaaaaggaaagtaagagtcttgaaaaatgtctttcctctagtagttatcattttgtagtgaaaaccttttgcattcactctcttagcattttttcaagaatacaaatattgttaactttagtcactgtgttgtgcaagagatctcccaaacttatttctctatctaactgaaaccttgcatcttttgatcaacatcaacgtcttctcaacccctgaaacacccccgccccacccctcactgccagtctcaaaagtaatgtaatccagcttggatttggtgatttggacttgaactggattgaaatcaccaatccagcttggattagtgatttggacttgaactgaggggaaattataggtgttatattttattcataaaccagtaattttatagtaatgtgttaacaaaggagaaaaataaatggtccagtgaaaaattgagttatggttagattgcataggaatgtaatcaataaagtatgacatagtagagagagaaaatttgtaagaaaaaggtcataatgcagaactcttgtatttagttaagtatcatttgaggctctttttgttgaaaatggcagacaaaccagtatacaatagcttaggcaataaagatgacttattggctcatataactggaagatccagaataagaaggagttttagctcaaggatgtcgtcagagatcccattttcccatctttccacagtgcatcctgtatatatggaattccatatatggattgtatatatggaattgtacatcctacaagatctttagacagtcttcctcatgttgtcaaaatgactacataaatttgaaaccccattcatagctatgcatttcctgtataactatttggaaagacttagagaaatttatgacctggagtcctcagtatatttcccttgggtgaaagttacgtggctgtccctaaagaaatctctgaagacaaagatcaacggcatatactgatctactcaagcccgtttttctgaaccaaattccaaattccatggagaaggagttaggattgctcttattggacttcactagagcagggcccacctccaacctgggtaatgtcaggttcccctgaagcacatctgttacaggaaaggggtcctgatccagacccaagagagggttcttggatctcacacaagaaagaattcaggatgagtccacagtgcaaagcaaaaacaaatttattaagaaagtaaaggaataaagaatggctactccatggacagagcagcccgagggctgcgggttgcccatttttatagttatttcttgaacatatgctaaacaaggagtggattattcatggctcctctttttagaccatctagagtaacttcctgacattgccatggcatttgtaaactgtcgtgacaccggtgggagtgtagcagtgaggatggccagaagtcactctcatggccatcttggtttcggtgggttttagccggcttctttaatgcaacctgttttatcaacaaggtctttatgacctgtatcttgtgctgacctcctatctcatcctgtgacttagaatgccttaaccatctgggaatgcagcccagtgggtctcaacctcattttacccagctcctattcaagatggagttgctctggttcacacacctctgacacttcagtagtgtggaaaaaggaaaaataattgaacaaaaatctcagcacttaggagccagatatagggaaacagaggatgactaagcaatcaacaaataacctccattctaaggcatttctcctcaagtttatatagtttttgccatttaaacaaaaaaacttttatttaaaatttattggatttgatttggccaattgtttctttgcattcatgtttttctagtttctggtgaaaatttcatttatttaatacttgttggtcattttataaaatgttaattactagtaaaatttttccaattagatatatgttatctcccagtccatatattttctttctaaccgcatattctctcctcatctaagctctgaatagcagggaggttaattaatagaggttgattttatatacatctatttgccataggaaacaccaaactcataagaaatggtaacaattaatcaatgctgtagttgtcccataaaaattctatccccccaaaatttcattttcccccagttaagaccaatatgttgccacattatctgttttcagtacatacgtagtcacacacccacagatatttcattttagttttgcaaagggaaattttgataccatactgaaatggtaggaaatttagttccaaatcactggagttaaatagatgataattccacaaatctcttttcattattaaacaccatttctactagctgtattttaacttttaaatgatttcaaaccatttattataagtaacaatatataatcgcctatagaaagttcatactatccagctagaacttgttcagctatcaacctgacacctagtaatcatgaaatgtccatccactcagtagaaataccctttccctaaccaaaggaagtttctgtctcctcttttttctggactcctgctactcagttgctgagcttcccctgccacaaggaccctctgactccatcttccacccttcctgctctcctctctttgaccttatgctgggatatttgtaggtatatagacatgtcaagccctttcaatccttggcttttaccatgctgttgccactttttagagtagtgagttgtttttaaccttggctgcacattggaatcagttacagaggattttacatctcagtggccaaccagcattcaagacaaatgaaatgaaagtatctgggggtgaggtccatgtatcaaaatttttttaagcctccagttgattccagtgtgcagccagaattgagaaccctctctctattcttacaactcctgattctcctacatatatttgtctaaatattatagcactctgcagagaaacttttattccctctgcagactaggtttggttttttgaaagatgctttcatggctggacgcgggggctcaaatctgtaatcctagcactttgggaggccgaggcgggcagatcacctgaggtcaggagtttgacaccagcctggccaacatggtgaaaccccatctctactaaaaatacaaaattagccgagcatggtggcacacacctgtaatcccagctacttgggaggctgaggcaggaaaattgtttgaaccaaggaagcagaggttgtagtgagccgagatcacaccattgcacttcagcctgggtgacagagcaaaacccggtctcaaaaaaaaaaaaaaaaacatgttttcacagctcctgtatttctcttcatggcactttgtacgcttgtaaactacttgaaagcagatatagtgccatgcgtatctttggtttctagaatgatatgcaatcaataaatcaacaaatatgaactgatttgtcttgcttaccaggacaagcccattgaaatcagactgctatcttaatgaaaccagtgtggaatctactgccacattgtaaacatgtacttaaatttctatgtcagtgaaagaaagaacacgaaactttttacacctgctactatacatacagatttgttcatagtccttagggctaaatctgcagttagaatcatttataaccatacaaacttgcccagttttcaaccactttctatgataggaacagatttatctcctaatctgcttacacacagacacagacacacatacacagtgcataatacccattgaaatgctctgggtactgtggaacacagaccagattgcctaggactaaaacaaagaagaaatatctttaactcaatttaagacacctaattctccagtccttattttattttattttattttattttattttattttattttattttattttattttattttttgagatggagttttgctcttgttgcccaggctggagtgcaatggcacaatcttggctcactgcaacctctgcctcccaggttcaagcaattctcctcccccagcctcccaagtagctgggattacaggcatgtgccaccatgcctagctaattttgtatttttagtagagacaagtttcaccatgttgactaggctggtcacaaattcctgacctcaggtgatccacctgtctcagccctgcaaagtgctgggattgcagacgtgagccaccgtgcctggcctccagtccttattttctatcccaggttaaacaccttttaaatgggatatgcaatggaaataactaaatctttaagaaaaattctacttgtacctgtattgtgtataatcaggttcacataatagctcaaaaggagcctgttctagatttttgagtcttataactttaactttgcagataatgcgtagtgctgattaacataaatgaatactttttccctttatagataagaatcagcatagtgtagaccttactttcatataactctgtcctacccacacaaacatgcacacaggcactcccaaatgtgcaaataaaactgtattttaaatcaggtggaataacatttggtaaaaaagtagcagaatgactaacagaattataaaatgtcgaaatataggcagatgcaaataagaagctggaattttccccaagtggtaggaataaaatctgattagagatttaaattaatttggaaacttatggtgaagggtttcatttagttatttcttaatgatttcttaattaataaaaatcacattaaccagaattggcctttcctttaatcgaatgtgaaagtgtgattacttttggaatcaagttaaaatttaatatttaagctagtttatcattctcaactctttgtccagtcctcaatatgagaatctaaagcatgctttaaatatctaattagttctaatgcatagcacaatgcctgacatatagtaggtatatgacattggtgaatgatttaatacttaaacaaaacaaaattcttgttctcaaataaaaaataaaataagccttttttttttgtcagggtctctgttgcccaggttcgagaacagtggcacaatcatagcttactgtaaccttgaatttctgagctcaagcaatcctactgcctcaaactactgagtagccaggactatgggcatgtaccactaagcccagctcatctgtttttatttttcatagagatgggggttgccatattgcccacactggtcttgaacccatggctcaaactatcctccagtctcagcctcctgaagcactgggaaaaacctttctctttaaaagaaagacatacttgttattcataagaaaaaagaaagattttaaaacaaatatatctttaccttataataagttgatgacatatataaagtatcttactaaaatgttatagtttgacacaaaacttaaaatagttggacttcagattcacaccatattatgttgagctcagaatttttatccatttgcgtacaaactaatgaaatatgaataattaaagaatagtttgtacattgtactaaattcaatgtctctaaaattttcctgtgttattcgttcttaaataaactgaaataagccaataaacttcgaacattcctggctacattttcagatttctaagatgtttctgaagtcatctttcctgatataattatattgtaataaagtacccatcatatcataaattgttattttaatgatactaacataggcatttaattattaagtaatcctaaagctgacattaaaattactatgaaattgttagtttcaaaatagtaaataaaacaacttttatattttttaatgtttttattatagtttctttgtaccagtaattattgaaatattctaataactcaaaaatgattttaactaaataacttcacttttaaaagaaatctaacaacttaattcaaccaaagtaaataacaccttttgtattattactcctagatgttgtttaagtctttaaaacaatttctaaaactccaagtttatttaattttttctacaatgtgaaaggtaaagtctcttatctaaaacctgtaaaaaacaagtttaatattggttttttaaaagccttactctcaaatctggttcttgaactgttaatcgtaaaaatagcatgactatgtgaaaatactagattgttcttttaattataactctgaactatattgtaaatccatttgttagctttcttcttctttgtcatctaattccatttctagcacttagcatagtgtggagagagttttaggtcgttagtaaacaaaagaatgagcaaactaatagatgggcatgaaaagcactaaatttatgtcttgctgctgtcatatagtagctaagattctgatctcatcacatatgtggacacacaagctttcgctaagatatatacagcattgtttggtttacaatattcttttacctatagtattgaagttgatgctcagaggagctatgtggaaatggccggaaggaaaattattatccacaattcataatatagaaaggtgaaggtagggcattaagcctcagttttatgttgaattgagatgatattatttatagctgaactgtggaaaggagtcagtaagaatttagtataagggtatttggtccaaaattgctttcttctgatcacataaaaacatttttgtataaatttttgtttccctgggatacccttgtcatattaggtataagggcacaagagtcagaatatttatgttaatcatatgctgattacctgcatgactttcccacctgtatactgtccctcaaagaaaatctcaagaagtaaaacagaattctaaggataaaatgaaacagcacaagaaaatgtcatgtaaagtaaaatactcacaatgctgaaatcatttttattatttgttttgtaacaaaataatgtggttcaaattcttagttaattgtctgtgaggtgtgtagaacttggactaccctaaggctcagttttataaaatttaaaaagatatttgcgtgactatttaaaaagtatgaaataatatgtaatgcttttagatcccatggcagtatttgtactcaataaataataaaataataaaaataaaaataaaaataaaaaactcaactataatagttattatacttacatataagtactagagtttttattgttgttactgtgctgaatggaagaggacaatagcaaaaataggagggagaaaaataccctctcctgtctcctatttaggttgataaaagtgccacccctccttcataggatttagatgaaattgaaaatacaaaatattacaagattaacaattctggttttcctgctggagtatctccagtattgacagataaggctaacttttcatccagcccatctgatgatattgactttcactaccatctgcattgccagtgattatgctcacctaaatgaattactttagatataattatcaggtccccaagacatcgaataaaacctccactggtgacatttcaaatgatgacagtgtgttttctcataatatatcaatccagagaccacctaaaaattatctttgtctttgggttaatggtaaaaagcaaataaataaacaagaacaattatactaaaaggttgccatgaattgttcacatttttcattttaaagggtaaatagtaaagaaagaataaagacatatttttaatccaattaatcattccatatctaatgttgtagaccaaacaacaggacatgcctaaacatttcaaagtagaaatagcatagttatattcaattcactataaaatgacaaacattcattgaacattggctttgaatagcatgtggaaataatggtataaggatgagtaagattgtctattggagaagacacatgtacaaatagaatatgacatctaatttaagtggtttaaaaacattttgctatagaaacccagagatgaaatattaaaattcaacaaaagccccactaataagtaacatgaggctaaatgtcaaaagaagggcagaaattgtccagaaataaaatctccaactggaaggaaagtgtactcagtagttaaagaaatagaaacggcacaaactcaggttacaggaagacataagaaattgggtgttgcagcaatatactggaaaagctggagaaaaaggagtatgttcaaagataaaacaagcatggattggagacagaaccagtaggttggtggtaaattaaagagtgttcatttgatccagaggtagtttgcaaaggcaaccatgttccaggccctaggataaatgtgttatgtttaatattgtttattctcacaactgtatatggtaggtagtgttgtcacctctttttcagatggagaaatcaaggcaaagggagctaagtaagttagtcaaagtcacacagcttgtagatagtggagttgggattcaaacctcagttttctaagactttaggctttttaactgtgtcctgttgcttttctctactgattgtccttttctgtcacttaccattcatttgttagcctttttactggcttctcattccccatcttatttgttccttaaatattatggttgtccagaattccatttttgtaaaactgaaaagaaacatatgagttctatagtaactttctttgaaattatacaagctttgtacttagaaacaaaacaatgtgggaaaaaaatttgaataccttcagagcatcatgatttgattagtgggcacacactaaattgtaagataaaatgcagaaaagtaggtaaatagcctataggtacacatcaaactgtttaattagtgagagaataaaatgattaaaaattaaaattacttaagcaagttctcaggcaaattctcatttctatttctttcttaacgagtctttaattagctgaaattacattagggaagtttcatgccttctatatttttgccaatatgtgaagtaccctctttattcacaaatgatgggtgtaagtggataatgaaacgtattcctcaggagaaagggaaattgcagtcaatttagtattattgaatatcaacttgtgtatatttttggctgaacaaaattaaagtcaacagccagcaagggaaaatttggttagaaatattttatgttatgtttgttttccacaatttcttacaaaatactttggagggagaaatataaaatgattttattataaagatttaatgtatctttgtaacattacaacaaacaaaagaattacctcaaactcacattaaaattttcaccctccaaactgtaaaataaacactagcttaaaattatggaataaattcatctttcatttcagaatcaacttatatgctagctttttcatggtttatgagaaactattatataattttctttttttaaaattatgttttattgccctttttaaaacttttattttaagttcgggggtataagtgcaggtttgttacataggtaaacttttgttatggggttttttgtacagattatttcatcacccaggtattaagcctagcacccattggttattctttctgatcgtttcctttctctcacccttcatcctctgaaaggtttcactttgtatagttcccctccatgtgctcatgtattctcattatttagtcccagttataagtgataacatgtggtattcggttttctgttccagtgttagtttgccaagaataatggcctccagctccatccatgtccctacaaaggacatgatctttttcttttttattgcatagtattctatggtgtatatggaccacattgtctttatcaagtctaacatcgatgggcattcaggttgattcactgtctttgctattgtgaatggtgctgcagtgaatatgcacatgtgtgtgactttataatagaacgatttatattcctttgggtatataccccataatgggattgctgggtagaatggtatctctatctttaggtctttgaggaatcacctcactgtcttccataatggtcaaactaatttatactcccactaacagtgtataagcattcctttttctccccaacctcacaagcatcttttatttttgacattttaacaatagccattccgactggtgtgagatggtatctcattgtggttttgatttgcatttctctaatgatcggtggtgtcgagctttttttatatgattgttggtcatatgtatgtcttcttttgagaagtgcctgttcatgtcctttactcatttttgaatggtattgtttgttggttttcttgtaaatttctttaagttccttatagatgctggacgctagacttttgttagatgtataatttgcaaaaatattctcccattctgtaagttgtctgtttattctgttgatagtttcttttgctgtgcagaagctttttagtttcattagatcctattagtcaatttttacttttggtgccattgcttttggtgtctttgtcatgaaatctttgcccattcctatgtccaggatggtactctgtaggttgtcttccagggtttttatagcttggggttttacatttaagtctttaatccatctcgagttgattttttgtatatgatgtaaggaaggggtccagcttcaaccttctgcatatgactagtcagttatcccagcactatttattgaataggtagtcttttccccattgcttgtttttgtcagcattgtcaaagaacgtatggtcttagatgtttggccttatttctgggctatctattctgttccattggtctatgtgtctgtttttgtaccagtaccatgctgttttggttaatgtaggcctgcagtatagtttgaagtcaggtagtgtggtgcctccagctttgttctttttgcttaggattgcctggtatatctgggctcttttttggttatatatgaattttaaaatggctttctctagttctgtgaaatatcaatggtagtttaataggaatggcattcaatctataaattactttggcagtatggccattttttaatgatattgactctttctatccatgatcatggaatgtttttttcatttgtttgtgtcaatgagataattttcaaagtattaattattttgtgctcattattaaatacgagcataatagaataggtcaatcttttctaaaataaaacttaaggaggaaataaaaatacccaaagtgcttgcaattcttaaagtaacttttgtttctaaataaaatatagagaaactctgtggtctaggttatctcaatatttgtcatttttacaagcataataaaaaattatgttatttatagttgtggttgtgtaaaacaggacctgtttttataaaccccagtcagtatccttaaaattttatgggttaataaatatagtacttgccttttaaatttaagtgtaaaacacttgaagttatgagaaaaaaagttatcactactatcataagagactgatatatatgaaaccaaagagtaagtagtgaaagaactaaaattctgaaaatatttttattataagaaagctgcttttgtcataaattaaatttgtatttagcggtactatagaaaacagccaaacagttaggagataagacatctttcatgttttattttaatatggaaaaagaaaagataaagtaagagctaatgatcaggaatgtgatgtcagcctttaacactttcaaatggattaaattcctggttgaatattaagtgagaaggaataaaacaagtatctagtgcatacgacattcaacacatttggtatgcctttaatatgcattatcccatttagtatgaacactttggcttaagaagtattgtcattccaactttatagatgagaaaatggagcatctcaaaaagtttgacaaattgcctaaaatctaatagataggaagatacaaagtcaacatttaacctcagaactctgatgccaatggccagtcctctaggttgtgacggttcctccatcttttctagatgctgataactttgataatttgagaaaaatcagtaaggtgttttgcagaatatctctgagttgatatttgtctgatgtttttccatggtaagagtaagggttacagatttttgggaggaagaacatagaggtaaagtacaattctcatcatatcaaaaatacttattatcaacaggacttattacagtttttgctgattttcatcaactggcagagatttttctatgtaactactcttttattctcccattctgtagtatactcttaggaagaaagtcattatgcacttaaggagtgggcagtaattatccacctccttaacaacagcatatctacacataaattatttggaattcttttgtacagatttttttcctccatttattatctatctatctacctatctatctaatgatttatttgtattagttggatactcattttaagcttttgattataattcattatactttattttgttgcttaaatatatccactttcatcattaagagctctttcagataaattctgtgccctattgaaatactctcatgtttgttttgcttgtttgtttgtttgtagaccacttcctttttttctggtattacaagatgtttcaggctcattttacatatttccttcctcagtcctaaaatcaaccatttctccaaggatccctggctacttttatcagaaaatggtattagaaacctagatctgggcatgaagtttgctcatttctaaggaatattgttgcttttatggtctcttagttgagagatcaagggaatatatgagtgtatactactgtgtgtgtatatacacgcctacaaatattgctgtatttcacatctatatctatattaagctaaacatgagttcatactgatgtctcccagtctaatctattatcacattgatattctacaacctcccattccaacagtgagacacctggctccgactgtcagccatccattgactttattccttaacgccagttacacatggattgtgatttcagaattgttagcccacacccactttggacaaactttaacaattatattacagagtgtttttttgttttgttttgtgttttgcctttagccttacagactcctttctttcaaaagtgacttagggtcaaaccgttttttctcacctcttttcctgaatttattctatacatttgtaatatatttctgttcgtctgtcctattctgcattccaacctcctgaatgaattatttgatttgcatacattaagatttactcttcatgctttaaattctatgcattttagcaaatgcttaatattttgtattcatcattactgtatcatacaggacagtttcaccaaccaccaaaaatcctctgtgcttccaatgttccagcctgttctcaaaacccctgggaatcacttaccatccctattttttgtttactttttccagaatatcatataattggaattatatagtacgtagcttttcagaatggctgtatttcatataatacatcttagagattcatccatgtctgttcaacacttgataattcatttattttccattcaaacaatattccattgtatggatgtcagtctgtttatcaatttttttactttaaagaccatctttggttgccttcagtttttggcgattatgaataaagctactctaaacagctgtgggcagctatgtgctgacaactcatatcacctctctccctcctacaagaatttcctttgccttttttgctctccttttgaaaatcacaccgtatctgctacaacctgccaccttcaccccacttaacaaactcctgcacatcctttctgtctcatatactcttcatgtcctctccaaattcttccccaacttctccagatagtagaggtctcttacttctgttatggttacagaaaaaccatatcactctgatagaattattcatctgagacagcatttaacatttaattgtatacatttccctgacaaattatggggctacataagcatttgtggaataaaaaaaactaaaatattaatgaaagaaaatgatataatacatatacttattcatatagatattgtctatacatataattgaataaactatcaagagcattaaggatatgtgacagtagtcaatgcagttctaaacttattagatttcagaacaaatttgaaaaattctaaattatgagatccttgttattcgataaaagggatttttggttgatcaagaaagtaactaaattattgagtaataaagaaatttatatttaattcacataaaaggaacattgagctatataataaacattattattaaaattaatttttaaagttttacaaaacatgtagaaatattctttatgactacctcacacattatctaaagataagagccgattatgtaataacacattctaattctttgtagttatatatgcaatggtatataaggcaaagggcttttttttttattaagtgttggtggaacagtggtggaaatatttttctcttaaaataactttatatgtccaataaccagaaaatacaccaaagattattgcttatctaaatattttttgaagattacactttggtttttttagttgttcaattataaaaaactttgattctctcagatatttgttattgtaagctttgttttgtttatttttatttttaatttctttggctttttttctataattttttatttttaatttttgtgggtacatagaaggtggatacatttatggagtacatgagatatttgatacaggcatgcaatgtgtaataatcacatcatggaaaatggagtatctatcccctcaagtatttctctttcatgttacaaacaatacaattatacttttagtaattgtacaatggtacttttagtacttttaaaacatacaatttactgtagtcacatccttgtgctatcaaatactaggccttatacattcattttaactctacttttgtacccattaaccatccccactttccttttacccctctaccacccactacccttcttagcctctgcttaccaatcttctactctctatctccaagggttcaatagttttgatttttaaatcccacaaataagtgagaacatgtagtgtttgtctttctgtgcctgctatttcgcttaacataatgaactccagttcattatgaacggaatgaacaatagaatggactgaagggtgagttctatttacgttgttgcttatcaaatggtgagaatttcattctttttttatggccaaatagtacttcattgtgtaggagtaccacattttctttatccaatcatctgttgatggacacttaggcttaatccaatcatctgttgatggcgattgtgaacagagctgcaacaaacatgggagtgcagatatctcttccacgaactgatttctgttatgggggatatagtcccagtggtggaattgctgggtcatatggtagctctatttttagtcttttgaggaccctccaaacccttctccaaagtgggtgtactattcactctctcaccaatagcatacaagggttgccttttctccacatcctcaccagcatttgttactgcctgtcttttggatataagccattttaactggggtgagatgatatctgattgtagtttgatttgcatttctctaatgatcagtgacgtagagcaccttttcatgtgttgctttgccatttttatgtattcgtttgagaaatgtatattcaaatgttttgcccattttaaaattagattattagatttttttcctatagagttgtttgagctccttatatactctagttattaatcctttgtcagatgggtagtttgaaaatatttacttccaacctgtgggttgtctgtttactttgttggttgtttcctttaccttgcaggagctttttaacttgatatgatcccatttgtctatttttgctttggttgtctgtgttttgggggtattactcaaaaaatcttttccagacagttgacctagagagcttccctaatgttttcttgtagtagtttaatagtttgaggtcttaaatttaagtctttgatccattttgatttgaattttgtatatggtcagagatagggatctagtttcattgttctgcatattgatatccagttcacctagcaccatttactgaagacactgtcttttccctaaggtatgttcttggtacctttgtcagaaatgaattcactgtaggtatgtggatttgttcatgggttctctattctgttccattgatgtatgtgtctgttttatgccagtacaatatcatgttattttggttactatacctctgtagtataatttgaagtcaggtaatgtgcttcatccagttttgttctttttgcttaggatagctttggttgttctgtacttttgtggttccatataaattttagaatttcaaaatatttctgtgaataatgtcatgggtgttttggtaggtactgcattgaatctgtagattgctgtgggtagtatggacattttaacaatattgattcttccaatccgtgaacatgagctatatttccgttgtggggtgtcctcttcaattctttcatcagtgttttatagttttcattatggaggtttttttccttctttagttaacttaatgcctagatgtttaactttacttgttgctactgtaaatggcactacttttttttcagtttactgttagcatatagaaattctattgatttttgtatattgattttctatcctgcaactttactgaatttgtttatgagttctaatagatttttggtggagtctgtaggttttttcacgtttaagattgtattatgtgcaaacaaggataatctgatttctttctttcaaatttggacgcactttatatatttcttttgtctggttgctctaactagggtgtccagtactgtagggaataacagtgatcatagtgaggattgttgtcatgttccagatcttagaagaaaggcttttagtatttccccattcagtatgatactagctgtaaatctgtcctatgtggcttttattatgttgaggtgtgttccttctatccccagttttttaagcatttttaacatgaagcgatattgaattttatcaaatgctttttatagtaccaattaaaatgatcatatggtttttgtcctacattctgttgatctgatgtattacattgattaatttgcatatgttgaactatgtttgcatcccaggggtaaattctgcttgatcataatgaacagtatctttaatgtattgttgaatttggtttgctaatattttgttaagggtttttgcatcaatattaatcagggatattgacctatagttttgttgttgtttttaaatttgtttttgtctcattatgatatcaggataatactgacatcgtagaatacttttgaagcattccctcctcctctagtttctggaatagtttgagtaggattggtattagttctttaaatgtttggtagaattcagcagtgaagccactggattctgagcttttctttactgggagactttattacagctctgatcttgttaattcttgtgggtctgttcgggttttggatttctctgtagttcaatttggtaggttgtatgtgtcaaggaatttgtccatttcttctagatttttcaatttattggcatatagttactcatagtagccactaatgatcctttgaattcctgtggtatcaactgtcatgtctcctgtttcatcactgattttatttattctaatctttccttttttttttctgtcttagtctggctaaaagtttgtctattttgttaaacttcttttttttttttttttgagatggagtcttgctctgtcacccaggctggagtgcagtggcgggattccagctcactgcaagctccacctcccgggttcacgccattctcctgccttagcctcccaagtagctgggactacaggcgcctaccaccatgcctggctaattttttgtagtagagatggggtctcaccatgttagccaggatggtctcaatctcctgacctcgtgatctgcctgcctcaaccttccaaactgctgggattacaggcataagccaccacgcctggcttgtttaactttcgataagccaactttttgattcattgatcttttgtattattttcatttatttctgttctcattttatcattttttttcttctacaaattttgggtgggtttactcttccttatctaatactttaagatgcattgggagattgttatttgaagtttttctcctttttgatgtgagcacttacagcttttaaattacctcttattgctgcttttgctctgtcccataggttttgttatgtttggtttccattatcatttgtttcaaaaaatttttcaattttctccttaatttctttatggacccactagtcgttcaggagcatattgtttaatttccatatagtcctatagttttcaaaattcctcttgttattgatttctagttttattccatagtagttagagaagatccttaatattatttcaattttttgaatgttttaagacttgttttgtgacttaacatatgggctgtccttgatgatgatccatgtgctgaggagaataatgtgtattctgcagttcttggatgaaaagttttataagtatctattatgtccattttgtctatagtcaagattaagtctgatgtttctttgttgattttctgtctagaagatttgtccaatgctaaaagtggggtgtttaagtctccaactatcattgtattggagtctatctctgtatttagctctaaaaatattggctttatatacctgggtgctctagtatcgggtgcatatatatttaaaatttttatatcctcttgctgaattgatcccttaatcattatatagggaccttcttagtgtcttcttatataatttgtcttgaaatctattttgtgttgcattagtatagctgtttctgcttttttttggtttctattgtcatggaatttattttttcatccgtttattttcagactatgtgtgtatttataagttaagtttatttcttataggcaacagatcaatggtttttttttttctttattcagcttttgatagaaaaatttagtccatttacattcaatgttaattttgataggtaggtaaggacctactcctacaattttgttttttgttttctggttgttttgtggtcttctctttttttgttctttgttttctgtatttcttttagtgaaggtgattttctttggtgctatgacttagtttcttgctttttatttttttctgtatccattatatattttttggtttcaggttaccatgaggctttcaaacactatcttataacccattatttaagttaataacaacttaacactatttgcataaaggaacaagctaaaacaaggctagtaaagactgtatgccttaacttcatccttgtgctttttaactttttgttactatttacatcttattgtactgtctgtcttaaaacgttgtcatagtttttattttttattggtcaccacagttacaatgtcatagtgttctgtggttttttgagatacttactattaccagtgagttttgtaccttcagatgatttcttattgctcattaatgttcttctctctcttattgaagtactccctttagcatttcttataggacaggtctggtgttgatgaaatccttcagctcttgtttgtctaggaaagcctttatgtctctctcatgtttgaaggataatttcaccgaatatactattctaaggtaaaactttttttttcctttagaactttaaatatgtgatgccactctctcctagcctgtaaggtttccactgaaaagcctgctaccagatgtattggagctccattgtctgtcatttgtttcttttctcttgctgctttaaggatcatttctttattcttgacctttgggattttaattattaaatttcttgaggtaggcttctttgagttaaatctgcttggtgttttataaccttgcacttgactattggtatctctagatttaggaagttattatccctttgactaacattctatccctctttttctaccttctctttgaagacagtaactcttaggtttgcctttttgaggttattttctagatcctatagctgtgcttcattgttttagttatttattcttatctctcttctttgtgtattttcaagcaacctcttcaagctcactaattctttcttctgcttgatcgtttcttctattaaaggactctgatatattcttcagtatgccaattgcatttttcacctacaggatttctgcttgatttttaaaaattatttcaatctctttgttaaatttacctgatagaattctgaattcctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccggctactcgggaggctgaggcaggagaatggcgtgaacccgggaagcggagcttgcagtgagccgagattgcgccactgcagtccgcagtccggcctgggcaacagagcgagactccgtctcaaaaaaaaaaaaaaaaaaaaaaaaaaaaaaaaaaaaagaattctgaattcctttggtgtgttatctcgaatggcttggagtttcctcaacacagctattttgaattctcggtgtggaagctcacatatctctgtttctctaggattggtccctagtcctttatttagttcacttggtgaggttatgttttcctggcttgtcttgatacttctagatgtttacctgtttctacgcattggagagttagatatatattgtagtattcacaatctgggcttatttgcactcatccttcctgggaaggcctaccagatattcaaaaaggcttgggaattgtgatctaatctgtatctgcttgaaggggcaccccaagcccaataatgctgtggttcttatagactcatagaggtaccaccttgatggtcttggataagagccagaagaattctctggattaccaaacagacattcttgttcttttcccatactttgtcccaaacagagtctctctctctctctctctgttctgagccatctggagctaggggttgagtgacacaagctcccctgtggccactgctcctaggactgcactgggtcagatcttaagccagcacggtattgagtctcacccaaggcttgctgcaactactccctaactactgcctatgctcattcaaagccctggggctctacaatcagcgggtggccaagccagccagtcctatgtccttccctttaaaaggtgagttctcccaggacttggacaggtccagaggtgctatctgggagccagggactatagccaaaaaccttagaagtttacctggtgttctgttgtactgcagctgatctagcattcagatcataagacacagcttttttccgctcttctctcccattttcaaaggcagaggagcttcatactgtgaccactgccacatcagactcatcgggagtactgccagaatactgcagatattcccttatggcccaagggctctttattcagcttgaggtctgtctagcctgggactcacccttcagggaagtgggctcacctctggcccaaggtaggtccaaaaatgccatccaatagccatgtcctagaatcgggaaccccaagagcctgtttggtgttctatccccctgtggccaagcgagtacctaacatgaaagaaaaagtccactttacttttttccctctgattttctcgagcaatagtagttttgccccatagccaccacatctgggaatgtgctgattcccatctgaaaccggcaaatctcagagtctcatgaaaagccctaaacatagttatctgggtattactgctggttattcagggcccaagggctcttcagttagaaactgatgaatcctgacaggcctagtgcttctattcaaatcagcgggttcccttctggctcagggtgtgtctagaaatgtcatctgcgatctagggcctggaaaagggatgtcacagctctgactagtgccctgtcctgctgtggctgagctggtatccaagatgcaaggcaaagtccttccactcttctgtctcctctcctaaagtggaaggaaggggtctctttcggagccgtgagctgtgcagtttgaggttaggagaggggtgagacaagtactcccttagccatcccagctggtgtctcagtaggtcatgtccctctatcccccaactcaactggctcttggtccagttcagcactaggactcacctaggtgttacagttcttgtggcctaaactgcctttcaaggttatctggggccccagtggcctttagcttgtagtggcaaggcttgtgggaattcaagttctgactgttagaatctgtaactcccccctcactaggactcatttgagtgctctctttatgggcaggcatcaggggagtttggtctagttttgctttcttctataacaagggcagcactgagttcagtgcctcataatcactgactctccatctccatagggcacaaaaatactctctgcatcatgcttccactacccagggattggagaagtgtgacatcggtgattcggaactgttttttctacctgttcagtgcctctttcagtgatatgaagttaaaaccaggtattgtgagtgctcaccttatttttggttcttacaaaggtgcttttttctgtagatagtcattaaattagtgtccttggcagggcaggtggggagcaatatttgttggacccttctattccaccaccatcttgctgcagccctccttttaatttcactggcgtttttgcaggcttcttttttaaaaagtatcattgttattattattagatacaagagactgtgtattactctgttgcccaggctggagtgcagtggtgcgatcatagctcactgcagcctggaacttccacctcagccttctgagtggctaggactaccagcacatgccactacaccaggctaccaaaaaaaaaaaaaaaagaaagaaagaaagaaagaagagagagaaagaaaggaaggaaagaaaaagaaagaaagaaagaaagagaaagaaagaaagaaagaaagaaagaaagaaagaaagaaagaaagaaagaaagaaagttagttcatagaaattggagtctcaatatgttgcctgggctgacctcaaaatcctgaccgcaaggcatcctcctgcctcggcctcccaaagtgctgagattaatgcaggcttctttatatgtgtaaacatcccttttaaattataaatgtaaatatttagaaaacattatcttgccccataaattaataagtttatacactttttcagatttaacctccaaaaaaataaaaatctgtatcttaaatgaacttggccacccaattaaatttgagtcagagcctgcctactttaattaacaaagaaaaatatactgtgtagttttacataaaacaatggttgactgaataataataggtaatctttaactattttgggcatgaccatctgttgttaagatcattttaaatcatgtattcttataataatctgcaaaataaatcccaagtcaactttctctcttggtgaaacatcatttgtgattttcaacagtcagcctgttttgtgattctgtttattggaatttctgattctaatagtagtgaattagtttgttgtaagtaatctaattatgtggccattcttacttgttgaaataatgtagttgatatttctaataattttaattactttagttcaaaaaagagttattagtcactatctttaaaaggcactgccggccaggcacgatggctcaggcccgtaatcccagcactttgggaggccatggtgggtggatcacgaggtcaggagatcgagaccatccaagctaacacggtgaaaccgcatctctactaaaaatacaaaagaaaaattaaccaggcatggtggcaggcgcctgtggtcccagctactcaggaggatgagaaaggagaatggcgtgaacccgggagatggagcttgcagcaagcaaagcccgtgctactgcactccagcctgggcgacaacagagcgagattccgtctcaaaaataaaaaaataaataaataaaggcactgacaaaaatgtttttattctgatacaaaactttttgagaggttaaagatcatctgtaaacagataaaaataaatcatgaattaatacgttggtgatttttgttgagaagtggtgatgatgaagaaacaaaggctttgtgaaatatgcaagactgggtaaaacaaggagagaaaaatagtatagcaatagttattagaatgatggaaccgagtgaactcgttgaattgcttagaggtcattgcagccatcaagtgtgggttgcattttactagtatggcaaaatgacctaataattgaaccaaaaattgaagttaatttgtaagaattatgtgactacttagtagaagaaaaaggatgtgatattgggaaaggaaagcttaataataaattgtcattaagacacaaagtcaactatcatttattgttactatattccaatttctgtgctaggcacttacacttaccatcgcaagttgctctcaggttattcatttatccaacatgcaataagtttctgggagttataaggtgttttgccagggatatgataattaatatcataaccttgttggaggcttagtttgcaaaacatatttataagatgattatcaaaaaaagaatgattaatgacttgatagaagagtacaaatagtggtgaattataggaaaaagaaatacactccgtttagcttgtattttagtttcctagctagaaaatgaaagagctaaaatttaagttcaatacacaagctatgcagccttgttttctttatctcaatttataaaattataagaaggtcctttgcaatttgtagaagaactgacacggttaaggaaataggtgaaaacaaggacaagaattaacttacaggagaaaaatgcacatacctttccttgttttcataaaagactggcaagctagatccatattgccagagccatgaaagactgttctaaataacatgctagatgcctgatgtgagtccaaactgtggaacaaaaggtttctaaatgtattttttttgcaagtatttattcttgatgattaaagggacccaaaaccagagaagaagagagagagagagaaatagctaaacagctgtaaatttatccagaaagtactactcaaattctccttgattttccctgggcaacaatcagcaaacttttcattagaaggaactttaaaaggtttgctgatttgcaaaacatggcatgaataatgtgtacattacttgcataattggttttgtgcgtacatatggcacatgctattttggaaatgtaccccctctgtgttcattatagctgttgctcactctattccctgataatcatttatagttacttgtcacagtttattattagaaaattaatgaatcagcagttttgtgcactctcctttaacaacctaatcttagaagtttccaaaccacagtatacagtaatagaaagcaagtagatttcccaaatttatttgcgtatattgagctgcgcattttacagagattatctgaactttcataaataaaactttcattattctttatgaattgttctattacattcacagaaaacattttatgaaataaagttaatcaataaatctatattggtaacatgtttattttcacatattttctaatttttacatagcttaagtttttcccttgtctgttgaaatttccacaatatataattacaatttttcagttgaggaagccagaaatcagacagaaaagagggccaagagcagtagctcacacctgcaatcccagcactttgggaggccacagacagattgcttgagcccaggagaccagcctgggcaacatggtgaaaccccatatccacaaaaaaatatgaaaattatatgggtgtggtggtgcccacctgtagtcccagctatttgggagactgaggaaggaggatggcttaagcctgggaaatggaggttgcagcaagccaagatcatgctattgtattccagcctggatgacagaatgagaccttgtctcaaaaataaataaataaatacaaaaaatttttttaaaaaaattagaaagaagctctttttatcacagctcttagggttttatgtggcttggagatgagcccaaggagaacttccacccaggagactcttaatttgactgtttctacttcaaattactcctatttgtagcctagagcccaaggaaatagaatagcatttgcccttgccagcaaagatctggattatcagacaaggattttaagccatgcactatttgtttaaaaatttctaaacttagcactaaagtcactgtataaacccatggaactccagtttcatttcttacatatggttgattggtaaaacaacctgtagactccacatagactaacggaataaataacacatgcaatcctattttgaatgtttcataagacatttatctcccacatatagacccttaactatgggccagacaagatatattactttgaattactttgacaaactaagaagcataccagaataaaaataaagaaatggggaaatgaagcttttaaataatattattcaaaattatctcaaattatattgtattaagatgtatcatagatatgtaacatttccttgtatgatttttatatagaagaaatatattatttgaactttcttaagaaggcaaatgacaaagttttcagagtttatagaatattgtagtataattctaagtaagatactgtactgtacattggtgagggacagggaaaacaaaggtgaatagatagtttcttatcctcaaaatccattcaatattttttgaatatgttctttataccagccacaaatgtgccaattctagggaatatatataaagatcccaacttcaagttaatcaaaatctgtagtttccaagtcttcatactaatagctaattgggaaggctgttcaaacaatgaatactatttatcactgtatcaatttcaccatctcattgctatcctcacctccatcatcatcatcatcgtcatcattggacatgttatatttagtactatgcaccagctactctgttaataattgttgatatttattacacataatcttcacaataattctaggaaatagatgccactttaatcctgtttcacagagaaggaaacagccttgaagaaataatataaaattcccgaggtcgccatgccacactcattgtgaactcaattctagcttttcaccacaacgttatagtgcattctttatcacttgctctctttatggaagagtttgtattgtattattgtttcaacccataaatgaggctgtatttttgttgcccttttctgtagatgaattagtaagtttaaatttgaattagaagatcaccctgcatcaatcagagcagggtgaatataactaatttaattgttttattaccagagtacatcaccaagcagacatcaacaacaaattgcacatttgactttatgactttattataaactgcagcagcatgtggattctacgaccaatgacacagcttatctctttgcaccttgttaaccttttatttcactgttctttaaagtgagaactcagaagtcagagcagcatctgtctctgccatatctttgcaggcaaattaatctacatcaaagcaccctgaaaaaaatacttagagtcaagtattaacggggaaggtataatgttaaagagagcaaggaagaggaagattaactagaacaggcaataaacacaaaagcaagggacttagtctgaaatatcttgatatgtcaatgggcaactaacagtgtgacaagttatcattaaagaattcagcagggctgggcacaggggctcaggcctgtaatcccagcactttgggaggctgagatgggcagattacttgaggtcaggggtttgagaccagcctagcctacatggtgaaacactgtctctactaaaaatacaaaaattagccaggtgtggtggtgggcacctgtaattccagctacttgggaggctgacgcatgagaattgcttgaatccaggaggcagaggttgcagtgagctgagatcatgccacttcactccaacgtgggcaacagagaggaactccatctcaaaaaacaaaacaaaacaaaacaaaaacaaaaaaacaaaaacaaaaaagatttcaccagaaataacaaatcagtaatcttgtttcaaaattcgtttttttctcagaagtctttgttgtaatgacacttgaaactacatacaattcatgactctcttataggtgtttataaagttgggaaaagtaacacagtaagagacttcaccatctgcaagtgaaaaaaatccttttatttataatctcaactattctgccaaaaccagtgctttctgtctagaataaattgatttttgcttatgcataaattaaatgtcaacacatctttcacaaatctacttatggccagccaaaaaccaagctgttgagctagaaaacaaatttaatacagataactagatattctatttgttcaacaaatagatacaaaagaaaggagcttcagtgatcccaagttgtcagtgttaattagttgatatttgaagaaaattcctgcctcttcctcctaaaccactgtggatcaggaaacctgttatatattatatttctgtccaactatgtcttataacgcattagttccagctgaacaaacgctgagaaaataacaaaaatatacatttccatattgcaatattgatatcactgtgttaacacgtttaatttaaattctagaaagttttgagctgggtgtgttggtgatgctctttctctgccccatggaaaggggatgtatgtgtatagttgtgcacacatggatatttaataagtgcctgctgagtgccagaaactcttttaagcactatgacctggagatacagcagaaaattatatacatatgtgtgtatgtatgcagaatatatatagaatatatatgtataagaatatatatatacattcttaactttacaaagaagttcagcaatgaacaaatacatatacagtatgtcatgaggtcaggctaggcagaaaaatagagctatataatcagggcagatagtgataggggtatgggagggatgttttgagaagttctctctgttaaaatgacatctgagcaggacctgaattatgggagagactaagatgtgtggatatctgggggaaattatttcaagcacagagaagagtgcccaaaatcctgagactaaaataatcttgctattctggaagaatggcaagaaagtctttgtgtctgtcgtgagtgacagaggagagaatggcagacaatcaaacgggtggtcagagtaaggatactgaatatagtttaacaaggaaggaaagcattttgaggatagaattttctgtgctttttagttgcctttggcttcctgttataaatatctgaactattttattttttaagaaaactccagtaaaacaggcaactcaatattgtaattcttgaagtatttgttctcatggattatttcaacaaggcatgctaaaacacactctttggaattataggcgtgaaaatgtgtgatatcttttcttacccatcatccatcataagggtcgtggtgagcattcctataaacaaaaaggaggttaacaggagcaaagcacaacagatttatttaatcaaagttttacacaacacgttgaaccttcagattgaataacctaaaggtacatgggaagccatctgattttcttctgaggtttaatgaagcagggacagtgagtagaaatgtgactggataaaaaaaaaatgtgtgatctaatagtagtctaatagtgtgaggaagaaaacccagcaaggcttgtctgttcagcttcttcttggcctctctgtgaggcattctctccttccttctgggtatggggcagggcctctctggaatgtgggtcttataacctataccaggtaaatcagaaaatttatttatggccagctgttatgcagaaaagagggggaaagttaaagtaatactttcaggttttatggctgtctttgacgaaagggagttctggtttctatgactcacattgtgggtgggggattctagttgtttctatggctagcctctggagaaactgaggggagagcaggagagtgtcaaagataaactttgcttctgaggccttcactttgtgatatcattttctgggccccaataagacctagcaccaccaaaatgtgaactaattaacagatagtcgtgcaatcattcctttccattaacgtaacttgcatagctcttcaacactttagaatggtagagggggcatcaatattatgaagaaggaaattgagttccacagaagttgaatgatttaatccgaactcaaagagtcaattaattctgctcttgatttttccagtgtttatttatttcaaaaacctaagttaagttacacaaaaccgaacaatataagtagcctcaaaatagtgcactgtagtcagcttgtacctgattttccatttgtatgtgcatttcttcccaacttcaagttcagtggcagctcactggcagcttggagttagccttggtgggagtatttagaccatgaatattagcaaatgctatataattcagggttttatttacttatttattggtgtttcttggacagcctaattaccagcatactggaaattacaagtatgcagggtattttttcaacatatattatctaaacttttacataaaaaaggagcattctaatgcctttttttttgagacaaggttttgttctgtcacccaggctgactgagtacagtggctcaatgacagttcaggggagcctcaaactcctgggctcaagtaatcctcctgccatagcctccccagtagctaggactacaggcaagcatcaccatgcctggctaatttatttttattttcatgttggtgagatgggttctcagtatgttacccaggctggtctcaaattcctggcttcaagcaaacctcctgcttaatctcccaaactgctgagattacaagcataagccatcatgcccagtctctaatactactgtcacaggtgcaagtatctggggccggtgtcatgggtggtaaaggaatttaccaagacagttgtaggtaaagaaagatagattacagggaaagtacattgcaaggtagcaacgggcatcataacagagaaggggctgtctgcaaggaggcagaggctggagggaagttttatagggttgtgctggaaggggctatgtgcaaaacaaggtatttgggaaggggagattatgccagtgaattgtttgtaaatagctgtgtcttagaacaattgttctctcccacttgggagctcttccttgttgttacttactcatatcaggactccacaactacttctactttgcacttgtacattttactgaaagtatctgcttatgaggctttaaactccaagaggcagagactgacctatttttctgtgtatccaaactagaattgaacaacaaacgcaaattgactttaaaatcaatgaccttcacagataaagtgtcaatgaattattttttaaaattaatttttaaattactgttcaatcaagttaaaaaaacccaacttggtctaacttgtcaaatagcagcgtgaatacattttatatctttctattatttttcaataagttatttttatattaggtagtcttggtccaatattagtgtgataatatgtagattaaacacactcattggtttgacaggcaaagcttgatttgtcaaaaatacacggattattaaaacacatttttaattagacagtggttatctcagggaagaaattgctaagtataaaataatgacataagtgaatatgttaatctacacttagtatacaacaaaacactattcacaatgtaccgtcaacttggtgtgaatgttaagtttttgctagaaatgcacaaaagatgtttcattaagagtttgatttcactttatttgtaaatgtgtcttaatagactttattatagccattgtgttgagttgaagtgctcaattattcctactattttatgttaaattgtactattatctaggaaaataaaaggctgagttgaagaatctaatgcttattcaattgtaagtattgtcccatgaaagcagagactcttcatttccattcttttgtaaattcatggtgtcacaagtaggatttttatttattacttttaatcttcaataaacacaaattataaatcacattctttggatactaaaaccattactagctattgttagacttaatagactttattgtccccattttggtgagttgaagcattcagttgagtgcaatgagatgtattcaattgtggtaacattagaaaagtttcatgtttaaacggtgatctctgagaagttactcttgtaaatttaagttatgctgacttggacaactcttttcagatttatgaatatatagccttggtcacagaagtaatttaaactgctcaaggtttttaaagtatctaatgcacttctcttttatttctgctggttacaatactgctagaaaagtcagccttgctaaggttaatccaagattacacttgcaatttctgtgtaacttcaatcaaaatagtagagaagaatattgggataatttcatgactacattgctaaaaataaattacttctagtttttaaatggaaaaacaaaaaaatttaaagaaccaacatgaaaacaacaactttaaaaaaaaggtatgagttattcttactctatgtggaaaataaattatgtgaataatttttgcttgttttggcacatttctttaactagatccataggcaagaaaagacagtaaaactcaagttgacatcaagccattaaagacctggaaagaagagggtgttaaaagcgctcaagttcagataacatgtccaaagggataattgatgctgcaaatttttaattggatttaattggatccaagaacatttaattggattatttgatctttagctaaaattacttttctttttggaagttttcggtacagacaatgatttctgattattgagactaacctgatgcacttcattttggaaaccatttcaactgtcattaaaaagacttgtttggggtttctttcttcccatggctctaatgtaattgacaagtgccttttcagtaaattacactcattacctgttctacttactcttgctagttatttttcttaagtatctgtcgaatcatgtcgtgatcctgaattaaactcctcatgatgcctccaaataaagtccatgtcctactttatgtcatacaagccttttaatcattctaaagttacctgtgtgaattgtggaaaagttcaagctttggagacagatgaattgtatgggataacatatgctttgccacttagctagctatggcagtttgctatgccttctaatactcagtgtcctcaactataaaatgggaggattatgcatgataaggaatgtcaagtttctacataatacagtgcctgccactaagcaagtgccaaagtaaacaaacagcaaagtttatgaccacttccccatattctaattcttagaaaatgtcatcaactatgcagagggcagagatcttgccaccatcatcacctacctgagcacaacagcactgcacagcctcagggatggtattcaaactgcagtcaatgtgaattgcaccctctggagatgtaaatagaccagtcactgtatgtgatgactttactcattttctagagcttgggatatgcttgtcggtttgttgaatggataatgaaactaagtgaatttctaagaagttgagaggtttgttttatattaaaaaaaatttgtcttacaaattattgtaattatttatttctgggttaagtggttgcttctgttttaatcctctaacaagctgaatgaatgttgaaaccatgctgtgccaagaagggctaattggttgttttagcttattagggctggaagtgttaaaaacagagcctgacagcaatgaaattagtgacaatactaagccagagttatatggactgtagctaatgaagggcatgtatcattcccaatttttaaatagtatcttttacttacagtagattgagttgttcagtagggctggagtggggggaggggtgtggctggagaaagttatgtaaatttctgatgaaatacaaattggcagtggattggcaatatttgtttcacagtctttctattgtggtattttcttacaaattattgttattgttatatcccaattaatgacttctccctgtaactcaacagaggtcttttaattaatttcattaattcaaaaaatgttcagcaaacaccatgtatctagcatggtggtcttcaccaaatgtatgatagtgaaaaaaaggagtctccgtctgcaaggcattcagtttaaggaaggagacagaaaattaaataaagtaggagaagtgctatagtcaaggtaaatccaaggtgctggggaaacagacatgtctagtgttaaaaaattgttagaggtgatttagtgcagccctctatttacttataaattccccggatacaaggctgcagaaccgtgactccattgactggtacggtggtttggttcaaatgctctttttggtgaaacttgaacaattagtcatctggtctcctttgacagaaaggaaattacttcaaagaaaagtattttgaaaaaacgtaagtcaaaaaaaatctgggaaaaaggttatccccaaaatgatgtatcaactgcatgtcataatttagataaatattaattttcatgcagtgtgcatgcaagccctgggattttagaaattttagcttaaagtgaaaaacaagatatttcagtgttaatggtagcacataataagaattttcatacataatgtcacactcaaaaaattttttaaaaacctctagtgttgtcataaaaagagcaagcttctacagctcaaattctggccatttcagaacttgaacaacatgtagagccttcctaattgtcagaatcctagtctgaaaagggccatgataatgcttacataattgagttgtggaaaggattaaataagattacgatgaaaaagtaccttgttgaatgcctgataaattgaaagcagtcaatcaaaggcagctgaaaagaaatggctgcttcactggttaactgtcaggtcttgtggttacataagaaaatatgggcaagatagacattttctctcttgggttgaaataaaattttgatatatttcctatttcctacttgaattttactttcatgaggacagagaacctgggaattctcagtattcctgccctttgctgtccatgtgaaggcagcactgctcccaattgcactgttacagaatcacagcttctcggaagcatggatagcagggcccttctttcaggcatcttcttctcattctttcctagctctcttccttattgcctggaaattataattgtgtctttcatcagaaagagcatgcaaagctgaataagaagaacttttgtttacacttagggggagatccaagctctgtattattcattgaggttttttttttttttccgcctaataaatattcatagagtacctactgtgtgctagacactgctataagctcaggggatacatgggcggacaacatacctcagattcctttacagagtttatggtattgtggaagagaggtgaaacaaacaaatatatagaagataacttctactagtgaagaattttgacaataattcaatgaccagtgctctaatttcactctaaagaggctacccagagaactgggaagaagaatgggctctgtacatccttgttgtagaaggaagctataggaataagaacagaattcaggattaaaatcatttgctcttcgtcgctgttgcaagcagctttgttaaaaactccccaattgaaactaatttcatatcaagaaattatagcacctttggatttttaatgggctttatgtagcatgacattgacttatgacaatcttgatgtttgaaaacaatttgccattttatgacttttttgcatttctggatgacaccgcattgcatgtttcaaaatattatgagctttataaatatacatttaggggtaatttctgcaatattttcttagtccagttaagttagatcagagtgttgtttgctttgtaagtttaatttagaaatttgagtaaatgttttggtttctctgaatccaattcactgcctattaactttgcctttggaaatatggcttttactaggaaaaaaaaaatagctgtcttacaaatcttgcaaataaatcaaaaacaacttatcatagattttacatgcatcacaaattttcagagtcaaattttgtggtaatgtcaacctgaaaagaactgcagctgtctattcaggtgtgttcaatctctacttgataggaataattaccttctaccctcactaggtaattgccttttgattgaggtcatcagagcaatcaagtcagtgagaggcggaaatctagagtaggaaaggagacaaagggaagaatcatgaacagaactttgaaaggagaacaagaaagaagaggtttaatttgtttttaacatttaactgttcagtaataatttaaatagtggcagtcataaaatcatcataatatgcaacctgggttaattagcttgatatttttgttttttgaagtgaaaagcttgatatttttgttttttaagcatttgattagtatcattacacattcctatgaatgacaactcactctctaatttagtctccaaatagtctttgcatacacattatatcaggggaatcgtttaggtactgggacaggtagaggtgggaacaaaataaagaaaatgtatgtcctaacagggtttacatcctgattattgaaaaacaaaagcgattcatgttactttatatttttatatatatatatatatatatatatatatatatatatatatatctgtattttaattatactttaagttctagggtacatgtgcacaacgtgcaggtttgttacgtatgtaaaacaaagagagtgtagaagcaaagggaatagagagggttttttattaatgaaacagggaagaataaatatttgataaattgacagtcttcttaagtgagacatcctggggatgagtttgcaggaagacaaaacagtagtgtaaaatgtttggaatgttcaaagaacttaaaggaagccagtgtggctaagagtagtttgaacaaggggtaagtttgagatttttgcagactaataagtgcatcttctaaacttccaatttaagacttgcagatgttggggaaatataattaaaaacaaaatcttctcctaacccagaaatcctctctacaaagataatagaggaagaaaacattttcgttattgaataagcatgtaaatagaatgtgatgcaatcacaggaaatacactaagagactgcaggtacagcaaaatacggcagagagagaaatcccacctttacgtagagccaagcagatacatatcattacatatgtcttttcaagatgaacaataagtagtcctaaagaggacttgacaggactatttgtcacatatacttcattttaactttacctggtgattggagtgactatctgtgttagctatggtctttactcagaggaaaaagcagcttctatctttatgacaggagttagtcttgcagtttgcagcaaggtgcccactgaagtgaggcttccaccctcgagcagaaactgagagataggaaccttattttccatgatgtttacatttcaaagagatggctccttggtcgttgagaaagacattccttggtcataaagctgacaaaagctttatttagtttctaaaaatattcatatacatttcaaagaaacagaaaaagtacttacattttcaggtttctaaggtaaacttactaacaaaatgggaacggaggaaaatctatttcctattttcaacagtgagaattaagcctcttatttttaatctgtattttttctcattctagtaatacctacattagtgcttctcaaactttaatgtgcataggaattgcttggtgatccatttaaaatgcagattctgttttgatgactgtgaagtgagatctgaatctctgaattcacaacaggttccctggtgatgccaatgccatttgtccacagtacaggctttgagtgacaaggttagataaggagctgagagagaggcagcataagactagtgatttcgactagggtgggtatggggtgggggagcggtggtgtatgatcaagtattataaggccttgtagaccatttaaaggacgtttaggtttgaatgatattaaaaccttagagtataacagttcccttttatttgtgggtcataagttccaagaaccccattaggtgtctgaaactttggcaaatatctaacactgtggacacagtaagtactgtgttttttcctatacgtacatacatacatacatatgatacagcttaatttataaattaggcacagtaaaagatgtataacaataacctaataataaaatagaacaattttaacaatatggcaacatcaatactcttgtactttggtgccattattaagtataataaggattacctgaagacaagcactacaatctaaacagtgggtctgataaccaagacctctacaagtgactaatgggtgggtagcataagtggaaatgcaggacaaagtgtcgtgggatctgggggttgtcgctttcccagctggaaacctctgtggctggtggcacccagcatgctgcactcagctcatgctgccggcctcaacctcacgcctgcgaagggtgagccaggtgtggagcggcaaggggtgtgtaaatgatcactgggtctggccactgaacacagccaggcatgccagctaaggcaggcaggcagctcctggcactggcacagtcacgagctccatgtgaggctgcagctgggccagacgtaatgtaagtggcatgcactgtgagcactggggaacatggtggtgcccacaagcttggagatgccaggaatggcagagccccaaagagggtgtcacagccctggctcagggagctcctatgtctgggctgccagaaggactgcagctcttctcttattttcatcgcccacaacatggtaagcagggacatgtttcagccctgtttgtgttacagctctttcagtcgggccattcaatgggtcctgagttcttgttctatgtccaggaagaatgaggtacgtggacaactggagggtgagcaaggcagagagaagcgtcactgagacagaacagctcagaggaaactcaaagtgggttgctcctttccacaggcaggttgtcctgatgagtgtacaactcttagcagagaggaaacccatagtgggtagctcctttctatgggcaggttatcctgatgaatgtccagctgtccacatagaggagacctgtagcaggtagctccgtcccacagctggtaatcccaatgtctctgtgagtctggctgagtctggggtttttatgagctcctaagggaaaaattgtgtgctgattggtccatgggtggccataggcagacctggaaaaacaaccatctgattggccaaacagtcatcaatgaagtcctcactccaggccagggacttcacccagaactggcagcccggccctcaggcttcaggctgtttttgttttggaggtagggtttcactgaggaccctccgctttccttccaggaacctgtctgtctcctgccatcaacatgccatccatggcgccaaggttgttcgtgctgagagatgcctgcaggcccaggccaagacacccacaccaccccttgcctctctgctgtgctatgtggtgcccaaagtttgtagagggacaaggtggtggggtgggggtagggggctggcataacagcaccaccccaaatgtgtgcacactccctggtttgcaacagtgcacacgcccagccacaactttgctgtgcactggagcaggtgccaggagcagagaaagaggccagagagtgggagcagacacttaggagctttcaagggcaggggttgcttcctgagcctctgagaatgcagggatgccgaggtctgcagccatggctgggtggctgcaactgcaccctggagtgtggggctcctgccagctcagtaggggcatggtttccacctgttcctcacctctgccagatccatggggcacatagccctggctactcctcccccactgcagccagtgtcttcacagcgctgctccagaaaggtcactgctgccatcacaaccatggttagagatggaattgacaaggaaatttggttatttatgtggcaaacagcaatctaacataattataattactactgataacatatactaagaaataacagaatcacaggaacctcatacaattttgcaacacatattaatagcatatttataaaaatataatctaaaaagaattaaacaccatttcatatttgacaatgcttcctgtatgattttattataccaaaaatctgactatttctcttttggacttcagggggcctcatatcaaaaaaattgatgaagtcaaaaagactgaatttacaatttggtttttgccagtttgccaaataacagaggtttaaaacacttgatatcacaaaataggatcacaggtaactgtaaaataagtcattcatttatccaaagtggtaatacaaatatttccaaaaaaagggcaaaaactctgactcttttagaaaggagactcactttcataaacaatgagacctaataaagacatcatgaggccagctaaatatgtttctcaattcttataaacaaatctattaaattttaatcatcttgaccataagacagaattttcgtaagcctttttataatcttttacaatttttttaattaaagagtggttaaagctgccagaaaacttcgttaatctgacacactggcacaaatgctggtcttgtatcagtgcctttgatatgaatgtttaatttatcgaaaaatactgaactaattttctctgaaaattagcccttacagtctcctgcgtccacgtcttccatgttagtccttgggcctggaggatttgaatagttctaatttgtggccttgtatctcatgaatgcaaattattttgattgtcatattctaccaggtctgaagataaggctactgtaagtgtttatgatttagaaggagttggtgtcctttttagactcaggaatcatagccctgtaacttaacagtacagggactctaaaagcaatacagaaaattacatggatataataatcttgtatttttaaatctcagttttactaagcaaatcagaaacttaataacaatggcatagaaattatttcgataaaacataaaatctgtttcttaggccagttaccgaaaggcagaaaaacaaaaacaaaaaccttctgcagtgaggttgctttcctctgttaggggtccatttacataacctgcaagtcaaaactattgaaaagagtacatgaattatttaatcagacataggaaaagtgtgtcctgaatcgtaagtgaaggttttcagtttcatagaacaatttagatatattaagaaaagccaagagtacagaatgttacatcagaagaaaacattttctttagatcttgaagataaaatatttttagcattaggccacaacaacagttagaacctgaggggggaaataattacaaaaactgatgaaaaacttgaaggaaagagttattatctcaggccttctcaaaggggagagaaagccggaaacagcaagacataatagaagttaagcttttggattaaaagtgaaaatttcttgggcctggcgcggtggctcacgcctgttatcccagcactttgggaggccgaggcgggcggatcatgaggtcaggagattgagaccatcttggctaacacggtaaaaccctgtctctactaaaaatacaaaaaattagctgggcatggtggcacacacctgtagtcccaggtacttgggaggctgaggaaggagaatcacttgaacccgggaggcagaagttgcagtgagatgagatcctgtcactgcactccagcctgggtgacacagcaagactcagtctcaaaaaaaaaaaaaaaaaaaaaaaaaaagttaaaatttcttataattctattaagaacaaatgaatactttaaggaaattttggttttttaaacaattattttgtgtatcagtgtatttttaatatcaaacccaatctctagaaagactattattaataatttccttttaattttagccaacttaatcacgtaaaacttttccatacattttctttttacaaaccttattaagacttatagaaatttgtgagatgcttagacttcctcttttagcctaattattcctctttcttaaataaacagtcattttatttcaggccaataatttactgtacaaaatttgttctcatagaaaattattttccttttaacttaccaaaattacctctttataactttctttacaactgccttatttactacttccttttaccttgttttataaacaacctttgaattaaacaaaaattatttttcttttaataacttttttaagaaaaaaaaggctttacagctgaatacagtggctcacgtttttaatcccagcacttcggagggccaaggtgggtggatcacttgagctcaggagttgaagaccagcccgggcaatatggtgaaacctcatctctacaaaaacatacaaaaattagctgggcttcgtggcatgtccctgtagtcccacctatttgggaggttaaggtgagagatctcttgaacttgggaggaggaggctttggtgagccaagattgtgtcactcccctccagcctggacaagagagtgagaccctgtctcaaaaaaaaaaaaaaaaaaggaaaaaaaagatgtttctttaatatatgtatatatctttaattgaaaataacccagatatttaatgaatatctattatctaacataatataacttcaagattctaaattatatgtttatgtataagcatttattccattacatttccctaatttactatttttaatagtttatttagattacttagaaaaactgcagtattagacaaagctagtcatcatttaaagttattttcctgttaacaattgtttttagcctgtgaatgtctagttgtttatctaaacaagaactttaaggttcaataaatcagttttttgccaataacccaggatttagcaattttcattaaatcagtaatacaaaatgccttatttataaaaaaattacacaaagataattctgttttgagctgcatttatagcattaaaatcttcatgccaaattttgacagcttataatatctagcagatataattataaaacctctggaaaaataaatctaatgtataataatgtatgtgtataattctgaggacatttctaattttattttaccaataattctaaagccaccttatttattaaagatttgcttaagtcatgtgaacttgaaaaagcatttgggcttaaagttttttttctgatatagtatttaagtgcttttttatttaagccaattaattagagctcttttatatatttttgatagtgagacattatatatatgacacataaatacatacaggtatagacacatagacagaagtagatctgatagactcataagacttttattccacccctactttaaacttcacttttcttgataatctacttcattaccctaggcaattgtcagagagccctaaatttgcatactaaaggaacaattcttaggtgaaaatcagatagcaaaatacacatctcaaaggacagcaaaagggagagagagagagtctgagtgtgttagaggaaggttaaaaatggataccatgccaaacattaaattgtagaaatctaccgtaccataggattttttttaaggagtacaattttacttataaaggcagttttaaatttaggctctatcttttaactggacctctgagcacggggcagagtctacacttaatcctggttctccaaaaaggagagatcatgggaataggccatataatatttttacagtacactttgttactaaggcatttctctaagtgtttaaactgtaccctttcttattttaaacacactgagagtagcccccgcccccatagtaacaactatttactgtaagcagctgccatttagccatctctaaaagcatattacctagctgtcacacagaccatggtaaaaaaaaaagttatcatcatgcaaaataatatttgataccctcaaaagctaagaatatcaagtaactaaatgcaaggaagctgagctttagacctgagaagaattcaccaatgactcttgaaactccacagagaaagcagaagacctcaaaagaggggtgtgtggcacctttatgctgtgacttttaaggggtgtgagttattagactccttctcaagatgttttttcacttgataccaaagatggtaaaggggaaaggaggaatagggtagaagaaaagtaaattaaataatgatttttaagaaagaaatggaacagagaaattaagcacgtgttttcttttttgtttaaaaaaacgaaaggtttcagtaaactaaaaaaaattccgaaaagcaagatccgaaaagagaagtgtaaaatcatatatatatatatgtgtgcacgcatgtgtgtatatacatatacatatacacatatataaaggcattatatacataagaactttaaatatatttataaggcctttatatatatataagagatttatatatatttatatatttatagctctcttttctctctctatatatatatagcttgaataccaccttttaattaagctgattttaaccatgggcctcctaatgtatactatatatgtatatacagacacacacatatgtatatacacacatggagagagagcaagagagagggtagctatctatatagagagaaagagcttggatatcagcttttaattaagctgattttaaccataggcctccaaaacaaaaggttgggggggcggggagaaaaagacaaggaagaaagaaaaataaaagaaatcccttcaaatctcctactacataaatatcaaaccaaacccaggctgccttagtgaaaagggcagaatcttatctaccgaactacggtgtgaggtggctgtcattgctgtttctggaagaaaaactggaggtagcttggttagtaaaaggtggccttgctgtagatgaaacccatcaagtagccaaaaaaaaatttttggatcctttttcctggctgtttttttttttttttcctctcatttctttttgcaactgcagagtatttcagcaattttaaaaggccttgttaggcataactcggaactctcattcggatttgaccaagtcaggtagagttggtcaaatctgatgggagaaagactgaaacagcaacaacaacaatgaaaatacagttatttagagctctgatggtaaggagaaattaagaccagcttgttgtcagtctttacttttagtcattaaggaaaactttccaagacaaaactccaaattcatgtacttaatatagaaacggggcccagactgaagactgctttctaccaacatagaaggaggaaaaagctcatacttaccctccctgttgaaagccagctgaaactccggaaaggagctgctagccatccaccatcctggaagcaggaaaactcacttttttaatggaaatgagtaaaattctagaaaaggaattgtacatcaaaataaaccttagatctcaatgaaatttggggagatcaggaattccttggaggggggaaactcccagatctcagcaaattgtcatgttggtttgggcattgtagatagcccaggctagtactaagaaccaataggagttttgtcatgggtcagggtcatctccagtcagagtcccttccattggtcaccaattggtaaaaacaaaaagtatctgagacaggaggtcttaatcaatttgaagtttattttgccagcgttaatgacatgcctaaaaaaaggaacagcaatccacaggaacaatctgtgatccatgcctttttccaaagataattttgaggacttgagtatttaaagcagaaacgggctggagggtcaagagggagggcatggtcactttactcaatccacatgtgaggacttgagtatttaaagcagaaacaggggctggagggtcaagagggagggtatggtcacaatactcagtccacatgtttcaagacgaaaggagcaggtggggggatagtcaaatatgtattcctctccagtaagtccgcactttaggtgagagtagctgcctttggagatattctagctcttaatctgcaactatttgcttaggaataaaagggaaggcagttttttgcatgactcagctttcagcttaatatatcccttttgtgatactcaattgcgggcctaagattttattttcttttcacaaccaccatgttttgggtctcagaaactgaaaactacatgtgtcattcacttacatgagaaaaacagagggcaggggcaaatttggaggagacaattaagagatataaattgaggttataggatttgggatttctattttgtttccagataccgtcaactgcacagatacaaaaaaagtaactacgtagaagatttaaccagagttggggctctgtttctttcttttcttttccttttctttccttttcttttcttttcttttctttccttttcttttcttttcttttcttttcttttctttcttttctttctctctctctgtctttgtttcttttttaggggcgaatggggtagtatattgagaacatgtcaggaagtgtttatacaaacagtcataatatctctcttgggtgaggaaagagtgagagcagttcagggcaagtgagagcgaaaagctgctagggtctatatagtaaaagtctttgctggaatgaagatattagaatgagtgagccagaaaatagaagatgaaattggagagatgtgtctgtaaaattactgtaatgaaagggatgagattgtgggtgatgccatgatgctatatatatggagtggctggcggaagtatgatgggtggctgaattattagcgtgaaggctgttatggaactgagatgcaagagtactagaatgttcaccacattgaaactgataccaccaagaaagtacacactgtgagaggaaggaggcagtagctagatggtaaatactgaaagaatgagcgttgtgactccatgaatataaatgattaccaggaaaaaaaaaaaaaaaggtttagtggactgtgtagattgatggcctaaccttcaaagctggaacttttcagaggatggaaatctgaaattttgaaagcagcctgaggaacaaagaggacatttacctcacttcccagcccagtgctctgaattgtgctgtagagaaaacatgactgcttgagagtacagcagagaaagcaaggtcctctggggagaacccaatcttgtttagaagaagggaaggtttagaaaagatgttgaaaatataagtaattttgctactgactgactgatttcagagagaacagagaaaaaactgtaatcataattttccttgtagtttatctggtaaaaaaaaaatgtgtgtgtgtgtgtgtgtgtgtgtgtgtgtctttgtgtgtgtgtgtgtgtctatgttatagttaaacttttaggttttatttttatgataaacatatcagttactgtaaatcaaaatttgttcacatttctagtaaggtgcctagtattaaagatatttattattttcttttaattcatgaagggtatccttgtgtttatttctaatcttctctgataggtattcagttaaagtattgccgaatacatcaagctttgaccttcaatgaataccattatgaaacagagtgattcaataatattcaagacattgagaagacacttttctaacttgtacaattcttaagatcagaaaatagtgtgaagtcaattcaatcaatacaggatagttgatgaagctaaaagatgttatttattaaatgtaaatctcttgaaagttttttaaagagggaatcaaaatttaaacagtgattataaatccctctacgtttgatgacacagggatacagctgctttcctagtcacctaaggcaggtggtgctttactgtgttttacagagctaaaagaaatgaacatttttctttgagaaagcggaaaagcagatcagaaaaagacttgtcagaagatacagtgattattactactgtttcttatatattcagggacactgtgctcagtgccatacctacaatgaagatcacagttccaggccccaatataatcttcggctgaaaaacaggtggtctaatttgttttattatttaattatctcattaaagaaagaagcaagattaagactatgtgatgtattatttggcaccacagccttaatttcctcttcaatattgtggaaaaatatattttgatgcaatttccatgtcatgcagcatgtttctgaaaaaacagtagataatatacattcttttggaaatattttgccatttctaaaatgatgtatgaaaattagcaatattccatgcttgagttagcagagaaaattgactgacttgagattcggaggtttttgttttatgaaacaatgtacaacattatattatatattgtaggtaaagctaaatcatttaaataatttcctctagttccatgcaacagcaagtaagatgcatagcttttaattttctttgctatgcccagaagtctttaccataatccaattttctcacaacttttgaagtctgtgttaagcaataacatacggcaagtttattccaacgtaggacacagcttctcaaatcagagccgttttaataattattaccaataggaactttgaaatctactgatagtagctgaagagataaagtgatttgtctttaacagatgtgtttcttttaaattattcattttcagaagcatatttctgtataacaggtgcccaaaaattgctgtggaaatatgaatatatttagaagactcctatttatgctaggcatgttgttttgacaattcaagagaaatttctgaattaaaatgaacatcatacttctcaatttctcagaaaaggtagtaatcaagagtatttggtacgtatgatttaagatttaatcttgcatccaattttaggatcaaattttgttaatatatttctcagcaaagagtataatcatcaaccatttagtcaaaacacttgaggatgatgtgacttaagtctagataaatgtattgatatataattctcatatcagtcttttagtatcaatgccatttttaaagtgtgaaataatgctcctgaaatgtaatatcacaacatgatattgggaggacaaatatattcttcttttcattatataaagggcaatttgacaattctcctgtcaaattgtcatctttttgtagatgagaagtacatttttcaagacatcatacttatgccatcttaagaaacaatgtccatatcttagtcaatactttttaaaaacagtttatttcttgctcaagaatattctgcagctgtccaggtgacatatcagctgttgcccatgaggtgattcagggattaagtcttctggaattttttggccttgctatctcaacaggggttctacacactagcagtgacagggagagctcacactgaaactcacacctactccctctctgctgtagacagaaatgacatacgtcttcagttcataatactctaaccacatctggttacatgcatctacttaacagcaaatggggcttgaaatgtaggtgaaaataggaaatatttggtgagcattacttactctgccaaagagggatacactaagtcttaaatatgccaaataacttgtttatagggtacaactaaaaatatccagtacttgatattgggactagttctgtctataaccaaacctacactatttcttgcatagtgacctaccatcatttattggagaatcgtatacatagacaagcttcaattaggttgtcatttattctcatatttgtggcatggccatgtaggccatgaaattatatatgaggaagtatatggggaagatggtaacaaattgtagttctggtctgtaacagatatattcagaattacagtgcaaggttttataattattttaaaaaggtcgtattcaactttgaaatgactcataattttatcaaattttcatagacatttcaaggttgaaatgttctctaagttcatgcagtactactaatgcatgatctcatattacaacgctaccaaagatcttaaatgttctaaaggagtaaaagcagatcatgatcatttggagtgagagacacctgatttgaattccaattgactgtagtggtggcagtgatgtcaattactacatattgagtgctgtcttgggcactgtcattagcacgttacaaacgttattttaattactcctatggagaatcctatgagatagaatttcataggatgccaccataattctctccatttcacatatgaataaatggaggatcagagagattaaatcatttatgctcagatccacaatgagactactgtgcatcatgttatcgtctctaactctgctttattgtcctaaccactacatagcttccttacatctttcacagcatacgtttgaatcttactcactttatatttgtttaggatgttctgtttaaggtacagtttccccatcttgtatctattctttcaaagtaattggtgttcatctcaagatcgtgtttatgacggacagacatcatcttgttagatttagctcatctgataggtaaatccaaaaaactttactatcacctccagattacttctgacaatatgcccctttcatatctaatgaggacaataataatatgttacatttacaaaatactcaaaaattcaacattttattatctcctcacaataattctcatagcggttcctttgatgtccacactattttctttgccatttaactagtcattctttcttgatcataagatctccttcatacactcaacatcgagatatttgagtacctgaaagcttcatcctggttccctttcatctttatttataataacctctccctaaaaggttttctctaccttcatgatgttaattctgttgataagctgaacacttccaaatttgcatctttagcactggtcttttcagtgaactccaactgtctatgtccagcttcttactcagcctaataggcatctcacgtataaatgttcaaaagtgagccctgatttccacctccaaaggtttcaccaaatctcaaagtaaagaattgaaaatgaaatttgtaaaatgttatgtaggcccagagacctagtactttacgtggcaaagagcggtcgcttacaccatgccagatgtattgagatgatcttcaattataaaaatacctgatgttatgttaaagtcacacaactaggaatggctactggtatgagaattaaaagtggttttgccgctttatgtttctaagatgctcctttctttacgtaatcatctataatttgacttcatacattattattcttaataaatatatattttatgataaagttaattgtagagactaagaaagtctgattaaagtataattttaaggtcaatagcagaaaacacttaaacaatatttcccgttgtatacatctttttcgtttttaagctagtcataaaatatattaaaagtgattaatttgggctgggtgttgcggctcatgcctgtaatcccagcactttgggaggctgaggcgggtggatcacctgaggtcaggagtttgagaccagcctgaccaatatgatgaaaccccatcgctactaaaaatacaaaaattagccgggtggcatgcgcctgtaatcccagctactcaggaggctgagacaggagaatcgcctgaacctgagaggcagaggttgcagtgagctgagatcgcacacttgcaatccagcctgggcaaaaaagcgaaacaacatctcaaaacaaacaaacaaacaaaaaaagtaattaatttgaaagggtaaaaactccacagaaaataaaacttcccaaattttcaccaccatagggcaatcaccattacaatgctaatgtattttccatatattaaaaatgttttctagatgagattctgttccatgtacaatatggtattctgtttctgtcagttagttagtataagaatgtttatatatcattaaatgcttgtaaactatcattttagtgcaacatttaacacatgagtaaaggtttattcatgctagaagcttaataataaaataatgaattattctagattcccttaagatgtacttcaactttacaaattctgattgagtcaataaatacttaataaagcatgatgaaagtgccaaatcataatttatttacatgcatatttcaggaatctttttttaaaataaagatttttgaatagtaatttagaacatttattgatgagtctactataaggaactattcgtcttatctctattttaccagccaagatgttcaagtgatgactatatgtcacatatttcatgtcttacagccagtaattgttggacaagaattgaaacctggcagtcagacttcagaaactggtctcttacacaattttaggtcacctaaaaatatctttctgccttctttattttccttcatattcttattttctcctatctctttatctcttcatatctctctctctctcatacacacacaatatataactttttctaattcatatcatttatttaatttataaatatatttatgttagcaaaacataaaaattatctaaagaggacactgtatacagtgatgtgttttcctccaaagctctaatttttcactcattgaggatcccccactcatgtcacagttaactattcagtaatgtttgtgcatcaatccagagtttttttatacatatgtaagttcataaaaatacatatatacctctggcactgttttccagcaaatcaactttacacattaaatggcctgcttcaggaccaagttaactctcagcacttacacacaaagtcaaaatacagtgtgcaagtcttcgatgatgttgtgacgctatagaactggtgatatgtagtgaacaaaataagcaaaatcacacataagttaaataatttctgattttaatgaacactatgaaataaaaatagaagaaaatgggttataaagtaatatgtgccatttatcttttcgatagagtgacctaaatgatgaggattacacatataagcatttgtataaaaaatgcccatgggagagaaataagctcatattaaaaggccaaaggcaaaaacaaattctatgtaatcaaggaacttaatgtccagtacggctatagcacagactgttggaggagagcagagaaggaatcaggaggcatgttaatgagctagttcatttagatgtgtagatctctgtgtgtgtgtgtgcgtgtgtgtgtatatatatttaagattttagagaggaaatatgcactgtgaatctaaaaaaataacgttaaaaataaacttgtacacaaatgggctaaatacttagcatttagaaatacatagacaggcgcggtggctcacgcctgtaatcccaacactttgggaggctgaggtggccggatcacctgaggtcaggagttcaacaccagcctggccaacatggtgaaaccccgtctctactgaaaatacaaaaattagcctggcgtggtggtgtgcacctggaatcccagctattcaggaggctgaggcaggagaatcgcttgaacccggaaggcggaggttgcagtgagccaagattgcgccactgcaccccagcctgggtgacagagcaagactctgtctcaaaaaaaaaaaaaaaaaagaaaaagaaaaaaagaaatatcacaaatttgtatctaaatctagatatatatttataagtatttttagataagatacatgcatcttgccgctgtccaacaattaagattcacaaatcaatttatgcaatgaaatacattagtatttggtaatggagaggaaatagtatttaaaatatacataaaacatttagatcaatgcagatgtggttgtaataaaagacaaaatgtagaaaacaatatggatcattcgaataaatcagaaaaaatggtaaatgttaaagcattaagatgattgaataccataatgaatgcattagtatttctgtggttatactgaggatttaattcactctagaacagtttcttctgttaaaacagaaaacattccttcacatttttttctataactttcaataaatgaggataattacatttagaagtgatttatcttagtcagtactcttataaattataccagctaatttttagtgaattaagtttattgggatactgctgagttaaaagggatatattttgctgttgaaattttcttattaagttaatgacttcttgtacacctaaaatgacaactggaattattactaacatttaaaatctgaactgtttggtttgaacataaaatacaatttcttgtttatttgatttgacctcctataatttaaaaaattatatatataaaaatattattaagggaatatttgtataccattatacctaacacaaatagtcaacttaggttgtctaatccactgtgctttctgcaaagactttcagaattatttgtaggttacctgttcagatagataatcactagttgggcaagattgttaaaacctacacaagattgttggactttggttctctgatgactttgtccatagccttgtgtaacatttcttcttcattcttttccattcttacataacttttttttttctggatgcttaatatttggcaacatgaattgatgatcttaaaatgtcagcaaaaggggaagcattatgaaggagcaagttttgaagtgcatagatatgtccaggcttggaagtcatattctgttggtgaaaatgtaatcccgtgatcatcacactaaattgcaagggaagctgggatacgtaattagctgtgtgttcagtaagaagagcacactaattacggtgaactgattgcaatctcctacactctagatgatatcataacagagctggtaagacaatactttggtttttaaaatttttattattaacattatttagagatgagggtcttgctatgttgtccaggttggtctgaaacacatagcctcaaggagtcctgccactcctgcctcccaagtagctgggattacaggtatgagccaccccacctggaaatactttgtatttgatattttaaggttgaagttgtgtgagccttgcattttctctttagcaatcaattaacaaatcatgccttaactctctctaaagagcgtcaaaatattgagaataatttctgattagtataatatttagtctagttacctcatcttaacctcttttaaacaattacatatgggattcccttttgtattgcttttaatcttaactactttatacaaacaataaaataatcttgaacattcaaattctcctctgccctaatttttgtctagatctttcctagaactttctaacatatgttagaaacacccccacgttaatatactagcatctaaaactgtctcagccccttgcactgaacatgtgaataatgttctggcatagcctatatttcctccaatgtgaaactgcaaaattctcagctcttgtttgaggggcagcctcaaactagcatctccttcttccctttttcattgatgattggatttggttgcaccaaagtaacttatgagaggttgactcaaaataggaattgatgcattcagattgttttctcaaaaattaaaattgtaaaattaggagtgaattaagcatgtggatattaagagtcttggccatattagtaactctaaaacagtttggtaatcttacagcttggctcagaactctttttttttaaatgcattgttatgaaaaggctaaagtcttcaaagtcatttttaatatattttgagatgtgactccatgcgtttccatcagtgtccagcccatctggactattggattgagatctggggttctctgcctccgtactattgataagaatgagaagtgaattccaggaaaataccctgtgttatctctccattaaatcctgagttgtaatctcctccaggatgtttccctgatcatcctaagcagaattgctctgctaccttttttatggcattttcacatttgttgtagttatttgagtgcatgccttgctaactttgttccatggaaagtactggactcatttagctacccatagctatgagggctatatatattttttttttaagatggagtcttgctctcttgcccaggctggagtgctgcgtgaccttggctcaccgcaacctccacctcccgggttctagcgattctccctcctcagactcccgagtagctgggattacaggcatgtgccaccatgcccagctaatttttgtatttttagtagagaccgggtttcaccacattggccaggctggtcttgaactcctgaccttaggtgatccacccaccttggcctcccaaagtgctgggattacaggtgtgaggcactgcacctggctttgagggctgttgtttaagtatacctgtgttaatcaaagagacagagtttttgtggaaattatggggacagagctctagtgtttttctatcagcgtgttttattttaatcttgattatttggtgtgactctattcgtctatgtatgcttgtgaatacgcatgaatatgtctgtgactcctgcaataaaggctagaacaaagacatataaaaccagtttcttgaatttgtaaaatccatgctttagtttctttcccaaatcctgcactttaaacctctatggtaaaagaaaaaggaagcagagatgatattataaccagtaatgagaaatctgtggcctgttccaagtctgtgaacgaagtgatacaaaacatgactactgagaatagttggaaattgatgctgtgggaagggtaacattcctggtaggaagcggatccatgtggatggcactgtgattggccagacttatacatgtctccttgcctatattgatattaagactttccaaatttttcttactttatgatgtctagcactgtgttatttatttagtaagtattcaaaaatagttgaataaagtgataaaataattcacaaaagaattaatatttgagtgtgaaagtgctttgaaaatgaaaaaaataaacagacaaagatactggatagaagaaagaaaaacaaggattgaagtcactagcgacttgttgaataaaagactgtctggatctacctatcaaaatgctcagacaaatgaaaacatggaaatattttctttgatcctaaaacaggtggatctgaattacaagccatccaagaatggttagctcctgccctttttcctttttatctatgtgtaattgtgaattattcagaaggatgctgcatggtcccaaatgaattgttgttattgatgttttattatgtaaatatttaaatattgatttttcagaaatagtgggtagcctgtgtacattttcatggtgttttgacaaaacgttgcaataagtgtcatgagtcagtttttgctgacagtccaaaccagaacgccatgaaaaatgcaaactgatgtcacttctcatttgtaaaaggcttcaaaattatgaattcataaatatttaatagcaatggctcaaatagaaatttgctctgttagagtatacgactgcttgtgcatgcagcatatagagctatgctttcctgagacagtgctacctagattacaaattagaaataagatagtatcaggtggttttctaggaagtgggtcattggctggtgacctaaatattgtacttaaaatacttgtttatgggtcattaattttaccagtctgaaacagataggaatgccagtggtgttaaagcttttatgatttggaacacaaagaagcaggactatttttgaatcttttctattgagactttcagtaactttattgaaaatataggtgggtgccgtggctcacgcgtgtaatcccagcactttgggaggccaaggcagctgtatcatctgaggtcaggacttcgagaccagcctggccaacatggtgaaaccctgtcactactaaaaatacaaaaattagctgggtgtggtggtgggcgcctgtagtcccagctcttcgggagggttgaggtacgagaatcacttgaacccagggggtggaggttgcagtgagccgagatcgccccactgcactctccccttgctgacagagcaaaactctgtctcaaaaagaaagagagagagagagaaagagagagagagaaagaaaatatatcatttgttaattaactaccaataatttcctgaaaagtcatattaagtcagaggttatttgtcagaagatagtactgaaaatgaaggaaagaataaagaaacaaaatacacaggcttctgtgacattgtgatgtttaacaaacaagcaaatatcctagttaaaaatgatggcatatgtgtgtaaaatagtgaagagctaaaatgcccaatctcactatgtttacactttctgtgcacgttagtgagaaaaaaagtgtaataacacctaacatacatttcttcaatgattatctatcctttattcttgtataagcagatacaaaatctactgcttacttgccaacattacttcagagggacagaaacttcagtgtgcctatttaatcatatcaccttaatcttcttttatctgaataaatacttcaaaagtttgagtgtagtatagatatacttacatacatatatgtatacatatatatttggcctgtgtgtatatatgcatctatatatgcaaatatattgcctaactagctaatctttatatttttaagatcatttatatgtacacatagtcaaatctagtcccacctcttttcctacaggtatccataaataaagaatatcaccatgttgatactagagagttaatacagtttttgttttaaattttatgtatgtgcctgaatactcatatgatcaaaatttaatcgggaaacaattagttaatttgctttatagtttgtggttttccaccttatgggataatactatatttatgtgtgtgtatttatatatatttatatatacatttatatatttatatatacacaattatatttatatttgtatatttatatatgtatatttatatgcatgtgtataagtgtccctatttaatcatatatatagcttatatataaataatatatgggtgtggtgtgtgtatgtgtgtgagtgtggtgtgtttgcatacatatatgtatgtatatatcctccttttatttttattcttaagagttccatttcacctcagctaatgaggtagagtgttagtcacattggtggcaataagtaagtttataataaatactactttttatttcactagaaacttttcagagcatttatggtgcctgaatacacaatacttgtttaataacagttaatttccttcatttctcaatgaataaattctctgttcaaatggcgcctccagtttcttgattgtgtatcatattgtttgtagcaaacatttattcacacttacttagtgctgggcatgtatgtacatctttactaacattaatttatctttcccatatgtaaaagacaatttttcttgcattctttacattggatttactctctttttattctatcctcaaagagtcaggatgttgctggatggaagaataagagatgttaactaaggaaatggacagcgtcctctatcttccattcactcaaccattttcttttttatatttcagaggacgtaacattatttaatatgtggttcatagaagttcccctctcttttaaagtacttccttagggccgggcgcggtgactcacacctgtaatcccagcactttgggaggccgaggcaggcggatcacctgaggtcaggagttcgagactagcctgacaaacatggtgaaactctgtctctactaaaaatacaaaaattagccaggcgtggtggcaggctcctgtaatcccagctattcgggaggctgaggcaggagaatcgcttgaacctaggaggcggaggttgcagtgagccaaggtcgcaccacggcactccagcctgggggagaagagcgagactttgtcattaaaaaaaaaaaaaaaacaaccaaacttccttggatttgtagaatcctcatcctcatgttcttgattactgtggctgcatcttatcttagtttccctctgcctctcagattgctcttatacagtttcctttgttgatttctcttattgctggattttagctgtggacatttttgaagccttggtgcacattattttctttctgtgacattttatcttaagatctcaactttggagaatgtgctattgatcacaaattataatttagattctgtcttttcttctgggtctggacaaatgttcttaactatcatttatattttcacttggttagttcagtatcacctcagttttaataaatttaccactgattttattatgacttttacctgcaaatttttttcttccaatccttctatttcagtcagtaaagttattggcctgcaaataataaagatgtaaagttagccttgaaataaccttgtttttattattatctttcacttttatgtttagtcagctaatctggtctgtatgctaaatgaatgtgcatttgaaaagtgatttatagaagcaaggttttatccgaatgaatacaatttattttgcctgtagtcttctttacattgatatttctgccaccaaagatctcttgcctattaactcaataggctatgtactctcttagctgactttcctccttaaatatagtcaatacaatttaggctagtcctcctcataaggttgaatggacttcattcccaacctcagtaatttctagtacccttccctacttcttagcctggctttcaaagactggtttattcagaatgtctccccctatttttctgggcttacttggtctggctcttgtatttataagctttttcatgttttgaggcgaagggaagtctaagcctctttgccccaagcctactgttgttcatagtctattttctgggctgtaacaaagggagaagactttctaagccaaacaaacataagcttagacatcagcattatcacttactgacagactgattagccttgataaattacttaaactctgaacttcaatttcttcatttcttaaaaagtgataattatatctacctcagagaagctatgtagggattgacattcatgtatattaaaaatatgctgctgtttagaatgtttgctataattattctctactgcacaacttcagagtaaacttaatgttttgttttaggcacacgatttttcatatttattaagcacttcttgccagtttgtctcactgaccctttaaacttaaaaaaacagtatcttaactatcctcttctatcattgtgagcatttatcacaattctgaaaatataagaagataatagaaatcaagttagctgatttcaacttctagatttactacttaacagccatacaacttaatgaagttataaaaattccctatgccagtttctttatttgtaaaacagaagtaaattttgtaactcaagggttattgtacatattaaagtaatcaatatgtgtaaagtatttataaaagttctagttatggccaggtgcagtggctaacgcctgtaatcccagcactttggtaggccgaggtgggcagatcacgaggtcaggagttcgagaccagcctggccaacatggtgaaatcccatctctactaaaaatacaaaaactagctgggtgtcgtggtgggttcctgtagtcccagctacttgggaggctgaggcaggagaattgtttgaacccaggaggcagaagttgcagtaagccaagatcgtgccattgcactcctgcctgggtaacagggcgagactccgtctaaaaataaaataaaataaaaaagtactagttatgtggaaattgcacctcataaatgtcaattcattattgtagagaaaatctctaaaattagcatgatttgcttgaataaattattttataattacattatacatttattgtagagttatataatagtaagttaacattatatatatctatatatttgaatttcatcaaatttatcgctaaatgtgttacagaaacactaaacatgcaaaggataagagggctttcaaaagtcatccattgttggaaaaatataactgagaagcatcatgcagaattctacaatgaataatatgaaagacccacaaaataataaataaaattcttgtgtatagtacctacagaaaagcagaaatttgtttgactacattaataagtttacttgacataaaaaccatgggaggctaaaaactgtcaatacattctgctgctattagctaatgagtatatcatgcatatgcactattaatcattagtttttcaaggaacttgtggagaaaagtaataaaataaatagaaaccaagaacagtttagaaacctttcgattttataaacattacattatttatctagttaaagataattatgttgaaaaaggtaaaactgcaattttttgtgactatcaagagtaaatccctaccctaggaacctgcatttttcagtttcatgaaattctgcacctgaaaatgcctagggtaaagatttactcttgttgtattatagatgtggaaattgaggctcaaaaagttgcataatttgcctaaaattgtacaattgtttttattttattttattttattttattttattttattttattttattttattttattttatttttgagacagggtcatcttttgttgcccaggctggagagtggtggtgtgatcatggctcattgcagcctctgtctcctgctggactcaagtgatcctctcaccccagcctcccgagtagctgggactacagatgcataccaccatgcctggctaatttttgtgttttttatagagatgggatttctttccatgttgcccaggctggtctggaactactgagctcaagcgattcgcctgtcttggtctccaaagtgctgtgtttacaggtgtgagccactgcacccagtctacaaatgttttatataacaattctcaactacctagcatgagcttaccattgtgttagcaaacagaaagaggaataaaaaactactcgtttctttaaggaacttccaattgttcaataaactttttaactcgttttcagaagtatgttgaacatgtgtgaatttttctaacttcacagaaagttcatggataatgatcttgaacattattttaatgctgacttaaataaaagccattagctaaatagatattgagttttaatcttcctctgcaatctgtttccctgtggaaaaaaaatgaaaatgttaaagaactttaattgctttctcaaaacttatatttgtatggtttgaaaattactcacaatatttaaaatgtcctttctaatatgaacaaataatacttaaggagtttgccaaatttgtgtgccattactcatttcagttagcctttcctaaataagaaaccatctcaccttactgccttgtaaaaataatttattatttctcatgattctgtggattagtggaggttcttctgctgttcctacatggactcactgatgttggtagcctttagatggagggtcagctgggaactggttcaacttggacagctggtatgtgtgggtctctctttatctctcaaggtggccccaccaggttttctcttgtggtggcagcaaaatctcagaagacaattccccaagcgcttataaaacctctattggtctactggtatcacttaggtggatgtccatttgactaaagcaagtctgttggcaaagcccagaatcagtgtgggaagggtctatggtcatggatgtattttttgctctacattattctactgaccaaattaagagatttttaaaataacaattctggaagggacagtaaaaacccttaatatttttttgatcgacaaactgatgcacagaaaaaggtaattgcccaatattaaagtcaaattaccagacagctagatttaatattaggccagttacaaaggctaaaacacttttagtgttattccccagtgtttggggaaaaagagttactgaaaagagctcatcatattactttagttaagaaaatgaagatttttcagtaatatttgaagaaactcagagaataaatatttctcactatttggcaaaaagtattgctggtagaaatatatatatatatatatatatatatatgtttgtgtatgtatgtatatgtatacacatatattgtgtatgtacatatgtgtgtatatgtatgtatattgtatagactgtctgtcctcattatgcccagtaatgttctataaagactgtgatgtccccacaaacactgaattagcaaatactaagccattgtccttaggggaagaactatgtatatagttacatgtaaaagatgataatcttaaatcttaaaaacaactcatcctagtagattctatttccttaaaagaaaacaaagtttaaatgtgttcagtcatttgcctgaggccaccccactaacaatgaaagagttagaattcaaaccctgcctaactaaacccagtccagaccttattgcactatattgtactgccatctccatcccctggtcatctcagtatgagagctgaaacaagaaggcaagttttgttctgtttaacctcagttagataggtgctcttgcattgaagcaagttttttttttttttttttttttgctcttctgcacatgtctgaaagggaaagggctttgagtattgatttttagggctccacataaatattagcaactaggccaatttgcaaatacagaatctgggaataatgaagattgactatatctaaataataagaattattctaatattaatgtactcaatggagcaaagataagatgtgtaaaaggaatatgataggggagtcttaagcttaccccatttgtgatatatccgacacagtttcagacatttgtctctgtttttcatacctaatcaaagtagggttaatttatggaatgggttgcttctagggaaaggagtaaacagattgtactcagtgagacctgagattatagcttaaagtcaagagaaaggatggaaaattttaaaattaggtaaattactatctaatagcaataacctggaatcgtttcttattgcaaatagttgttttcatcccaatattttcttagaataacattgagcctgagcagagtattcacactgatgaccccatgttacattatacaaaagttatgagatgaaattcacattagccgattctaagaactagggaggggcaaaaaaatatacaaatagtacatcaaaatattacaaatggaatgttattgggctacacaatgaaaaatgtttctatttcaaaattccttttaagtgtattctgaaatctcagaagtttcaaataatgttatcaaatggaaaatatgtagtattcactacaaatgagatttgatgagtgacagagttttcttactgatagtggaaattatttttatatgttagaaagcatcataagagcagaattatttttttgccgtgtctgaaggattaggcggtagacataagaaataaaattatccttacagttgatgtaagatatttatgaataatattttatttatcttttaaacatagtacctagataaaagcctaacatgctgtatacacactttctttttattggaactaaattagttttggacacataatcttcttatgttttaatcagtccgtggaatgaattttgcatttgaatgacacattgttcttttaagtcacaagactcttcacaattaccttgaaagagtaattcaataaatggtgccctaatggagaaacaattaatttccttctaaccattacatttatttgttcgcagaaattgctccgaagtacaaattgctatgtgttcaaacttcacagtaaagttctaatataattttataaaattaaatatcaatttttcatagaactttagaaccccaaagtaccttagagattacataattcaaaattccttgaatttcaaatgatgaagccaaagagcaaagacgtttgctgacttaattcattgatatggtatatattagaaaataaatgtatactgtaaaatactgtatacaattgaagtaatataattattagttttgaaattcatccaaatagtgtctcgtcagcactaatatatatgttagctcccagtccaaagtccttagttctatgacagtctgaattttctcagctaaagaaaaaattgaagtttatatctaaacacaggtgttttttttttttttttttgggacggagtctggttctgtcacctaggctggagtgcagtggctccatcttggctcatagcaaactctgcctcccgagttcacgccattctcctgcctcagcctctcaagtagctgggactacaggtgcccgccaccacacccggctaattttttgcatttttagtagagacgaggtttcactgtgttagccaggatggtcttgatctcctgaccttgtgatctgcccgcccttggcctcccaaagtgctgggattacaggtgtgagccaccgcgcctggcctaggttttaaaataatcaccagtttgtagaatgtccttaagtattgtggtagattattatagttctatgtacgaataagtcatttccatagcagtatctgaatcaagaaaatgattattatgggaaaattacaaataaaaagactgggtcaaaatcttaaattatcaggtacatactttatgccaggtagcatagctaaagaaaagtccatatattttctcatctaattcataaaacaatcatgagaaatatttagtaattttcctcatcttataaacaaaaataagaaatatcatataacgttgccaatgtaaaaaagctaagaagtggcagcacctgggttcaaaaccggtgtgctgtgctgttagtcactttgtaaggcatttctcagattcaaaatattttacctgtaatgttttattttcatatttcggttagaacctgtaaaagtagcactaaaaagtactctagatatagtaaatataagccatgaaattaggcccatgtttgattaagatattgatgaatcatattttattcatttttttagacatagtagttagagagaagcctaattatgctgtacatactcaatttttactaatcgtataacaattgaggagaggaaagcgttggagaaagggaaaaaacttgtagagaaagttgagaacagtgaatgagaaaatacctgaagcattttctttaattcataactgaaaccatttgctgtgaatttccaatggtagagaaaactcattaccagatgaatatttgctttagggaatggaagagtgaatcatcaatacaagatttcttttgtctaacagcttttgtaaatagcaaaaacaaccaaaagataaaaacaagtaattttaataagagtaaccaaatgcaattatagcctaaacttaatacaataattttcaaaatttatgagcgatgaaaaaactaaagatcttcaaatgaagcaacaaaaccttgaaaattatttttgctaccctgaacctgaagataagttaactgagtttgtgtccttaggttcctttttatataatggagcaaaatgggaatgtatatctgttaggaagaaattagaaaaatagggaaaatgtgcaaagggaatgactgccttcgatataagccaagactgcagggttgcccaattatttgaataggtcttgcatatctcctttgggaatgggatgcatcttcaagtagtatgggttgcagtatagaaatactaagaacttctaagaagagggaaaaaagcacaattattcaattaaatgacatatatttcttcagttgatttagtattccaatcttcactcaggccttagaaagataaataaaatatgaaatacccagctctaaaatttattctaaattgctaagattaatagataacaaaagaaattgcccacagtgtatttgccccaaagaaatgtctgaacaatttctgaagacagcataatgaacagaaaaaatatatgaatagtcaaaatataccaataaaggaggggaggagaaaaacaaaagttgaatataacaagggagaaagatactcagctataaaataataaaatagataaagggtaatgatatagttgggctttgtgttcccacccaaatcttatcttgaattgtaatccgtataattcccgtaatccacatgggtcaagggtgggaccaagtggagataattgaatcataggcccagttttccccatgctgttctcataatagtgagtgagttctcatgagatctgatggttttataagggtctcttcctccttcgctcggcacttcttcctgctgccttgtgaagaaggtgccttgcttccccttgcccttccaccatgattgttaagtttcctcttgatcagtagtccaacgctttacctccgacctatagcccctcctcatgattgtaagtttcctgaggcctccccagccatgctgaactgtgagtcaattaaacctctttcctttataaattacccagtcccagacaattctttatagcagtgtgaaaacagactaatacaggtaattatctcagttgttttgctgtgtagaaatacctgataacattataaatttttaaaaatgtaacaaaattggtactgtatggattggctatgaaggatactgtggaacaaagttatatcttgtataaatcacagtctatctgtgctctgataggaaatctagtagcctcccagcaaacaaacagaaaatagttgacacagaagagtagtaagcattgagccaacacaaagccattggtttgtttggttggttggttttggaaagaaaatgcactgcatatagaatctaaaccttggcaagggatgagtggtttttcttaacctgagacctcaaggtaggccagtaacctgaaaggtgctcagatagtcacaggttaataggattatttggctcagggagaagcaaatgcaaatcctctctgcagaaaactaactccaaagttggccctcaagatgctcacacacaaagatgaactaaatatgatcttaaagtgaaagatcacgtggttctcaaataaattagctacaatgagtgacagttggcagaaactacattcagaagttttagtgtccaatcccaaataattttagatattgggataaccattaacagtatataaaattttgacattcagtgggcaactagaaataaaagaaatttaggagagaagaatgtatgagtgataaagatttcattttcctgaaaaatatgtagtttttttttttaaaaaaaacataagaattatttcaaaaagaaggaataaacaagtatgcctggggcagatattgaggaataatcagaagagtatgctgttgtcgaaatcaaattctaagaggaaagttgtggtcaatagtgtcacggagtaaaaactcaaacacaggcaggccaccaaattcaatactgaagtcactttaatcttcctttcttgtctgaatgctctgtgcagaggttcccgtacctgccaaccaaagcagccgcagtaggaattgtatgagaatggggaattactgaattttcctttccaaaattactgatagtaagaagaaaagggaaaaaaagcatgaaaaattatatatattattccaagccattagaggaaattttgatgtcatttaggcgtaatattgctttgctctgtaaatgtgtgatctttattcgttagtcctatagcatcttttcaagcccagtatcttttacttttattcccaaaggatagttgtggctctacctattgcccataagtagttgccaaaacaaccaggagctctgtcaacacaggtctttctgtttcagaagtcaatttaaggcagaaagtcaataccatagtttctaaagacaattttcattgaattgcccattgctgacgtttttcttttcaacctcttttcattcggatcgatttttaaactcttttttatttcaaaactctcgaaatgaaataattgcattaaattggatgcaaacttttctaaaactgaaaggaaaataaatatgaaaagtcaactgagagttcatttaaaaggatcatcaacccaccgacagaactgacatttctcagagaaaacgtgagaatgttttaggtggttctttaggtggttcaccctgacaaaaattgaggaaaaatatatattgctaatccattacctttggatatcatttctggagtatgaatgaatgttaaatatcgaaaagtaaaacacattttaaatattaaggacatcttgtagagaattactgagagaataaatttttcccttatgtgcagtgttatctaaatcaatctccaggactaaactgtcatgtttctaagcaagggattcaggagatctaaaatgacagctttaatttaacattgtgacagaagagttcatctcaaaaaaactgtagacttttcttgggcctacatttttctatgctgcctttccaactatttgttcttttaacatttgagattgcagggctaagttttgttttaatacctactgaacaacgacaacaacagaaagcttccatggtactaaaccacatcagataaatgactgaatatgcctaattattaatatatagcaatatcacctctgaagtacatattatcattttaaagttgcaagaactaaattttagggcacattctcaaagaatatgactagatattttaatttaaatattttaatgaaagtagtacttgactcattttgtgtattgaacaaatgtttgagtatattctgtgtgtcaggcaacgtgatagatgcttctgataaaataaaaaagaagaccagcaaggcccttgccctaacagaatttaaactctaatcaattatgaattaagaaattttctgcaggtttccaaagttatttggaatcggtagataatagtgagagaatgaatgaacataggtgtatataaatatatattcaggtaatgaagagtcattattccaccaatttgaaaatattatctgtctttagtatttagctacaatctacaatctatttacagttagctggtggacaaatatttatgtaacctccctcataatgaaaaggaaactgtactaagtgctacaggaactattaaaaggaagaaagatgcagctctcaggggacagaaatagatattatattatgcatgaataatacaagtagtagctgtcaatagaatttaaaggaggaagctgttgttttagctgggatgatcagagcagttttaaaaaaagaaataggatttgatgtgtctccttaagaatgggtagaatttcagtacttggagagaaaaacaatagctgtatgtggataaaaagaaggatagaaaggtattatttcccctaaaagttttatattttgtggatgagacaaaaattaaacacaaatttttaacaggaattttgtaaaattacatgtttccttgagtatgtttaaattgaaatatgtttttaattatcagtttaaatagcgttaagatgtataatttttaaagattcttaatattgatattattaaattagattgttatattatttttataaatatggccaatggaattcaaatgcattagcaacttggtaatcacttttatgtattttttttaaatggtcatgtttaacagtcagaaattataaattatttttctccatgaactcaaattttcacttcacttcccgctgcaggattttagattaatgtaacgtatttcattcttgaaattcttttgttgacatcctacattttcatggttctcagtaattctttagaatttactttgaccattggactccaaatcttaatacttctgaattatataatcattatgagtacacaactgatcaaaactatatacatttatatttaaattgtgacaaattaataacaaagtattatttgtattgcatctgttaatgagataaatgaggcttatttagctaatttcagtaccatggatcaatattaactattgttaagaaaagatatgtatcagtgttaattctatccttatttttttataaatgtgagtgctgagaaaaattatttacacaaataagtaagtgaacataaaaagtgttttaaaatagcaatgccacttaactttttgaaatccttcagtgttacatgttaaaatttgatagagatttatcatcaaaagtcatttttagtaatcaatcagattacactcagggctcacacatgagaattgcgctataaaaagactcaagatgttgagaggtaatgcatttcttctataaaatataaaaacaatatttgtaagagaaagttaattgggaattgggaaacggtaaaggaaaaatctatatatctattatggatttgttatcatatagactaattttaggaaaaaataactgtccactgatgctctgaaaaccgatttccttaaagctattcgtgccaatacataaagtccttgaaatgcctttctgaacccaagcgaatgcccatacttgagtttgaagcccataagaagaacatactatggaaccatatagccttggtatagtgagtcatttcaagagaatgttagtgaaggaaaaacctgaagtctggggaactgagcaaataaagtttgaattaggaggaagagtaattctcaagacagcagtgattgccttggaggtctagtagatgagcaagaaccttatgtactgtaagaaggaattgcaagaagttttgtgccatctgaagtagagtgtgtaagacagagggcgttgaataatgaacctagagagctgtttggaaacaaacgaagtcagctttgtaagttaggccatgaaatacagacttacctgtggacagtggtaaactactaaaatgtttttgacagagttagttattttgtttttgtctttttaagaccttcttggggcaataaggaaaatatatcccaggggaatatgtgataccaggaagatcttttagcaggtgcttggggtgaaaaagaaagaaatgatagtttcttgaaatgagctgatggcaaagaagatggaaacaattaagtttgaggactatgaaggacataaaattgcccaacatgaaaattaatagtggggagtgaggaaaatgaatttttttctaggtattattgagaagtcaaaatgagaccagatatggagctttggatttaagttgaatgaatagtgactctcttccctaaatatttggaaacatttgaaattttttaagtagtaagactaatatgatagaaatggcattttatgagcattaacattattagaatatgccattacaatggaagagtctggaggaagtgagtatatctttaactgagactagcatgaactatgctgcatgcaaggaataaaaaggacagttttgattcagtgggtgttacaaaataaagcatgaaatgatatgaactcaagacttcaggaatatatttttttctattttaattatgtgctggtcactgcctttgcacagagcaacgaacaagacacctctgtaacctaatgaagcttaaggtctggtggataagaaagcaatgaaatatatatgtgcatatatttacaatggcaatgtgtcttatgagagaaatattaatactagttgtcatgagaactggtaacaaaagggcttaaatcttttggagaagtgagaagggcaattaaagaagtaaaagaatgagatatctggagtgagacataggctcaaatatgccttaagtcataacaaaaatagaaggagctagtattactagacacatggaaattaggagcagagattattttaaaggaaaaaaaactgggtgatttagttttgttctgtatgaagtgatattagtgggtcaacatagaaatatgcattagatagttggacatggaggactagagcttaaaaatagatggaatgcgggtgtcttccaaataaagaatgtcgtgctaaaccaggacatgcaaacatcagaaaaaaatataaaacttttaatgtaaagcaatagaaattatttaaaaattatttcttaaatagaaattatctcttaaatagaaatttttaaagaaatatttaagaaattatttaagaaatatttaagaaatattaattatttaagaaattatttaagaaataattttccagtaaaatagatacattgtagtagaaagcacatttctcatgagttaagaagtactgttaactttgttttatgtgtccaaacattgtatttttccattattttcaggaaagacatatttactctctttaaatatcagaaatattgcagtaaacaaacacataaggaatactacaaggaataattcatttttttacaaagtttaaactttaaatcaggaaattagatacatcttgtgaagcttaagatattgagaaagaagaattagaaggtaaagtaaaagacatcctctggccaacacgtattaactgactggacttaccctcctgcctaaagcgatttttaaaaactttacgaatataagaaccagtgattttcagatactgaaaatcaggaaacttgaaacagtgaatcctgaaagagggaaaagtcgaattctcgtaccttgctagtgagagtttaaagtgatatagtcactttggaatcacgttatcaatttcttacatagtaaaatacatatacctcccaaacgatccatccattccaatcataagtcttcattcaagaaaaaatctttaaaatgcccatatgaagatttgttgaaaattattcattataacaagtttatttgtaaaggccaaaaattggaaaacacctaaaagctcatcaacaggtgaatgggtaaataaattgtatccacacaacagaatattactcagcaataaagttgatgccctcaaaacatatatgaatcttaataattatctgagtaaaataaaccaagaaaaagtggacatattgttggctttatttataaaaattattttaaaatgtagatgatatatagtaacagaaagcagatcagtagttgactgggattcggggaaggtataagtaggtagaaacagaagggcaaattctaggcaattgtcaaggtgtatgtttttgatgtgctactgacattttggcaggataattctttcttatgcaggtaagaactgccgtaggtttgtcgtttctggttttctcctactaaacatcaatgttgtcattcacttataactaaaataaatatttttctctatattttcaaatgccccaagagatcgcctatgaagaccaacaaggatgtgaggagaaagtacagcctaattcacctaaaaaaaatctgtagaatacccttggaattccttgaaaaatttgaaatgttttttgcaagaatttgtttaataattagaaataaacatttactaagaaagcattgatattgcttagttccttgggatgttcaatatagtagtaaatttctgactggagctgagcctgtcaaaagttgtattctagtattctaatcctagacgcagcattgtttgattagcatttttttttctgattccagtttcacaaagtataaactcttttccatgtctgaatattctgctaaagtgctaacactttcaagaatgtgctaccctctttaaaatgtgcaacttttttttaaaatgtagaatttaaaatagaattgtgttacaatatcagattatgtatttatcatgatcataaagtaaatgtgttttcttcaaaattattttttgttttgaggcatttttaaattgatgcctaaaacttcaaagcatgttctatttatgctattcaatacaataacccactagtgattagtagccattgagtactggaatagtggctatttttactgagaacctaaatatttagtttcatttaaataactcagtgtggtttgtggctaccatattatacagcgcagttctagagtgactgggaaggtataacataaccattgagatttacatgatcactctctgtattaattctactaaaccactgactctatttttaaaataccctagacacattgaaattaggggaattgataaaagtttgtattttgtattttattcagggagaaagagaaagaaacaagaaacaatggcaggaaaaaatgtgtagattgtcctttttctttcttttttttctttttttcttttcttttcttttttttttttttttacatttttcaacatactccacaagttggcaaaaatttctagagagacttcttcaattgtttaagtgtcatgaatgagcattatattgatgtgccctggaagaaatattagctcaacaggtgttcactactgtaagttgattcttaactagtcccaaccagtatggtgattaataatgtataaatatttgaagttaattcatctttttgaaaaacaagaccgtaataatgcctttgtcactcagcaaagactggagttaacatcctccaaaagagtccggtagtactgaatacgcccgctcccttgctaacacctgaaacctatactgtaattgtcacttactggctgctacctcattggtgaattactgatttgtagattaggactgcaggagtaggggaggaaatttcaactagaaaatgcaatagcttcggcacgacggctcatgcctgtaatccctgtactttgtgacgctgaggcaggtggatcatttgaggttaggagttcgagaccagccggataaacacggtgaaaccccgtctctactaaaaatacaaaaacaaaacaaaacaaacaaaaaaaattagccgggtgcggtggcacatgcctgtagtcccagctacttggaaggctgaggcaggagaattgcttgaacacaggaggcggaggttgcagtgagcagatatcacgccactgcactccagcctgggctagagagcaagactccatctcaaaataaataaataaataaataaataaataaataaataaaagtaaaaaagtccaggcgcggtgactcatgcctgtaatcccagcactttgggaggccgaggcgggtagatcacgaggtcaggagatcgagaccatcctggctaacacggtgaaaccccatctctactaaaaatacaaaaaattagctgggcgtggtggcgggcgcctgtagtcccagctactcgggaggctgaggcgggagaatggcgtgaacccgggaggcggagcttacagtgagccgagatcgcgccactgcactccaacctgggcaacagagcgagactctgtctcaaaaagaaaaaaaaaaaaaaaacaatagaagaatgaatgaaaaatccaactttcagtgaagaattgaactcattatacttaaaaaatgtctgctattccaagctagtactgtataatgtctatactgtataatgtctgctattccaagctagtactgtagctatgtaatgagcatagagaatctgagacagaatcagtcatttatagctataaagaaggaaaaatagaaccatttaatatattatagattcctttgcatgatttgtaatatttgtttgactaaaagtacctatggcatctgaaatgaaaaatgcaaacttatttctgatactacaaattaattaaattctgtaaataagtatgtatgtgtaaagacagaataatcaaggaaataattttatgcttcctctattcagaagctcgtcttatatagtgaaatattttaaatagcagtttttaaactaaaagaagattattgatttttctgaatataaaaatgatccttctcactaaaatgtgatcaaataaaaagtaaaactataccctatactgcaaaattataatattatgatgatcatagtgaatttttgaagctctctttactaatttctttaactgggtttgtaattttcctccatattatagcagacagatgcagctgttgaaagaagacttggagaacacattgtggcttatccagcataagtgtgctaagtgttccttggactctattagtgatttccatattcagcatgtaactttggggagtatcttatgctgcctttgaacgtaatcacaattttttgaagtgtgctcaatttataaaattaaacagctgttccatccaggggaattggggataaatgagcacatgttatcattggaagtggatgatatagccctagatatcattttcctaaagagatgcaaactttcattttaaatcatgaatccagcaatcaaacaatttcattgatgatctagtttgaaggtattcagtatgaacatatttgtgaaagctggcaaatagttttaaatatatttataggtgatgagtataaaaaaagaagatgtctaagtttctaagtattatggctatgacttcttggtcccttgaaatataacaggaaaaggtgtctgtttctttatgttataagcattgaaattgaattacatactcagagtattttggaatcttgaccaaagttatttatgcagttttactattgggaacctacagattcaattggttgaagttgaaactgtatacatttggattaatttgaggttgttggattagaatatgcagtgtttttcccccaaacaaaacaaataataacctataggaaatatgttataatatgtatatatttacataaaaatagtttaatcaattgttaccactggagattggtaaccaactcatttcacctcaaaattcacaacttgtgggtaacaactgtagttagtttactattttattatcataaattagcatttacagagcattttgctttattttttatttggaatattttggaataaacacagggccatatgcaagataaccaaatattctgctaggagttatttctaaaagttaatgattcagcttgagaacggaaatcatgcagaaaaatgtatgcaagagaaagttaatagtgtatgttaggaagacaaataatgcttttgagtaaagtagagtagtcccttctaaaagtagtaaatgtgtgggtcaggttggaaactggctaataaatacttcacctatttgtttcccttctcattactgatctgtgttcttcagttgatttagccccccacagcttcctttcgttgctccaacactgtggtcaactttcattgtcttttactgggcttaaattgtttttatttaaagcaacaaatatttttctaaaccctatgaaataatacagtgatatcaaacacttctagcccttgcactttctatgcattatacatatatttaatgtttacatattaagtaaaaatatatttaatctagtttcattatagtttctataatgtattataacatcatttctagaatttagacaatatgtgttttccataggcctcattctcttgtgttcagtgctacacaccagcttctagaatattacttggtatatagtaggaaatcagtatatatatttattaaattaatgaataaattaattttttttagataagctgtattggtctgttcttagatagctaaaaagaaatacctgagatggggtaatttataaagaaaagaggtttagttggcttatggtgccgcaggctgcacaggaagcatggctgaggaggcctctggagacttaaaattgtggtggaaggcaaagggggaagcaggcatgtcttacgtggccggaacaggaggaagagagagaaggggaaggtgccacacaccttttttttttttttttttttcctttgagacggagtctcgctctgtcgcccaggctggagtgcagtggtgcgatctcggctcactgcaagctccgcctcctgggttcacgccattctcctgcctcagcctcccgagtagctgggactacaggtgtccgccaccatgccctgctcaattttttgtatttttagtagaggtggggtttcaccgtgttagccaggatggcctcgatctcctgacctcgtgatccacccgccttggcctcccaaagtgctgggattacaggcttgagccactgtgcccggctgatgtcacttttaaacaaccatatcacatgagaactcactcacttctacgagaacagcaagggggaaatctttcctcatgacccaatcaatcacctcttaccagtcccctcttccaacattgggtattacaattcgacatgagatttgggaggggacacaaatccaaaccatatcatgtaccattcctaaaaccttctgggatttttattattctaaaaaattcactttaccttctcgatatctttgatattcttttttcagaaccccatgttgtgttttactttgatgtggtcaatctttctttgatttttatatggtttcttatatagtttcctgataaagactgcaaagagaggcaaaactttttataaattttttattagagtaggcaaggctactgtgtaataacacatctctaagtcttaaacattaaaatgaaatttaattgttttaattaatgaaatattagactgctgtagtctaactcaagaggggattaggggactttagggctctgttccagtcattaggagacttaagctccccctatctatgacactgaaaccttcagcacatcacctccaaagccactactgagcgggaagagagggtttggctgatcacataaggacatttttattttgatttttttttaaatacggatttcatatttagacagagaagtgacatgtacataattgccagcacattctattggccggaagtcaatcacctagccttactcaactgcaaggagaaatgggagatacagatttcctatgtgcctagagaaaaatgaatgtatttactgaatgcatagtgttatctctgccacatcatggatatctgacaatgtctttattctttcctcacttgagtaatactttgactatagaattttagttcagaaatcatttttccacagaattttgaagataatttcattttctctgaagagacacagtgtttttttatgtttaaaacataaaaacaaactgatataaaacaaaactttaatatagttatatccaaatgatttttgttctatatttgcgcttttttgggtctttcttgggaacttttacctgttaaaatgtgatgaaaatgctatcctgcagtttttactatttactttataattttccccttatatttaggactttcattcatttggaatttacccttatacatggtgtaagattagaatccaatttaacttttctcctatggtgctagttacatgagtaacgtcttctaaacaactttctttttttgtttaatcactaatttgtcataccgctttatcatgaatgtctgatccttgtataaatcgtcttctcatctgctcggttaactcatccttcaattttattgatctctttgttcttgccccaatattagtctttttcaaaattttaattactctagctttgttacacatccttttactaaaaaagagagccccacaacactatcttaactttatgctttttctgcaggattgggcaggctcttgatcctttcatttataatacttaactaaagttaattattttctcaatagtcaccagtttatatttaaatgttgctgtttctttcttgctcaaattatctgattacctttctttttatttaactatattaatgtgcttatatcttaccatattttcatttcttctcaagctgtttccttcttctagctttttgctgatatttttaggtggtattgagattgggaaacataagattctaaaatttcctcttcattcctgttatatatatttcagagatcatatttaccccttgagtcttcaaaataatgtgccatgcatgctcttagtgttgagatatcttaaataattattttattattaattttatcttttagcatttattattaggtgagctctatctgaatccagctgtagatacataaaagaagagagtgaattgtctttagctgtgtttattatgcatgttgggtgaactccctcagatatactgctgacaaaaacgaatatgcacagctattaattccctttctagtgtctgataagtatacatgtctccattctgtgagtacttagactcatgtaggatcatcttctgtcccatatcctaatatctggtactctgaaccaatggagtatatagcatagtatcaacacaaactatgtgctaccacctttcctgtctctatcagaaccaagaacattgcttatgaggacttaaatcggagaatgtaatgaattactcctaaattttctctcacccccaacaatccctgttgtacttcaacaatgtgaactctagctgccgccaacagccttacatacactggtctatatgatggatggttaggcaatgtagcctgcagagtcattgcaatgtttgcttagcttctttccactcaaattctttccatcttccaagttatatgttaagattaacatataagtgtgagttttcaccttttttttttttggaattttcatggatgttttcagtggagatttcaaagaggctgcattgatgtttattgttagaaactttttttttttttttttctgagaaggagtttccctcttgttgcccaggctggagtgcaatgttgcgatcttggctcactgcaacctccatctcccaggttcaagcgattctcctgtctcaggaaactttttcatataaatgctttctactagttttaggaatagatttatacatgttaatagcatctatttgtgaaactaggattaacggaaaaagaaatatgtgaaattcaaaattacctgtgcttatttttgatatttactccttggccttcacagcattaattccatgctatttacataagatttagaaagtttaaaattagcttttattttgctagtaagatactgtagtactggtaaaagaaaagagctgtaagttaaatgtagtatttgttttaaattcccatattcccattgtaagatagaaatgaccatatttaaaatcttagtattatcaataagcaattcattatgttcaaaatagcgaatttctatggagtcaatgaatacgaaatttgacatattcccaattaattgagcaattaataattgcatgattagagacttagctttcatccattcatggtataaactattctacagttttatttctatcctgtttcaaaattatctatttcttacagtccgtagagattgtatataaaactactacaaatatatcagtatttattattttaaaagttgaattattcatggttctctttcttgttttatttttaattgttcattatttctaaattcccacttaacttactgtataatattgatctatgttgggataatattttatagctctgattttcccattccccacaaagtagtttaaacagagtatgcacgttgtatgcatactattgagtttaaactcaataataatttatttcaatgaggataaataaatggaaagaaattaaattcctgatgcttttctttgtagtgctagttttgtctgtctatggttttatttataatactgataaatttttaaatttttttttggcttttgatttggagttgcacctaaatatctatgtacctttaagcaaatctcaaaatatttatgaaattcaattactcttactggaagtgataaggttaaataagctaatttctagtctctaaagtttctcctacttttctttatgaataataatcatcatcataagaactacaatttaatgagtgtcagtcatatactaggcattagtacttaaaacagacctattcatttagtagaagaagaaactgaggttcaaagagttagagcagcctgtccaagacagcacatccatgaggtggtgaattcagaattgtaacctgggcaggctacgtgatagctgcttcaagtgttctctgtcagttcgttagagtttgtgaggccatattctctcatttcattcttgctttagttatgaatcagttatttcattgatatttcaatttagtttatgtcctccactgaatctttgccaaattcttttattcctccaatcatacctgcccaagtctgagtcctactctcataaaatcagaatgatagaagcctcaggtctcaacatttaaacatatttaactgtattttcatacttatactctttcttgttcctacacaaataaaaataatgttcattttctttccaaagtgattattttgtattctaataattctagtaattcatccaagttcatttatatatttactttgtaatgaagtgagagaataaaaatgaaataagtcttcaatttagttcattttcttcccctttctctacactggttctatactggttcatttttcaagtagaaaatctgaaaataatttttatttattacctgatataatatgtatttgatgatatgtaccttatttcctcatccacaaataatacacacctaacttttttgccccaaagaggcatcaaacttgatttacaaaaaaggaaatgttccaattatgaacattattctgaagaggatacccaatatataagctcagtcttggaaatgtgcctaaatttttaatttacaattaaaatatagaaggaaaatcacaaatttatttttttttatcattatagctatattctgattaagtttgcagttggatgctttgacatactttcacaagtatagattcatggcagaatgtgaagtaagtaaaaagttaggtagatcttatttattcctgtaagtcttcattagtcaaggactgctgtcatccccaaaataactgtcattgacactttcaggtctgggttcaaaataatatctgaactgattctgaacctgaggcagtcaagctgaaattgcagagagcacctagtcccatttcacaaactttccagatatatttttggaatcacaagtacattttatatttaaagtaatgttgctaaaaaaaaaaacaaattttctaataaacattttccttaaacagcaataaaaggtaacacaataataactcacaatattttatacccccataaagtagccatctgcttccagaatataaaatatcttccaaacccaatcaaacaatataagtaatctttatatctagaacttggaatcacaggtatgttttaatattagaaatgaagtcagtttttactctcatgtactttctggatcatattttcacctcccacttttgcttggcctgatactacctgtccttaaggtttctccaggaagctcctttcctggtctaaatttgtcattccatcagtgaagagacaggttagctagcgattaagagcacagattattcttaacccctactttgcaatttaaaagctgtgccatcttgagaaagttgtgaaacatctctgtacctcactccttcatctgtaaattggagatgagatacttacttcatgtgttttttttttcctgaggattatactatttaagtcatgaaaagcatgtggaaacagtggctgacatatagtaagtacccaagatgggccatgcattggtaataagttttgtgttcttcaatagcattttgtacattccctatcatgatagtaaccactctgtaattatgcttcttagttgtcccttttcccagaaagattataatgtccaatcactcagaaattatatctctgtttgtcacagtacctcaatacctatcatgatgcctaagacatagtaaacacttaatctgcatttattgaatgaattaagtttctatatgtcacagggaccaagatacatattttatgtatattatctgcttaaaatttaatcataaccaaggaataaaatagtagtatataggtaaggaaactgaacctcagttttcatggttatcagacaaaccccaagttaatcaacctacacatcaaagtttctccgctacttcccgatgatttcccctgcaagtctccatcgaggcacaaagtcaaagtagtcaaaagaaaagtaaaatttggaaattaagtctgtagtatgagtctgtgaatttgctaaaattatggctggctcatcattttccaggaatgaagattgctttgaaaatgctgaaataatcacccctagattctgattttgtacatgagcagtttatcataatgacacctcctttatctcatctttgtaccttcttttcttggcatttacttcatttactgcaaattttgtgtagtctgtttcacatcattgtaaacttgcctcaaatcacctgatgctatgtttctatgattatgccaagttttgcactatgcttagttcattcttttgtaattagtttttctgtctgtttgttcaacacttactgttgtgcgtgaatacttcctgtgaagttttctttgtcagtgatcaagtttacattgaaaatttgcagccaagcgacattgatgtattggaaatggaaacatacatgcattagcatatttctttccttctttcttttttttcttttcttgagatggagtctcactcggttgcccaggctgaagtgcagtggtatgatctcagcccactgcaacctctacctcctgagttcaagcgattcttattcctcaccctccccaggtgcacaccacatgtgcacacattacaaaacaattatgaacgataacaaacattttggttcaagttcatctctagaaaatcattttctatggcaccttatccttctgtgattgtttcatcaaattgagcttcttgatagcttaaatcttatgagttaatcattttgttccctctctgacagcgaccaacaaatatgtctgacacctactataaatattcgaattaattaatgctgccagaagaagtgattctgacacatctctttgcttagagtatacatatttattttgtctgttctataaacattccactgtaaaaagaaagggctagttcttatactagaatgaattatttttctcatgtagacaaattatttttactatttcttatttatacttgctttgctttttagcaacaaccttggaaaatcttttgatacttgaaatgaaggctattaggatggattttctttccttggtatctgtagactaattttgattttcacttttaaacatatatctacttgtcaaagcttctaaacacaagtaaaacatataataataatgctagaattaaaatatagcttaaagcattatattccttttgcaaatactacagaagtaatttataaccctttgagatcagagtttgcaaattttggctttctcatataacaagaataatttgcatttgaaatatagtgtatgtttaaattctcttctatgggagttagatgttgaaatctttactgaagtgattttttttttcctgcgaacacttacaagattcctgttctcaacttaaagattgagatttatgtgtccaacactttaaatttttttttaaatttttacacatttctcagtgaaacccacttgttgtctttgacttagagactctataattaaagtaaaagcacatttcaatttaaactctaattcacagatagtttcttagttagtctttattatatcaaataattgcagcaacatttaaaactattatatttaaaatataatatatatgaaactgctaaagtaaacatttacattctagaattctttataaaccatagacagtaaatatatttgaaataatcagcttgccacactggctagagtgtcaaagtagccatagtgctactggtttttaagtccactgctgagtttggccagggctactactttttacataaaatggctttaaaaaactactaagaatacttgtttacatggtgagtagtaatatactctttattgcaccaaaacaattttcttaaatgggagtacttgcttacattgtgaactgaaaaatatctccagtctataatatgcctgattccaagtaattcaagtgtaagattctaatttatatataaaaaatactgtattgtaataagaagttctagggattttttaataattacataatattttggatatttctttgttgattttgatatttattttggattatgatctgctggagctcaaaattttcctaaaaccatcaaaaaaatacccatcctctgcgtcttcttccccactgatttgaaatcctaactttacattttaaagtctctttcatatagaatttgtttactgagctttctatcatctgtcataattctgtatgcccttgttcacatattataccattaattattattaccattatcattgaaattacatagcatatttaaattctaataaaaaaagcccatttcgttgtctttttaaaatttgacaatttattttatttatttttgcagatgaaacagaataatcaagattgaaggaaaaatcaatttttgtttttacccaaaaggtgtctctataatttaatttatggagaacacccaactttgcagtatttaatctttcagggacatattttttattcaatttttaatgtcactatattttttgagcgttttcaaataaatcttaaaagtttctaattaaatctatttttaggtttccacatttggttttcaccattaatacactctttctagcaccccctgccatggctagctaatgtttccggaataaaacaatatttgtttgataactcattaattcttattatttctagtagttttttctcttagatgtctactatcatttgaatgttcctccaaaactcacgttgaaatgtaactgtcattgtaacagttttaagaggtgggtcttataagaagtgactagaccatgtaagatccaccctcatgaatgtgggattagaccatgtaagatccaccctcatgaatgtgggattagaccatgtaagatccaccctcatgaatgtgggattagaccatgtaagatccaccctcatgaatgtgggattagaccatgtaagatccaccctccctctttactgtgggagtgaattaattatcactatagtgggttccttataagatggatgagtttggcacaatttcgtctccatgtctcatggcttgcctgccatctgccctgtcataacacagcacaaaggcccacatcagatgccagaactatgctcttgaatatcccagcctctagaactgtacaaaataaatctttattctttaaaaattactcagttccaggtattctgttacagtagcagaaaatgaaataggaaaactaccaacataggccatcatattatctgaaaacagtcatttatttattcaataaatagctgcagagtacttgttatctctgttatatagcttacactgtattatacttttgtcctctttctaaaattatttccttctcttatcttattctctgatttaaacttcctggaaatattaataattttgattatgccataaaccttgtcttttttaagcctgtaatggaaatacctctagtatgacatcattaaatattatattggtttttatttgtaaataaatgattttattgcatttaagtttctaattctaataatttttaaaataataaatggaagagttttgtctaatgctttttttttcgtttttggatggtttctatttccctctttaacatgacaaaatgatgcttgaaattaagttcccaatgtttaaatcatatttgatggctgaaacaaattcttagtcttggaatctctctccccttcttttcctcttttccttcacgtggaactttattctgccaccaggcttcatctgatctttgcttaatgcaaattcctgtgagcatctggcctaacatatcattgacaaacagcctctaatatttcttcataatattttattctcttgctctctttctcttttttcccccaaagaaaggatggaattgagtgaatttgttgtcattcatgtcctggcacaattccccaaatttattttatatttatttttctttgatttatttttaaatattgctatgacattaaaattatcacaagataagataattatcacttgaggctaaaaatcatatatgtgtttatcaatctattaatatttatctactttctcattttattacaatttagagcattctttggctctgtttctcattttaacatcttactaaatttcaaaatttcacactttcattacttagaattttctttaatggaaatacatttctattcctaatgtaataaaatataattcaccatatggaatatgttaagcaatgatcttttaaaaaattacttcatgagttatgatgcatatcacgtagatttgtgataggaaattatagtgcacaaaatatgatacgtactttgtgttacctaaacattctggtcaacttcttatagaacttagtctttaaagctaattggcatatgtagcaataagcattcataattatgaactgatttcttcaatgagtggtcagattggggcccaagtttcccagtttattttgtttgttcactgctgctatagctcaaattatttccttcttagtagattctgaattcattctgattaaaatctctgacatattaaggattttagcagctgaagtatgatagctcatgtttaatcaactgatcctttcaaagggttgtagatatcctcaaccaacaagtgaatggctaattacaatccgaacttttattgagtttctattgttttgttatctcttcccgtttcctaagtgagatacatatatagatgccaccctatgcttgtgtttacctttacttatttttgtggttttgcttttttcttaccatctctccagtcagactttctttaaaaaaaatttatccatttttatttctctcttagcatcattttcatagatctaattactttgcatgcactatatattgaatttatttaatttgaaaaaatatttagttaatatccttaaatgaatatataattaagatataaattgaagaagcatacagttttaatatttgatagttgttttgtttaggaaaagattattaatattacacaattgagactcttttaaaaaataatttagtacccctacataagatgcagttctctgcattttctgtatagttattttctaattttcacaaagaaaattttgtttttgtagggatcttgtattctgtgatgaatctagtattttcttcattgtataactaaactctgagtctctttccatttatttcattattttattacatgaacacttttatttcaatatttttcttctggctttcaccatatttttaattattctaaccctaaatagtaataaagttgataaaatttcacatatatagagacagaaatggtatatgcgtttatagacaaacatacatataaagggaaagagagaaacttagaaaactatagttagaagtataccaaagcaaaatttaacaaaaataaaaataataacccttcaaggaagatcaggggccgggtgcagtggctcacacctgtaatcctagctctttgggaagccaagggaggaggattgcctgaggccaggaattcaagaccaacctggccaatatagtgagaccccatctctaaaaaaaaaaaaaggtaattatttcctttaaaaaaataaaaagaagctgaatattttatcttacataaagttggaaatactttaaaattgctaaatattggaggtacaatataattagtaagtgaaaaactgaaaaaatcctgctgttgtagaatcagaatgtgaatattatagagacacattgcagaggtttagttggagatgatttttttctttgcctcaagaaaaattgtgaagttaagtcttttttaactaatgagtatttcaaatatcttttctttatttattatctattgtgctgtaacacattttcacaaacttagtggcttaaaacaatgcatatttattatctcacagattatgtgggtagagtctgggcatggctgggctgtgccttcctccagtctctcacaagactgcaatgaaggtgtcagctaaaactggggttttatctgaagactcagttggaaagggctcactttcaagcttacttccatggctgttgggaggattcagtttcttttgggttgctggactgagggtctttggctgggggcccaccctcagtttcttgccatgtggatctctctaccttggtaacagcaaaatagagtatctactaacaaaatgggttaaaatctcttttaaccaattcacagaagtaggatcctattatgtctgttgtattattttgcctagaaataagtttctaggcctacccacactcaaaggatggagattacaaaagggtgtgagtatcaggaggaggggatctttgagggccatcttggcattggctactacaattccttttctctttccccctctccaaataggctctttcaacaatgtggatatatggatttttttttgagatggttgttaaaccaagataacatgtaaaatgcatggtgaaggtagccaaaatattttgaaaattcaaaatcattactaacttgtttgaaaataaaccattttaagaatgctacatgacttcagctatagagtgatgtttcctacttttaaaaatatacatgtgcattttattgattctatttaatagatatatttctattacacagagcaaatgatttaatctatacattaatgtccatttaacctgaaaatattttgtagctaatgttttagattctttttggtttgttttaaattgtgtttgggatttcttttagcccctaaacactaaattgtttgaatgaatatagaaataaaatagaccccattcatcaaaatgaacactaatgcaaatagcatatattaaaatgtaaaacaatggattaaaattcatatggcttttctggttcttggtggaaatagagcataaagaaatcaactggtcatcctcttctagtttcattaattcttatttttaagaactatttgtttgtttaagactgtgaatattgataacactggaaaccaataacttttaatctatcaggttcagaatgcccttcacacttttttttttactattttataagaaaatgttatttattatgaaagataatttaatttaaattttactgctatccatttactagttctatatgcagcataaaagtcatttaatacagttctgaaaaaaagaaaccctttgactggttttacttaattcatgtcattctaggtaatatagagcagggctttaaaacccttgtaaacactgtaaatgcaggaaactagataatttttcttgggaacaaattttgaaggtagatgaaacttaaataatctaattataaataagcaatgatcatacttttcttacctttgcattttaaatctagaaatacatcataccaagccatttggcataaagctaaaataccacttttaatgggttaaatgttttgaaatcttctcttaaagtttttaagtgatggaacaggctccggttctctaaatatgtgtaataatactctacttaattaaatttaaaaaacaaaattttattaattttcacctccagcaacagatgtatatgttttgaggtaaagaaaaaaaaacattttataaatggtctgatgaaaattttagttggctgacacatttaattttcacagctgtttatttttttttgtccagtttagtttatttttcttatcagaactggataaagacctattagaccaaatttattcccaatggcataaaaagaaagaaaaaaagctaaaccctttattacaagacaaaacagtttcattggctaaaagtagagatacaaaatatagataacagatggcatttaaggttgttgctattcaactttaatcagattggtgatatctttgatgctggttgtaagtaagcatgattttttctggtacatattaactatatgatggagtgttagttgtctgtggaagtacacctattaatataaaatatgctctacaacaaattaaatacttgttctctccttttattatcttctccatgcctttcctatgccagttttgcttcttgaaatgataaactttctctcctgtggaactgccagtaagtagccaacatttggtcaggtaaagagtataggctctggtgtcggacagctgtttcactggctttcaatggcatctttggcaggatatttgatctctggggacctgtttccttatctgtaaaactgggacatcagaattatcaaattcataagattattgtaaggcttaaatgactaaatatctgtagaacatatggaacaatggctggaataattatgaacatcatataaacatttgctattaattttacctgattcttgaatgtttgcatattcttgagattcactatatgtttattctacaatctttgctttacaacctgtttcctaacatctagagtgtatctatgtaacttctgttactattgaaattcataacttctaatatgtatagtcattttttttgttttgttttttctacctgtgaactagcccctagtgtctatccaactcacattaggacctgatatgttacaggccatgaggtatttctgtggcttacctaactaatgatcaacagtcctcattcaacatcagggcatcttttaccctactaagttctaaaagaatgttctatggaaagaagaggatggttttcgattcaatgagaattcattggggatattgtgtatctaagataaccacgaaattcacttgcatatgtccttgaaacttttgagaagaatgtgcacctactctcactcagcttactgcagtctatagtgatgagactgggttgaaaattatgcctataccatcctatatctcagttccacagaggattggcatttaaaaaaaaaagaatattgcaaggattgttttagttcctactggatatctgcattcaaaggttcttgccactgggtcttcagtaagcagtaattctagtgcctttttaaaattttcatctttggaatattacttttctttatctcaggatattttctcacaattatctacatcatatcatgctaattaaagcctgacaccattaatatcaaaatatttgtctttttaatatgttcttaagcaaccaaatcttacacaaaatatattagagtgctctattttctgagcctctaataattttgtttttgttctgtttttctccaatcatagtccttttcccttattcactgttgtatccctagcatcctgcactggtgatcagtaaaatacattgacttttaatgaatatatttgctgattatgtgagaaatcttttaaaatacaaagctgatgctgttattccactgagtaaaatattaaaacaacttaatcactcagtattacctacaaattcattatcacggaataaaagactcttcaggagttggccctgcttattgcttcaagctcccccgtgatttccttctctaagtgttgacaaccaccttacttccccacctgaatgaatacatttggttttcaagactcagtctaaatacttatctttttaattcctccaagagctaattattttctcccctgtgccagaagtatattctgtagctaagcctaccatagtcaagattctctgtactgcaattatactgttatatttctatatctccttggaggtgattgtttagggaagagatgatattttcttaaattttgtgtaataagaacataatcagcacacaataaatgttataagaatgatttaagaattaatgaataaattgataccttgctaaggttcaacatccctaacataatattttgagtctgaaattcccagtgattgcatataaaggaaaaggtaaattttgagggttttaaggggaataaaaattcaataaaaatgcattattaatctccctatgaactgaacatatgaattagtacgctatacctttccctttcagatactgagcaaagggatgcaatgaaagatgattcctattaagtatgtaaccaaacaagttaggcaaaatgctacttttaataaaaattattattttcccatagacaagatacacatttttgaaagctgcaaagaacagaaaggtaattctacattgctttaaatgataaagaaattatagtgcaaactttagtgttagcttctcaactagtatcattttagcatttgtatctatgttggatctgtaacagttgaataataagttatatttaaacttaaatttcaaaaacccagaagagttacttttgtatgtaacttgtgaatttagtcagttgctttttgttcttaatgttttcaaatgtgaaatgtgacttttcagtaaatggaaatattgcatttactttttaaatatttaataaaatcaattgttttcttgaaataaaaaccgaaatcgcttttcaaaataggtcatagacctaaatgcaaaatcccaaactataaaaatcctagaagataacgtaggagaaaacctagaagaacttgggtatggcaccaacttatttagacagaacaccaaaggcatgttccatgaaagaaataattaatacccggaacttcactaaaattaaaatcttttactctgtgaaagataatgtcaaaaaatgagaagtcaagactgggattaaatatttgcaaaaaaacacgtatgctaaacgactcctatccaaaatacaaaaataactcttaaaactcaaatactgaggcgggtggatcactagatcaagagaccgaggccatcttggccaatatggttaaagcctgtctctactaaaaatacaaaaattagctgggcgtggggtggcccgtgccagtagtcccagctactggggaggctgaggcaggagaatggcgtgaacccgggaggtggagcttgcagtgagccgagatcgcgccactgcactccagcctggcaacagagtgagactccttctcaaaaaaaaaaaaaaaaaaaaaaaaaaaagttttagaacagaaacaaaaggaagtaaagtgcacttggaagagggccaagctggcaacttgagaaattcaagcacacagtttgacctttgacttggggttttatacattgccattcttcgtgcgcagtggcctgctagtacttgagaggggtctcatgcacagtgtcaacaatgtgtttactggagttgtgcgcatgctcacttgaggcatttttcccttaccagttgagtgctcctagaagaaggtcctataccagttaaactccacgattttgtctcttagtgcacattcttgagcccactcacccaactccggagattttattgggaagctgctgctcaccattttcaggtgtttgtatctattaggagcctccctggtgccagctgtgaccaattattattttagtgagacagcgtagcaaccacctgaccatcacctgatggtctcctgacacttctggttggccagggttgtggggttgcgggggtgtgctctaatgacattttccacagaaatagaaaaaaaagaagctaaaattagtatagaagcataaaaggtgacaaatagtcaaagcaagagtaccaagaacataaactgggctaagcacagtctcttcagtaaatggtgctaaaagtagatatccatatgcagaagaattaaactagatccctgccttctcaccctatacaaaaattaactcaaaataaataaaaggcctaaatataagaccccaaactgtaaaactagtagaagaaaacacacgtgaaatgctttaggacattagtctgaaaaaagatttgatgataagacctcaaagcacaggcaacaaaagcaaaaataaacaaatgggactatatctaactaaaaaacgtctacacaacaaaggaaacggtcaatagaatgaaataacaatgatctgacgaggattaatacccagaatatacaaagaactcaaaaagctcaaaagcaaaaaataaaaacaaaaaaacacaatacaatttaaaaagtatgagttatctgaatatacatttcttaagatatacaaatggccaacaaatatatgaaaaaaaagctcaacaacaccagtcatcagggaaatgcaaatcaaaaccacaatgaggtatcatctcacccctactagaatagcatttatccaaaagacaaaaaataacaaacgctggtgaggatgtggagagaaggaaactctcatacactgttgatgggaatgtaaactactacagccactacggagaatagcatgaaaattcctcagaaaaactataaacagtgttaccatttgatctagcaatgccactactgggtatttattcaaaggaaagtaatcagtacatccaaaagacatctacagctctatgtttattatggtattattcacaacaacccatttatgttcattattagacaaccaaggtgtccaacaatggatgaatgaataaggaaaatgttgtgtattacaccatagaatactagtcagctacaaaaaaaaaaggtgaaataatcattctctgttacacgaatggaactgaagacattatgaagaaataagcctggaacagaaagttaaacaccacctgttctcattcacattcatatgtggaagcaaaaacacatacaaacaacaacaacaaaacactttatctcatagaagtaaaaagtagaacagaggatactagagattgggaagggccggggagaggggagcattgggagagatttgttaaaggatacacaagatatttgttacagctagataggaggaataggttagtgtcctgtagctctgtaggatgactatagttaacaataatacatagtttcaaatagctagaaggaggatattgaatgctcccaacataaagaaatggtaaatatttgatggatatgctaattattctgatctgatcactagacattacatttatttcaacatcgccattgaccccataaatatgtacattatgagtcaatgaaacatttttgaaaattaaaaaagcaaaaaccccccaaaattgtttaaaaaaaaaagggaagtgatttccatggattagtggggagagagagataaataggcagagcacaaaggattttaggggaatagaactattctatatgttactaaagtggtaactatgtgtcattatatatttttcaaaagccacagaatgtacaatactaaaagtgaactgtaatgtaaataatgatctttggacataatgatttgtcagtataggctcatcaattgtaacatatgtaccattgtgttttgggatgttgacaatacagaaggttgtacatgtgtgaggacaggggacataaaggaactctctaaactctgtaattaattttactgtgaacctaaaaatgctctaaagtttattgattaataaaagcatcctgcggaataaaaatatatactaggataaaatgagattttctctgtttaatcagaatgatttaaacttgaaaatgcaaacagacaaaaaaaacccctgaatttctgtcttaatattattatgtccaatttatagtttggacatctttacaaccatgaaatttctcacagtattctttatttccactctaaaattacggagaggtaatgagtataatactcaatgtattcattcatagtaggcaatcaagcaattggttttcatttacttggtttggaaaagctataaaaacctttctttgtaatcatggactaataattacaaaaattgttttgtctctgtttctatacaatacgcttacaattaatatgaatcttctgggctcagttatcctgctgttgaattctacaatttttgcctattttctctttcccagagagtttatttttactgtataatacgttgaggaagtattttagttcattcttataatttatttggtcttttctgcttttatgagtacaattcagttaatagtatttgtttaaaatgcctgctttaatctttttcagatatgtctagaccaagttgatgtctttcatagagcatatcaacttttaataaactaatttagatactctgacttgctgccatgattatataataatatttccattatgcattatacttttgtctatgcttatgtctctacctggaaaagtaagctttgaaaagctcatactgtgtattgtttattccctaaatctttgtatccaagcatagtgcataacaaataatgggttcccagaaatttgtttagataatagtcagtatattattccattttagaacagttaaatttgtttagataatagtcagtatattattccattttagaacaatttatttaatgtaaattagtgtgagtaaatgatggtttaatatgaattaaagtgatgattatttttcagttaactgtaaaattgaaatataaaacacaaaagaactcagtgaaaataaaacctaaaaatgtagtttagattttcaagagttttagaaactatttctttcaaatgcaaaaactggactgttgatttttgcattgttgttgttgtcatcttaacttcaaaagcattactttgatcaatattggcttttgaaacagagtgcagaggttaaccataagttataaagtgggaaaggaatgatgacatagatctattttcttactacacaaaagagattagaaaaattttttattggctataaaatgatgggaaataaggcttatagacagtgagctatattatacaatccccaaataaggtaatttaaggggacataggaactgcatctgtcttttcctctggtatttttggaagagtcagcctgaaagaacacactgcaacaacatggttggccatattagagtaaaagtgccaagtaaatagatgttggcagagagaaggtcgagaaagtacctaagttctacataggttctgacagatcacagaagacatttagtttggttctgcatgttaaagtggagaactgagtgttaccatcacgtgtccaccacgttttaaggtgaagtgactatacagcaaggctgacacattaattaaagggtaggatgtaagtgtgaacctgaagaccatcagaagaaggatccagtatgacaatttattcaacaaaggaaactgatgaattcctaggaaccatgctttttttctggcttctgcactgtgattacttatgtaataaagcaggccactgcagtgaaattgtcacaaataagatgcttcttgtctgatgccaagatcttatcagtgcataaatgttggatgagagtagggatgaggcaaatgcaaatattcacttataacctgggaagccagacatccctgtagaagaatttacaaaatcaaacgtaatagtctttgatgaaaacatcctcatgaagagttcttcttatttccttatgttgtgtttcatttcagtgtgcctaatacactttccttctagcagacatcacttggatcatctccattcttcacataaacaaaacctaaaaacatgaaatatcaagaatgtcttaatttcttttcaaccaggagactcctttaatcctatgaaaatttgcctattgcttctccaaacaccagctccttataacaaaatatataaattaaggcaacttttaatgagttaagaataagttctctcccagtcacctaaatgagtttgtacgtgccacatacttgcatagccaagagggcttactcaaatgttatgaaagagtgggagaagatttatcccacagtaaatataactaattataagttaattatatttgatctctaggatcattgtatttaatcctacaataataaagatattttgcattagctgctatcatgaacaatttccaaatgccagagggattaatcaaatgaaagattatttcttatttatttattttttcttactttcccatctgatgctagtgaagaatctcttctaagaatctccaagaagtttttttttttttttttttttcctcttttttgacatggagtctcgctctgtcgtccaggctggagtgcagtggcgcgatctcggctcactggaacctccatctcctgggttcaagcgattttcctgcctcagcctcctgagtagctgcaactataggcatgcaccaccatggccggctaatttttgtatttttagtagagacggggtttcaccatgttggtcaggctggtctcgaactcctgacctcgtgatctgcctgtcttggcctcccaaagtgctgggtttacagacattagccaccatttttaagaacttccaggctccagaatccttctactgtgtggctttcttatctcaaaatctttgctgctaaccactagtatggaggctaggtcttcaaccaagaatcttgcaagaaattctaagggccaagagaaaagttgggtgtatcatcactttctacattctgtctgcatccagaactagttatagtgtaccaatttaattacatagaattgtggaaaatgtaatcttcctgtatacactgcaagagaaaacaaaattgatgagaatctatgcaatcattttaccaaaactccacacattctaactttgccacatgctgggtcaggatagattgcttctccttggaggattagtcatgtaattaacaaaaatgtttgtgggagttcattgaaagatactgaaaaagaggggaaagtgagcattgttctgaatactagaagtcttgttttagcatgaaaagcaaacagaaagtattagactactatttttgaatctaaatagaatgctatgtgctatcgcgtctatcaaacaagagcagaagatctcaagagagcctactctatgatttgccaaggataaaaaaaaaatactatttttttctaaaaaataaatacccttgcttttcttttctctttatcctttattgcatttgtacaattgattactttctttccgtttggagttttctagatttagagacacttctttcaggccatacaagtgccaaatgctgtctttttagtcaacttgctaaattacaggtaactcagccaaaaagtagtttaagtggcattcaggtgagtttgcattactctagagagtcatgtaactggataaaaatcagccttcaaatgcaatagagcgttatttattctggtatataagcatgtaaacatgacaaagtgaagctgttaaaacaatgaactatgattcccctaaagatttagagcaccatttagtattttacagcaccaggcttactcttaacagtatctgattttgtcatatatatattttaacttctcattctctctagtggttcctggctttaaggaatctcagcattgctttatttgctaatactgacacctgtgattaatgaaggcttaatatctgagataatttgttgtcacttggagtccctattaaattatagagtctatgtattattttaacataacagggatatgactaaggtaatatttatgaattgtgaagcaagatatccattctgtagcgtggagtctgccaggagttggtacaccatagaaagaattcaggaaagtacagatgttatcatattcctactgcagacctcttgcagggagaatgtgggagagcaagtgatgaaagagcaaaagtgagagtgaaagtgagagggaaagacagacagagagagacaaagagagagattgaatgtaaaataggaaaacatttaaaaaaggaagataaatacttttgcatattatgggggattgaaacaagtgccttgatcttaaattttaatgtttaacatccatttaactcttttattatatctggacatattcacccctagaattcagacacgttatttcacttcttagatttcttatttagtaatatgatgacttcacagaaacagaattactaagttttatttcaaaaatgtattggggacttatatttaatatgcttataccttacaaataataatgtcattctgtgatattaattagtcttaataatattataagaaagaagtgctaaatttgacaattattcagacaattattcaccaattttgaccaactcaagaagcataatttaggtgttcatcatttggacattaagttattacataattttttttctccacaccatgattctgtagtttattacataaattcattattgagggagaacaaagtaatctgcttacaaacataatttttatttgaccataaagtccatacataattatttagtggagaataccagtgtctcacaattcacttttagtgtactcttcttactttgtaaatatgcagtcaaataatagattatttttcagtgtgcgttcctcagaaattgtagcctgagacaaagtgcttagttactgttacttattagggagtgtgatcccagtgagtagaagtgaggctcagaaggtgaagtaggttaggagggacagccaacatgaggctgtattagcaagctgcctgctgattgcatgatgccttaggatgtccccaaagaaaccagaaatttactgcttctcagtttatatgggatggccaccatgtggtgagtgaagtggaacagtttatccatggtttcctatctctcattgataaaagttttgctccactgggtgttaactcccaaatacttctgagtcccatggagccatccttagggaatcctctgggcaggagctgcaggcatgaggcacagttgttgaagttgcccttgtgtggggttactcagagctcaccgagatctaaccactattgggacagctaaaacagaatactggtaaggcctgggagagctcaagttgcatatgtgggaagaatactatattccagatagcacagcacggatacactactgccctccacagctggcttccatactgtaatctggggtctccatagttgtgagaacaatgtactcctttagtttccaagcaaagaaggggatattggggatacaaattcaatcaatcattcccatgtatttgttaggccgtgttggctggaattcccatatagtggttcagcaggccaggcagggtagtgctaagagttgtgccagagaattccctgggttccagtctttctccttattcctattttcttgtcttcagagcaacaaggctagttttcatagtaataagattgctaacatactgtcaaaacggactaaaggcgaattgattatattcggaggttaatgatcagaggaatccttattgactcccggtggaagtatttattccctagtaagcagacctctagcatagaagagcctgagatttccagagtaggagacacacaaatttcacaaggtggatactgacagttaaggtaggagggaccaatcctgtttctacccattgtttctgagacaatatgctattgggattatattaattaatgattcatcgaatatacatccagaagcatagcatttcaattctgttgcatatttccttgagaaggactcttaactgaggctttaccaggccagttatctaactattaggctgactgtctcaatgaggaacatgaaatcaccagtacattttgctttcatgtgcctatgatcatagctgctttgtcagaaaatggttcccttggtctaatgcagtgccatgtggtattgcatattaaaagataaaatattttgtaagtccttggatggtggtgcaagtaggaatcacaggaaggaaagataaatcattatcctgaagaggttttaagctgttaaagagctgtcccaacctgggtagaagaagtcatataaccaacttgaagcctgattcctgcaaggaattgtgctctgttgaaggctcatttttagtatctgttgttggaaattcagaacaccaagcagtgcagtagatacattatctttgttgaggggagccatctgttgggttcacgctattcctgccaacaaagatactttgttcatggcccattgttcaaacattgcaggatgggtggggtgaagacatgttggctgacatttatgtgacgggtcatgttcattcttcgttaaaagtctcctctgtaagttgatgctctctggtgatcattatgaaaaacaaagatctacatattttgtgacaatagccatatcaattacctctttaatagaccttactcccaatcttccaatcttgcttccttcaggcctttaaactggaagaatttattttttctttctcaggaatccaagctcatgtttacctcagcattcttttttctttgtagctttttgtgatgactaatataacatattcatatgctaaaatcttctgaaaagatatacctcaaaggaaggtgattagtgctatagcgctgtgatagttgagaatctagtttattattactattaattttaaaatttggtttggttctgtataggggagaaaaagtaagatcttttccttacccattgcaagggtcattgctgagacccctataaccaaaagacacattaacaagagaaaaacataacaaattcattcaatgtcatgtttacatgacacaggttattcaaaatgaagactcaaagaaacaggaaaagctgtatatttttatgcttggatttgaggaaggggagccaggcatgcagaactgtgaatgaacaaaatggatatggtctaatggtaataaaatgaagaggggacaccgtgaggaccgtttgttcagattcttcttggcatctttatgtcttcagttcagagatgaggacgtgtttttctctgggaacaggaaaagtccctctggaatgagtaacttatggactcctttaaaggaaggtcagataattctttaatggtttgtttcaggggagaaatgcaggagactgtttgaaagaccttcctgcttctactgctacctcaaatgcccaggcaccatattctgagatagcatgtcctgaaccccatcgctttgtttgtatttttaacttatattttaacttatatagttgatgatatttaagttttacaaaaattatctgaaatagttaagtttgtttctttctttttgaagacaaaatcgcctaaagaatgtgttggaattcaaagttggtttaagtcacagtttcaaaagatgaagtcagcataatgattacaattaatcttagtaaatgctaaagcagtgtataaagtacttttatttgggctcatttcatgcacccaacgaacaactccaataaatgccatgtgtattttcattttataggtcagttattgagtatcgataattctataccttttgccataatgagcagtagctcaagccaatgctgtctaattccaaatcttgaaaataaattaagtttataaattcagttagcaaatattaatggagaaacttaagtgacagagatacagcagtgactcaaacaaattccggttctagtgcaggttcaaaaaaacaaatacatatataatatgatatgagtaaaattaaatgttaagaagaaaaggcagggtaaagggatagacattagcagaggaggattgaggtgttcaaggaagttccacctgagcaaatgtcatttgagcaaacgattggtccatgtattttttaacaaatagaaagttaaaggatttacttaccttacatgtgctctgtaactctcattattataaatacaatatttaaatttctataagattttaccaagatttactaaaggtagtaaacttcaaaagcaatctatatagtcatgtagaattggaattaaaattaaatttaataactttaaattctatactcattctgatattggtagctaccgattttattaatcttctgttaatcatttattatacgaaaaagaaatattgcagaaagttgttttcctgagaattaaaatctatagagatgcctccacatttatttaattttggtgtagtaccactctgagacattcatgtcagagctttcgaattctcccctggatctgatggaactcactccgtagtaatcgaccaaatttagaagtaatcaactccatgtggcaaaccaaagcccagatggaatgcctcttaatctttagattaatgtgtctactcagcatttaaggtgtaactccaaaataatggagttgcaatacccttttactttctcaccaggctatattaagctacgagacctaaaacagatttaatcctaaaatatatccatttgtctaacatatttaatagcaaggctaaatcctttgaactgtataccttttatccttattgggataaataattgcttcacaaaatactaacagtttttagatattgaatttaaaaggtgaagaaaatcttgttactttcttgtaatggggtccaggaagctgatgtaactttaatgcctgaagaaaaacactgtagggaaaaaaagtctactctggaaataaaagttttacatagattttcccaggctattagccctggacagtctgtgataattagcttaccacagatgactatggtgaggagtcacatgctttcttatatagctgaacgagtgcaggctaaccaagctgacgggcatgccctcatttttagctccaagtaaaggtgtcgtttgattttccagtgctgtataattattgtttcttcccaggatattaatcttgaccttagggaactggagttttaaatgaaagcctacttttaaaagtgatagaacagtatctgttcatttttttcacacattttaaaagacatcagattcttgctcatattttgttacaattaattataattggtgcaaaggtagtcattttccaatataaacttttatagataaaatcaaaaacactaaaaagtgttgatacagggtcttaatatttttaaattaccacacatgtatctctccaatacctttatttaaatcacccctgctgggcgtggtggctcatgcctgtaatcccagtactttgggaggctaaggcggcagatcacgaagtcaggagttcaagaccagcctgaccaacatgatgaaaccccgtctctactaaaaatacaaaaaattagccaggtatggtggtgcacacctgtaatcccagctactcaggaggctgaggcaagagaatagcttgaaccctggaggcggaggctgtagagagctgagatcgcaccactgcactccagcctgggcaacagagcgagactttgtctcaaaaaattaaaaataaataaatcatcccttcatatattgctaaaactaagccatttgccgtgtacatatcttatgagatatggcgctttctggaattagcaagtctttgttatggcccactcacatagaaagtcagaaagagaaatagcagttttcatggcttctgagtaggcctttcagagcatcaactccaattttgtaagagaaaatatataccaaagtcacactagcacatgcataaaggccatggtgtatcatgcgatgaagattgcattcttccctgaatgtaatgaaggctttctggaagtagagagctttatcctttaaaaaagccactttgatagcagggtagagaataaattacggaagggggagtgttttaatccagaagagcaattgagaggatggtgtacaaatctagaaaataattagagaagggttaatctaaggtagtaagaagtgcagagcgagacttgaaagatagaagataaaaccaatataatatggtgactgggttgggagactgagaaagaagaaaatgtttagtttattggcttggatgactgagtggatgaatgcaccacttactgacatgggaattatgtattgaaggaaagaagagcaatgtgggaaagggtacacatttttgtttaagcacattaatttaaaatgtctatggtatatccaagtgtaaatgttttgtgaactgttgagtatcttagagtacaataagctgagatagagattaggagtcagtgattctttatacatgcttattaaatcacaataatagaagtaatcatgcatctatttttgatagagaagcgtgacgaggactgaggtcacactctgtgaagtttaacgtttaagtgatgtgtcaaagactaggaacccatgaaaaatgatttattttatttatttatttgagacagagtctcgttctgtcgccaggctggagtgcagtggccagatctcggctcactgcagtgaaaatgatttttttaagtggtcagaaaggtaggatgaaatgtaaaatgctttgacctcataaatctaaggagaagaatgtttttcaccatctcatttttaatatagtacttgacatattaaaaatgtcttgaaagaaatacagttcaactgtcaggtcttacctaatgtaagtttcctataaagtatatgggaacagcaaatgggaacatttgtaaaggcatacacataattcccagatagatagatcagtggctgtctagcaagaggctgaggaaacaaaatgcaggcattaaacaaattctgcctctctactacttaaaatcatgtaagatagtccagatgatgtatttgagtgaaagatgcatagcaatctctgtgaagttgttaggatgccttctcaagaggtggtaagtaactggggttggatgttgtgaaaacactctccattcataaataactatggattttcatacgttttcagcctgtgtaaagtcaaccctaaatgtagacctctgctagtcataattcaaaggaacgaaaaatagagagaagcaaaacatactggttaaataaattaggcttttaatatcgtcggccagaattcaagtatacacttccagtgcttcctagttgtttgattttattctcatagagcttaatttactcatctgtgaaatgtagatgttagcacttcctatatcacagccttgaggattgaaagagaaaatatttgtaaagtgtgttaaacagggcataccacatgaaagcattctaaaaaagaagtaacttataccaataattagagacccaaaagagaaaaatataacaatcccagatgggaaaaatattaacttaatgctggtctgtgaaattttatggaaacaggttatttagtaaacccgtatgtttctaaaaacctaataaactagggagaaatagattgctttgatgagttagatgtcttgataaaactagtcagaagccatttgtgagaacagacaagggaacactgcctttgatgtaagttctggctgttaagaagaaaaatgctcacagctgaagccacaaaaaagctagtaacccagatagaaaattccccttttctgtaggaacttagtagtggcaaaacccagaaagaaaacttatttctagctctccaagaaagggcagtaataacatgggccaggacaactaaacaaaactagcaaacaaaaagggaggaaacaaacgaataaaaacagaatattcaaaaagagttgaatgacatacatgtagctcaactcaatatataatcctaagattatgagcttgaaaataaactctgctagatattcattgtttgaaattggagacttcttcctaccactgtaaaagatgggatgtacctgacagattacaggtacagtgaaaatgtgaagagaatatattactgaataaggaaaatggggacatactaggaatcatcgttttcacatcagaaaactgcttgttaaatacactactgataggttcagaaatttacctaggaaattaagtctccaggtgagacttgtttagggtaaattccaaagtgttccaaaggccatcaaagttctaatcatcagacaattttttctagagttgattttgaccagagatatcattttctacatgttagctactgtgtgttcaggcgtatagtcttgccaattttatacatgctgccaagtaacatctttatggttacctaatgggtccgcatagagctacagtgagtttagaggctgagagacaataggttacattttccatgtctttttgtcatttttgttgcttttctctaatttctttcaaaatagtgatctctaaacagtattgatttttataataagtataatgtgtaataaatgtactgcattttttgtagctctaaatagcattatcgcagttcagtgtaaagtcagtgtgtcatttgttgctatagttttcgacctcccatctctggtttatctattcattaccacagttaacttgttagtcacagcttttattagcttgattctgagttattgtaattgtttccaactaatttttttattctaattcattctacaaaaatctaggtaatttttcttaagcaattctcattgtgttaattcctccattttcctctccctaactagcatcaatgttccctttttcccaaactttcctttgagaatttcctccctactcccacccacctccacagtattcagatacggagtttgaataagtttggtttcctgccaatgatatacaaataggctctgatctgtggaagccaaccattatatctcatacctgtgtcaccagtgaggggtttaagaatgaatacataagctattagggaaaaatgatgcctcagtttgtagttagggcttctgggaaaaatcttccttcttcccttgaaggaggtaaaagaaataatttttcttcttgtgcacattgcagtgagagtgtgtgagatccaaaaccattgcagccatttttgtaattagggaaactaattttaggatgaaactgacacaactgagtaaggagatctaggagatggaggtttgtttggtaaagcaaaattccagcgatgtcatgataaaggcagctctacctctgatgtttgcaatcacatgagccaatacatccccttgttggcttaaagcactattgagttactgctttctttctcaatcaaaagcattttatcagatagaagatatttttggtcagtgatatcatatctaaattttgtcactgctactttgaattctattcctactgagatagttaacaccccactattcccaaattggaatgtgaactgtttcctagtaatttctgttcttcatgaatttttaacaaaaatgttatacctagtgctatggtttgaatgtgtcccctccaaaattcaaatgttcccagtgtgatagtatgtagacgtgaggatttaggaggttataaggccatgaggacttctccctcatgaataagattaaggcccttaagaaagcatttgcatgcagcgttcagtctcttgcccttctgcctactgtcatgtgaagatgcagcctccctcccttccataggatgcagccctcaccggacaactgaacctgctggtgccttggtcttgtgcgtcccggcctccagaaccacgagaaatcaatttctgttctttataaattacccagtctcaggtatctgtatcctgttatagcagaacaaatggactaagacacctagttagtatccatgttgtctcataaaaattctacacgagttgttgacaaaaatttatttattctaacaattttgaaaatgttagtcaactcaattttgatatttatttgacacatgtcatatttccttttgctgacaatgagatatttataatgtttaatcaattgaacagttatatttttcaggccatattgttttctgtttttgatgtgtttcctatgaaattcatgtcacaacataaataaaatcctacctctttctttatgtattgggtgccatagaaaaagttagacttacgtaaaaaatataggctttggcaagagtatttatgactactattctgtatcatgtgcttatttttgactttgaaaaagaatggcaaaaaaatggctggtttcaaatatttcaccatgttgagttctgggttgtagcttccaatgaaatggggatctgaaagttggagaagagtgaaaatagtgtaatgactataggagtagatttgtttgataatgaaaaaaacagaggcaaaacacactcaaatattaggctggcgcaaaagtaattgtgatttttgccactgaaagtattacaaattattgctgatcttgatcttatatcaaaatcctgagagtttgtttatatgcagtgatagtaactcaaagcatttgaacaaatggattaacctctcttttaaggcactcaaattaattccaatgatacctttaaaaaaagttgtaaagctaacacatttgttttaatggaagataaacaaatgagatctgaagagcttaaaatggaaaaaatatttttttctaaactctcgtttctatttttcagagtccttgtatatttccagaaaaatgtttatacctacccaaaagtttatcaatttcctttttctttcctttctttcttttcttttttctttccttctctctatacattctgtgtgaaacttgctttctatttaatgtcacctaaaaatatttgggacattatgctgtatatatgcatagcattattttttcatggctacatagtattccatgaattgtatatatcttaatttatgtatgtattgtttaagcatatttgaattattttgcattgttttcatacaaacataatagcaatgggtgtattcctatttgcagatgtcctatctacttatctagacttttttgtgtagattactgaactgaaattgattgtcaataagtatgtttatttaaatatttttagatattaacaaatttcttccaaaatgtttcaaaaatttatactcctagcaaagctatatgaaagttattttttcttacctgtaatctgtatgccttttgtgaaaaaaagacttcagaaatttgtgtgcacagtgaagatccttgatatatgcaccatgcatacatacgtgtatttgtatatattctctgttttgtgtgtgtttgtgtgcatctgtgtgtgtatgtgttctatttgtaagagagaatgattgcattatgtcagaaataaaacactataaatatttgctgagtgggtaattgaatgaatggttgaatcacctatgctgttctgtgctgttcatagaattgagttgaatctactattctgctggaattataattgggacgctcagtgacaagcttctgctcagcaattggctttatagtaatggttgttctgctccttcatgaaatgaatgagatccaggtcaagccaattatgaagggagaaaacattgaagttaatgcaaatcattcagaataggtttaaataaccctagatttgtttaactaacatttagtttaaagaatatttgaaataactacttcctctgtgagtcctttcccaactaagtaaacctgaaatgtacatgcatccttcaagaaaccactgacacagccactttctcctggcatcaggcaagatgctgcagttgcaaaagaactgatttgcttcttcagtagcaagtgagcccattcttaggacaaaaaaagttttgaattttatccacaggtaaaagatatttttgttattagtggaatcagtgattcaaccattcattcaattacccactcagcaaatattattagtgctttatttataaaataatgcaattattctgtcttagaaataaggcacacctggtttgaaaactaattttctctctgactgtttgacattgcatatgtcattcacattctccaagatgatacactcacctgtcagtattttcagtatttgattttaaaaatgtggaaggcctgactcataggcatttagtgattctgttatcttcttttccatcttttattagcgtaaatgattgtcatcataatcaggtcatcaaccagggatttctggcttagaattattcataggtacaacgctgatggctcttctgaaattgcccctgcataggttaatccacaaattgtacatgtatctaatcttcggcctcataacattgtattccctcaacacctccattattttataattctgcaacagacaattcaattgtattatgttgtccattgctaacatctatgttggatggtttttatcaacagtctgtattgtagagggtgagaaaaacagtacaggtagcagggttcattttacctcatttgtatttatttagaacgatgctttttcaaatatttcaaatattgctatttttttcttgtgtctttaatatggttaggctttgtgtccccacccaaatctcagcttggattgtaatccccataatccacaagtgtcaagggagggacgagatggaggtaattgaatcacgggggttgggggggtggtttcctccacgctgttctcataatagtgagtgagttctaaggagatctgatggttttataaggagctcttccccacaactttgcttggcacttctttctgctgccttgagaggaaggtgccttgcttctccttcacctttttccatgattataactttcttgagacctccccaagcatgctgaactgtaagtcaattaaacctcttttctttataaattacccagtctcaggcagtttttatagcagtatgaacatgaactaatacaccccaacagtaacttattttcaacaaaagcacagttatgctctaggtccctactcttctaaaccatacaccctcctagaggtaaactaaagacctatatgatgtctcacttttcatctttacctgtgtttgccaaaggcacttcaaactcatctgtcctttctttaacatgtcttctccttcccaaagtatttttcttcaccttcagtccacattttagtaaatgacatcatatttcagtcattctgcatggctagaaaattaggaattatcttgggttacaatttcccaaacttttatattaaaaagagtatctaacactaccagttttatatcttaaatatttgttatatatctatcctttccatctttatttatagcacttttaagtcctttttaatttttacttgcagtttgacaaatatggttcttactaggattatactatgcgtattcctctataaccttttccctatgtaactctacatctttcttcccttcacttccttaatgtgttttgtcattccatgcccaccatgttcgcatacactaattactagaatgtgagacaacccctctttaaccctgtcatccctttgggttgtcaaaaccgggtgatccatctttatttattgctacacaactatgaataaagtttgttcccaagaaaagacagcaacgtgtctgggtaaaaggggatcatattctctgtaaaagatatgctagattctcagcctcatattcatttgtttctcaaccacctaagagctatgcattctcccaagctcagttcagacataatcacttccaggaagctttctgcaatgctgtgagtgtgaaacaagtgtgcctctcaatgtaatttagggcaaaatctgtaatatagcacttgattgttaatatatctttcacctttgttggactgcaaagtactgaaggacaaaaacctgggtcttttattttgtcatccgcagcttctaataatactgttccaggcatataacagataattgacatatagatgggtagacagacagataaatagatctatatctattacatataatggaattttttttgtaatatatattatattctatgatggcaaggaattgtacctcatttctcctttctgttaaactactttaatggcaaaatccattttagttaataattattcaataaatatgaaccaaattgagttaaattagcaagatacatcgtttaaattacaatgtatttgtaacaaaaatcttagtgtaatacagtgatttatatgttactttttaatattcattttttgctttatatttgtgtgttaattgttcaatgagatgcttggcttacaagatttttctcacccatatttaggtgaatgtatttgaattataaatctgtggtgaacaggggctgcacagatttaaggtaattttaatatgatcaacaaactgactttttttagaaaaggtagagttttgatgtaaactaatattttgataataatcctagcacccatgggtttagacaagtgtttttactcttatatgatccaaaagaaattaaagtggctgggcgtgatggctcatgcctgtaatcccagcactttgggaggctgaggtgggcacatcatgagggcaggagatcgagaccatcatggctaacacggtgaaaccccgtctctactaaagtacaaaaaattagccgggcatagtggcacaggcctttagccccagctacttgggaggctgaggtaggagaatcgcttgaacccgggaggcggagggtgcagtgagccactgcacgccagcctgggcaacagagccagactccgtctcaaaaaaaaaaaaaaaaaagaaagaaaagaaattaaaatataattttacatttgagacacactaacaattcagttgtctgatttaatatttctactcttgttgtggatgaatgtatatatttttaatagaactttggattttaagcaggaagttactgtaacatcaagtaaattgttagaaagtcgttcttcaagctccaaatgaaagattcttcactctttgaaaccttcttttgctgactccatagacttaaccacttgtgattagagttcccttgaccttgaaattgcattacagatagttgtctttggtgctactttccttaacagaccacaacttcttgagtgcagaaaccatagtttattgctctcctaattctaagtgaaaaaggaaaggagaagagaatgtaaaaagcaggggaaagaggcaagcagaaataaaatagtctttgaatattttgcagccacttaataaattcttaagtcagatcctttttgtcccacttctgacttctggttgactttatgtctactgggatggcctcttctcaagactcaattgtgttccagtatgttttctttcttctctctcagcatacctcccatttcgcccaagttatacagtaaacttgctgtttgaaagaaagcgctggacttgtttaatttatattaaagaatgggtgaccatttattgcttttatatggtatcccaatttgatgttaacattttaaaaaaagacatgctgacacaaagtagtaaatctctaatggtagaaattatctgtacaaatttgggatataagagcattgattatcagtactctttgtcctgctttcctcactgtcctgctttgctgaatagtatttgcagaagagagaaagagttagtatgcaggataatttacagaaacaagtatgatgtgggaagaatagagttttttgagagcttaataaatttttttcaacataacttttgaatgattcactctggtcatttagacaggaggcccaaatagcaatgttagaaagctgccagagaatttgttacacaagataaatccagcctttgggaaatcttgtggtattcctaattaccttcttgtttctttatacacgtaaggcttggatgctggaagataacacaattatatctcctcccccaatccctatgtaacagattttccacattgaatttcatttttgttttttaaataatatcaaacctttgcatttctccaggttagtaaaaatgcaggcctcattgtgttgctaaaggatcttcctcttttccccacttagaattttctgaacctaatcagcaaggagcattttgccaggctcctggtcattggtccataaatgaatgacactcttcaggccaagggctagctaattgccaattccgaactctgtgtgttaactagtgtgtgttcttttcacttttcaaagtcataacggatcaggtacagtggcttttgcttccacatttgagctgcctgaataaacaggaggtaatccctcaccttaggctgctgcataatgcattccagcttgttgctctgagtattttttgacagctttaacatttgttactggtagttgatcttggactttttgatccatgaatctgaatggtacggcttgtcctcatgctcatcatttcttggtcagcaaattagtctggggcccttgctcaggatcgtactaaaaatgaaaatccccatgcaaaataagtatttccataattttgagtatctttgttgaaaaagaaaaaaatgttctctctttttaatggcatgagacagttattcttccatcatgtgagcatcttgctctctgtttacaatgtgtatgttatgcagattcttatacaaatatcttttctatttttttaaacgaaggcaggttcacacctctgtcttgtgtccacctttccaggtaccagtgcctctcatttattcttagttttcagtattgcgatttgttttaggtagacgatttgcgccttgaaaaatagtcattgcaaacaatgagtaaatacttaaaaaaaattatagtgtttgtatagtaaaagtgtgtgttttttctcttctaaatttactgtaatgtcacattttacttgtaaataagtaggaatttcaatgtagtaacgtaaataagtaaaattaaataaccagtagttctaaatactgttttaattgttattgtctgtttacttcatagtagtaattgtaggaatatatttcaagaaagtaaatgtaaagtctaacaaagtcactacattatttgttatagtaaaaaatatcaataaccaaaatgcccaaaatgaagtaattgatcaaatttaatgagaacaacctgagggaatattatatgagtggagacaattgtatttatttaaaaaaatataaaaagttgaaaaatgctatttttatgaaaaagcagaatttgacatctaacatatgaaatgatctaaatcaatgtttttcagatgttttagtttccatttttaaaaataaaaagtgtattgtacctatgaccctcatatatgcatacataatacacaaataaaacaagtttttctcacacctgtaatcccagtactttgggaggccgaggcaggcagatcatgaggtcaagagctcgagaccatcctggccaacatggtgaaactctcttctacactaaaaatacaaaaattagctaggcatggtggtgcgcacctgtagtcccagctactcgggaggctgaggcaggagaatcgcttgaacccgggaggcagaagttgcagtgagccgagatggtgccactgcactccagcctggcaacaaaaggagactctgtctcaaaaaaaaaaaaaaaaaaaagaaaggtttttcaaaacaatagtcatcccattaaatataatgtatattgacattttcttttttctctctgttttaatttaattttaaaagaatttgaattgtgacctgttaaagtgatttattgaccaaaaaatgggttgtgatgtgtagctaacaagacattgacctaaaatacataaacgatgtactttgaaaatattctagaaagaaatgcagtataatattaatattttatacataacatttagatatggaatatttacatttttccctcattctgctccaaagttttaaaaatattggcagtaaacattttaacctcacaagtgtgactcaacttttcacgtgccatattttttcatcaagtgtaaatatgttttacttttccaagtgctttcttccagcttcttttccgtttttggtagggtagagcccaggttttaaaacacagagtatttttctggacctagtaagttcaagataaataactattacatgagtgagtgagttaagtgcttgaatggctttataaaacttaactcaaatgtgtttttatgaagtaaatgttagtttttattattattttattcacttcattacagagcaacatcagctctactaaaatggaagttaatatagtcaaatgacattttcatattcaaaatatactcttgtccaaaacatgtcttcagtgttaggacagagttatgtttggtgataatgctgtataaaatgtcatcctgctgaagaaagaacgtaggcttgggagccaaaacagtttgtagtgatctcgctgagccactccgttgtaaaatgaaaataataatatttgcctcataagctttctgagtaattaatttgtataaaatacctaggttcatgactggcacatatgttaagcgcctgcctttccttttccccagctactgggtaatattttaaaatattttataattttaaagaaaattgttgtcatttacagtcagcccttcgtatgtgatgtggaacccgtggacacagagggccggcttttggatccagggttgttgactgagtacaccgatgcagagccacacatactgagtgctggctgtactaccatttcatacaagcgacttgagcatccacagctttttgtatccacagggtttgcggagcccttcctcaatggataatgagagcaaactgcaattagctgtatataaaattacaatctttaaaaacgtaggcttttatatcaactgaagtgactcaggttcagcaacgcataatataatttttcttttctttcttttttttttgacacggaattttgttcttgtcacccaggctggagtgcggtgtggcgcgatctcggctcactgtaacttcctcctcctgagttcaagcgattctcctgcctcagcctcccaagtagctgggattacaggcatgcgccacaatgcccggctaattttttatttttagtagagacggggtttcaccagattggccaggctggtttcaaactcctgacctcaagtgatcagcccgccgcagcctcccaaagtgctgggattacaggcgtgagccaccatgcccggccgccaagataaattttataaataaatacataaagtgtaaatatgaagtgggaaaaaaataccatctaattttaaaaagatacaacacttacacagatatgatatggggggaatatatcttagaaccaaaagtactaagttgaatataaatcatcatgttgtactatacctatgaaagggaattctcatatatatttcagaagatttggccaacaagaatagaaaatgtctttgagctcatccctgtgttctttaggatcttcatttaaaaagcagagttgtcattcttgttttttgtttgttttcagggtgtactaaaaaactaaagtcagttcaccatcgtacatgaaaaattctcaaaaaatttgtaaacaaacattaaagatttaatttgatttaatttaatagaggaaattaagattaatttaatacaaatctctgtgcacattcaaaatagaaatggtgaattcttcttcatgttcactgagaagagataaggatattggttaaactggcaaagagaaagagcaaaaagggaaggtgctgttgaaattttaaagcagtcttttaaaatataactgaccaaaatgatttttagactctgatacaacaaaataagtgattgaatttttgaagtctcataacttaataaaatagtatgatgtcccagaggttttgatttacatctgaatagaaccttttaatgaaaacaaaatatacacaaaaatgaataaataaaaataaaaaatattttactgagaaaaaaagagattattgatcatttaatataggggtaatttccttaatacatctatttattaatgttatgaattaattttctcaacttagaaaaagtattccctacatagtatgaaaaattcaaacaatgtgataataaaaggtaatgctgcacaggaggtaaacacacaaactactgggcttgaattcaagttctgactccatctattaatatttctgtaagtctatatacaaatgtcgcttaatctctctttgcctcaattttaaaaaaaatgtaaatgaaaattaaaataattcttgtttctattatggggcttaaattgcgtaatactggcagattacttaaaacagtgcttggcacagaataactatccaatatattttagcctttataattattgtataataatatagtcaaaagacacaagcagagagtgcttacagaaagaacaaaatggggcaacaagtatataaatcagagccaaccattcttacaaccaagtaaatgaaacaatgagacctttgttaacatatcggattgaaagatttatctgttgttataggtgtgggaaaaaaagagactctcaaacactgttggtgagagtataaactggcataacctttctgagggcaatttagaaactatcaaagtgaaactgcacgcatcttttgacctagaaatctgacttctaatattactgatatttaaacatgtctacaatcttgttaacagaaaactaatggatgcaacatagcagttctagtatgagttgtatgtgcttcagaaaagtacatatacacattcatacaaaatatgagtatgcatacagtcatgtaccccataacaatgttttggtcaataatggactgcatatatgagggtgcttcaatagtggagctgaaaaattcctatcatttagtgacattgtgtcctttgtaatgtactgcaatgcattattcaacgtttatggtgatgctgctgtaaacaaaactattggactgccagttacataatgataatatacaactatgttactggtttacatatgtactatactatacttttcatcattactttagaatgttctcctttcagatattttttataaagttgagtgtaaaacagccttaggcaagttcttcaggaagtattccagaggaagtcattattataatcataggagatgacagcttcgtgcatcttattaccactaaagacctttcagtggaacaagatgtaaaggggcaagacagtgatactgatgatcctgaccctttgcaggcctcggctgatgtgtttgtttatgttttagtttttaatttaaaaagcgtaaacattaaaaaaaattaaatagaaaaaatcttatagaaaagaacataaagaaaaatatttttgtagggtgtcaattttggatctttcctgctttctcttgtgagcatttagtgctataaatttccctctacacactgctttgaatgtgtcccagagattctggtatgtggtgtctttgttctcgttggtttcaaagaacatctttatttctgccttcatttcgttacgtacccagtagtcattcaggagcaggttgttcagtttccatgtagttgagaggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtctgcttggtgcagagctgaattcaattcctgggtatccttgttaactttctgtctcgttgatctgtctaatgttgacagtggggtgttaaagtctcccattattattgtgtgggaatctaagtctctttgtaggtcactcaggacttgctttatgaatctgggtactcctgtattgggtgcatatatatttagcatggcacatgtatacatatgtaactaacctgcacattgtgcacatgtaccctaaaacttaaagtataataataaaatttaaataaataaataaataaataattttgaatatgtagttgcataaaaaaagaaaaatatttttgtatagctctacaatgcatttgtgttttaagctcaatgttatgagtcaaaaaagtttacaaaattaagtttataaagtaaattaattacagtaagctaaggctaatttattgaagatacaaaaagattttaaataaatttagtgtagcctaaatgcacagtgtttataaagtctacagtagtgtacagtaatgtcctagggcttcacattcactcccattcactcctgaactcacctagagcaaaataccaaccctgccgcctccattcaaagtaagagccctagacaggtatagcattttttctttcataccacattttgctatacctttaatacatttagatacatgcgtaaggttactaaccattgtcttccaattgcctatagtgtgcagcacggtaacatgctgtgcaggtctgtagcctaggagcagcaggctatgtcccataaagcctaggattgtagtaatctataccacccaggttcgttaaagtatatttatgatgttttcacaagaaatcgcctaatggggcatttctcaaaatatatccctgccattaagtgaagagtgactgtataggcataccttgctttattgctctttggtttattgcagtttgcagatattgtcttatttataacgtgaaggctcgtggaaaccctgtgtccagcaagtctgttagtgccattttttcaacatcatgtgctcacttcctgtctttgtgtcatgtcagtaattctagaatagtttcaagctttttcattattattatgcctgttacggtgatcagtgatcagtgatctttgatgtcactattgtaattgttttggggtgccacaaacagatcccatataagagggtgaacataactgatgtgttctgccttctccatcaaccaaccattacatcatttctctcttcctcctccatccttattccctgagacacaacagtattgaaataggccaatgaataactgtacaatggcttctaagtgttcaagtaaaaggaaaaatagcatgtttctcattttaaatcaaaagctagaaatgattaagttttgtgaggaagacatgtcaaaagctgagataggccaagagtgaggcctcttatgccaaacagttagccaagttccaaatgcaaagggaaattttctgaaggaatttaaagtgctactccagtgaatacatgaatgataaaagagaaaaagctttattgccaatagagagaaagttttggtggtctggatagaggatcaaaccagccacaacattcccttttagccaaagcctaatacagagaaaagcccttactctttgattctttgaaggctgacagagttgaggaagctgcaaaagcaaagtttgaagatagcagacgttggttcataggattgaaggaaagaagctttttccataacaaagtgcacggtgaaacagcaagtgctgacatagaagctgcagcaagtcatccagaagatctagttaagatcgttgatgaagatggccactaaacaacagatttttgatgtagacaaagagccttctgttggaagaagatgccgtctaggactttcatagctagagagtagaagttaatgcctggctttaaagcttcaaaatacaggcagcctctcttgttaagggctaatgcagctggtgactaagttgaagccaatgctcatgtagcattccaaaattcctagagcttaagaattatgctaaatctactctgcctgttctatgtaaatggaacaaaaaagcttgaatgacagttcacatgtttacagtatgttttaccaaatattttaaacccactattgagatttaatgctcagagaaaaaaaaaagattcctttcaaaatattaccattcactgacaaagcacctggtcatgcaagagctctgatggagatgtacaaggagagtaatgttatttttatgcctgttagcagaatatccattctgtagcccatggatcaaggagtaattttgtcttttaagtctttttatttaagaaatacattttgtaaagctattatgaccatagtgatttctttgatggattttgggaaaataaattaaaaaccttcttgaaaggatttaccgttctagatcccatcaagaatatttgttattcatggaagaaagttaaaatatgaacattaacaaggggttaaaagatgtcaattttaaccctcatggatgaattttaggggtccaagacttcggtggaggaagtaactgcagatgtgatggaaatagtaagaaaattagaattataactgaaacataaagacgtaactgaattactgcaatctcatgatcaaacttgaattgatgagaagttgctttttatggatgagtaacaaaagtaatttcttgagatggaaactactcctgataaagatgctgtgaacattgtggaaatgacaacaaaatatgagattacataaatgcagttgataaagcagcatcagggtttgagaggattgacttcaattctgaaagacattctaccatgggcaaaatgttatcaaacagtgttgcatgctaccgagaaatctttcaagaaaagaagagtccactgaaatggaaaacttctttgcttattgtaagttaaaaaattgccacagccatctcaaccttcagaactactaatcttgtcatccagaacccaataacattaaggcaggatccttcactagcaaaaagatgaccatttgccaaaggctcagatgatggttagcatattgttttggcaataaagtattttaaattgaggtatatacgttgttttttacctaatgctattgcacacttagtagacttcagtgtagtataaaaataacttttattgcactgcgaaaccaaaaagctagtgtgacttgttttactatgatatttgctttattgcagtagtcaagaattgaacttgcactatatcccgagtatgcctatatatggaaagataaactgaaaactgaaaacttttgatatttcctttaagtcagtgagactatgaagggtgggacctatcatggttaaagaaaggaagatattagactttcatctcatagctttttaaaaaacgatgtgcaattgttatagtaaaaatgtctaaatgaaatatatagcttcaggcataaaatgtataatcataagggctaagcaaaattgaaaacaggtcactgaacaaaaaggatatttaaaaagctctacttaatttaaaagctctgttggttcagtatgtatatttatacatatttgttgaagaaattatgtattttttataaaagaagcagcgaagagagattaacactgctgaatgtggtgtcagacaaagcaaaaaaattaacaactgtcacaattcttgtagtgtagataatttttgataaaatatatgcaaaattagaattgatagccacagcctgaatagatttagctgaaattcctgctagagaaaaatgactttgttctgaatatttgaaatactagctatgggattcagaataaaaatgcattgttgtagtattaggtaaacacttgcttaatagaacaaactgacaaagatatcatctgtctttttcaccattgtatttcatgcctgcgttgagattctcattttatttataataagaggtaattattaggccatagaattcacttagaaaaaactgatgcattttataaagttcaaagtaggaacatattttaaaaatgtaaaagctttgccttaattgtcccctcaatttattagttaattactaatcagtttattagaaatgtgatttgtacatcaagatcagcattaaaccataaatgcatgtgttttctagatgcatttatgctgttttatttctatatgctattttattaagagatttatagatgaaataggaatctttaagttagctgatatatagtaaatattcattatatcaattgctattatctcatacaaaatgaataattgctagctatgctttaaaagatatattttaaactacattgtagagagtcatacacttaaatgtttatttatataattttatgaaaaaaaaaaaacaaaatcatatctatacaccttaccaaatggaaagttttatggtcagctaggtttttctgaccgcttaccctacactaaaacagtggttcacatatgattatgttatgaattgatcaattgctcggctatatgcaataccataagtaacagaataaagagaaggtgctaattgttaaaaaaaatggcttatttacaatactcataaatataagtccaacctgtcttttatccttaagctaaaatgagatatataaactggaagatctagcaataaaaatcatttttaccattccagtggtatatgttctaatcaatttctaatatgtagaattttctcaaactaagagtctattttatattggcaaaaattttcctaataaccttgggtaattaaaattcatatttagctcaaatttctggtaagagaaaacgaactccatatagactagaattagtctctgtggaaactagtatgttctctgaaaagagcacttttcaggttcttctctttttgaaaagtgagttggtcaacaaaatgaaaaataacaatggtgcatacataatgcacacatccacacacatacatgcttacgcacgggcacacaatccaaactgagagcatcgagtgagggtcaccaatggggcagtgactggcaaatgtgaatttctttcatggctgttgatatagttgttaggaaaaaaagatttaagtacacttgttttcaaaatatattatggaaaacattgcagttttacctcaatcctaatcctgaatttttttaagatttcttgttaatgaaattcactatcatgtgtaaaaatgttagtattaaaaatgtaagaacttgttttttcatttcatttggaatgcacataaaaattagtctgtgagatacttatgttaggtgtcattttgtaagggatttgttttaatcccaacaagtgaaataattagcagtttaaacaatgaaaaatgaatgggcactaattgtgattgacatgaaagagtatttctttgattattttaagttatttggtaagtagaataaaagggggagggaaactaaatctgtttgaattcctgctatatgttacacacacagttgaattctccacaaatgatctaagtttattccttacaacaccctatagacaggttttatctctcttttaaagaccagtcaaatacagggaggttaagtatcaagtcagaaatatgagaagtcttctctttcctttatccacaaatttaaccggtcatcaagctctatcaaatttccttaatgtcttgtatattaaacccctttttatattttctttattattcccttaacccttcatcacctctttcctggactcttccaagagtagatcttgcagtagatcttctccacagcctttttctacaatgcaaaactaatcacatgactcctttccttaatgcccttcaacatgtctccatttttcataggatgtactccgaaattcttggcaagctctacaagactctccacaatctggtccctgctcatcacttaaggtttatattcacacattcttattctatttctctcctagacttctcagccatcccaagataattgcagttctgaatctattttctgctgctttatgtctgagtattttctcacctgcctttctttgacttgagctcaccacgccccacctcaaaatttctgccagattgtcttctgtaagctagtgataacgtcacttccttcataaaccatttgctcacctgctacccttgttctctgtcccctcttacaagtgaattgacagctctaacacacatttctaccatagcccacctaactttagtttcagtagtaacttaaatgtttttctttgatcgttagtctgggattaagtttagggttaggacagggacaatgttatattttgtgtgcaaacctggtaactagcatatttcttgggacatcataggcattgtatttcttattttgtttgtaaaggaatgatattggagaatatgaagggtattagaccaagggaaagattagacattcacccataacctagaaaagaatcaattcagggtatccaaacagttatcagtcatggaccttcttttagagttttataattaatattactcaattctaattatttcatatctgtgtgtgtgtcttttccaggtttcaaatttccagtatattaaatctgatttgctcaagttcagtcggatgcgtacaactgaattagaaaaataacttagactcatgtgagatgtgaccagtaggtgtcattcacaggaaagcagcattgttaagactcaggtcgccactttatgagacacccgttggaggtattcaaaggactttagctggctaggtagtatttaaccgataaaacagagcaagtatatatagaaaacatttatcaacaaaaatacagtagacccacaaatttaaaatcactacgagtcaaaacctctagcgacaaatcatgaagtgggtcttcaagctcttgtgaaactctggtgtcctgaattatgcatatcactgcagtcacaacaatttgagaaaaattttacttccaaaaggaagtagcaacaataaggttaatgttttacattggaaaagtgatcgttctccagggcaatatggcagcaatggctatattaagtatttagtcaaatatactataagcttatggtcttccattgtttcttattaagataaatgacaagatcttccattttctttgtagtccagagaatttgaaatcattcctaatatcttcttcttttcatatttaatttcccaagtaattataataattatgcccatataatgtctcttaaaacttttacattgtctacctccagtgcaacactttacttcaaattacaattttatttcacctatactgtgaattagcctcctaatttataactaattgtattaaatgcatccattctgctaagctccacccttctaatttcttcttcatacctcatccagagttaacttttgaaaactcaaacctaagcatgtttctatcctgcctgaaactttttagtgggtttccatttctcctggaataaagacagaagctcataacttggtctaccagtaccccatctccaacttcactaggctctgcctaatcaaactcgtctttttttcttatcctttgtacttagactgctccagtaagtgtacatgatgttctctgtggaattcccttttattgcttttttacttagttaatttctactcacccttacgttctcagctcaagctaacttctttatagaagccctctttgatctccctgctgggtcaaattcctctactgtctttcttatgcaatactcttcttcttaacatcatgctgctatccttacagtttgttcacagcaccaattttactcatttgagtgtgattatttaattaatgtctctacactaaagtataatttttgtgaatgtggggatatgtgtgtttctgtttctaaggtgtctatcacatggcaacaaattaggcaatcaaatatttgtcaaatacatttatgtatcattcaccaaaatgttagataataatttgaatatgtcaattttcttccttctaattatgctctcatttataatacatgttcacagtattatttctacttttatcatatattaaaacagttattaatagataatgctcagttttaatcttcatttatgagtagataaattgctagtttaactgcataaaaatatacatttcacattccatgtttattcaaccagtctgggaacaattctagagtttacatggaaaaaaagaagagcattttgtactgtcaaaagagttgatatgccctaattctcaccctaactagactgcaggtttccctgtcagagaccatgcatttaatgtttttacccctaaggaatcaggagaattccagactttaagtggatagtcaataaataatttactgtatttttcttcccacattcatgctcccttagctgtttttgattacttgtctgccatttttgtggcaaccttttgtgctagttcactgaaccagaatatttaaatgtttttatatagcatttattttacgctcaccctggcttttatagcacatgagaattcaatacaaccagaaagtatttggtgacttaaaaattaaagtatttatgttagattctctggcagaatatttatattttggatttacatacagctattgaaatactctaaatataaagtgagagtttcctaaactttgaagtagcttagaaaacatctaacctggctgtaagaaattaataacaccaaatttgtatagtctctcctagataactgcttttaatgaactattatttctcatttttattctctttgtactcccccaatcctcatcagtgatactaaggtaaacttacatgctttatgcatgatcaaagtgcttacacaagaaagataggatgattaagaaaaacaatgtagggagcagtttcttaaacttcttattaaagccaacttaattctctggaaaagaattaagcagcatttgaaggtcaccagctcttcccaaacctttcagagtatcttgtcctgagacacaatgtttgtgcagcaacaactggttgcctgataaagaaagaaaagagtgagggacctcactgataaagaattgtcatggggtaaaggacatgagggaaggtaggagtgttagtacatacaacctcctgctttttctttccttctcatacgtattttgggatccaagagaagatcacaaatatttatggtccaaaaattttttaccaaaataaaaaatgtatgtacaacatcataaaaatgttacaatggcttgggtagctcaaaaaatgtcaactgggcacctttgtttgtactgctttaaggcatcaaataaatgttagttaaggcaggatccatggtagaggtaaatggcttatgatatgatcagaataatagctttcaattgcatagtaatatgcggtttatatagctccttcagattaattatatcctttaaatctcatcacaaccaaagattatatgattaaaatttagaagagccagaaccaaaacccaagccttccattttaagtccagtaagctttccactatgggatgctgaatcctttcttttccttcctcatctcctcctactcctcctcctcctccttctgtcaactatattagttaaatttagatgtgctagcattgttggagctggggaaaagatgtggctgaaggttgataacatcaatccttcaagcctgcttcctgagcttccagaagttgggcttgccacttaacttgctggatatatgtctaacttttctgagatcaagtatctaggtgtaaaatagaggcattacctctcatgcctaaatcacaagtttctttttaagtttgataccaaataatttagaaggaaatactttgtaatctctaaaaaaataattttaggtgacttattttaattgtatttatcattttcaaagaataacattataataattgcattcactaggtacaaatttcaattgatgaataaaaatgtgagtcatcctttcttttagaggagaggaataaaaaaaggacactttgtaaataaagtttgctttaactgcgttagcttgctatttcccaccatcacttttgtcctcctccttgctcattaagcagtgagtccaaagtgtatctgttgctcttgttgctgtagttgactctgagtggctacagtcttttctaacttggacaagaaaagctagagcatcagtaatcagtcttttcctcgcattttgcttttgtttctggtaggtaacagttgttttagaacaaaattcattcaaacatgtttctctattaattagctggggatgagtttatctgttatcaggaagaagaataaggaacaggctcaaaatgtaagaacatttgcaatctctttacctttgcagtaagtttccttctgcaagtagtcttgtgactagcagagatttaaagcttgggtaataaaaaaaatgaataaaaaatcatcttctatgagaatgtcaaccatggggccacagaggaaaactggaaacttgggaaaactgacatgaagtggaggaggtttattttctttttctctctcttatggtaagatttggagacagcagaaggagagaatatgaacacctataaaagaacatataaagttcttttcagagaaagaactttaaggaactttttgaatagagcaagtttataattaaaataccatcttttagattacaactgttgtcattatggaattagcagatatttaaattggattatttttaccaaattactgaattttcatcattaattgaggtcaataaatctaatttgaagtatcaggaactaagtggttattttaataacaagtctagaaaataaaatactatacatttttttcaaatatgcaaagggctattctagtatactactggaacaagtaacggtattctaggaaagttttatccatatttactacagaaaatttaaagaaggaataaaaagatacttcttgtaattctctatagacattcactaaagagctgagttatttggagaatataaataaattatttaatactttgtaattttaaccaatgactcatcttttaaaaattgtttggattttctgcctttaatgtagtcgaaggatcatatgattaatatagtaggaatgaaaagaatactttttaagttgtacattccagctacttttaggaaagctcatatttaaatactggcatctatctttctttattgatattctttagaatacttcaatattaatgtaatagccttaactcctctccttgtaactaatgccgtgccttctcgcccttccttcatgtgttacaagaatcatccttccaaacaaatttgattaggtcacactcccactgaagaccattcaataacctctccctgtacacacactaaattccaaaaaagtccaagatacttacttatgttctggcactaaccaaaacttctgtttattattatttcacattatgttccagcaataccaagccataggcaattatctacattctatcaagctatcatatttttcctcctttcagtacttgaaatgactttccctcttttaccccgtacagcctttctcatctttcaaagtctactacattcgtctgttgacactcttcctttgtgtcaactacttgcgtacattgagtatactcttattattgctcttatcacactgtatttgaacatactggtacagtaaattacagtctggattatgggctgtttaaaatagaatgcttgtggctggctgggtgcagtggctcagcattttgggaggctgagaggggcggatcccttgagtttaggacttccagaccagcctaggcgacgtggcgaaaccccatctctacaaaaaacacaaaaattagccaggtgtgatcgtgtgtgcctgtcattccagctactcaggaggctgaggctggaggattacttgagccctggcgatggaggtagctgtgagcaaaggtcactgcactccagcctgggtgacagagggagaccccatctcaaagaaagatagaatagaatagaatagaatagaatagaatagaatagaatagaatagaatagaacagaacagatcagaacagaacagaacagaacagaacagaacagaatagaacagaatagaatagaatagaatagaatatgtgtttgtttttgtatcctcggttcccacactccccagcacatatctaggaagcgtgattgagcaaacatagaacagatctagagtaagagagactcaacaaatgccaagtggtttctttactgagcgcatgctgatgtttgccagagtttaggttggatgttagatgagtacaagcagtcattaatttgcaaaagattgatattctctgaatagcccagactacttcttccataatctcttttctccagagctgtgccaaagatgaaggactttcttttttttctggctgaaattgggagaaatgacaagaaatttgaaaaatagaaataaataaatacctataaaagtaaaaaaatgaatgaaaataacttttcagaatatctcttcagaaatagacaatttatggctcaacatgccatagcaacaggcagaaaatggtcaatcacagtttctggtctgggtcacttttgatggtgcttttaatctggcattgtcaggtcactatttggaggatattccctgactaagctgttaaaatttctgattatacaagtttgttttgtattttcataaaatgatcattttaatttaaaggtataataatattcttatttcttattcaacattttatatctttgtgtagaatattttccttattgttttcatctagtttgttaaattaaaattaaatctctaaaaccaactatttgtgacaaatcaccaaagcctttagtggtatttgtacagcgaaatcatgaaataatacgtgtgtcaatgaaatatatttatacttataggccgagagcagtggctcatgcctgtaatcctagcactttgggaggctgaggcaggcagattacttgaggtcaggagttctaaaccagcctgtcctacatggtgaaaacccatctctactaaaaatacaaaaaattgatgatgggtacctgtaatctcagctactcgagaggcttaggaacaagaattgtgtgaacctgggaggcagaggttgcagtgagttgagatcatgccactgcactccagcctgggcgacagagcaagattccatctcaaaaaaaaacaaaaaaaaagtgtatttatatgtatatatattttcaataaaaacatactaaattgtataaatactaaaatccttccatctttttcccctaattttagtcatcaagttcttatgatcaattggctttcaaaacatactgaggccttcttaacaacaagtgaaaatttccaaataaatgatcttaattaaatcatttaaagtacagagcaaacatgaaagaactattagttatgcctcagtcctcatagaaattatgtgcactagatacagtacacattgtcatattttcctacattattgtcatcatttaccatgaaaagccaatttaaagggaggctttttttttacattaggaagacctatcttctagcaaaatattataaactttaaagcaagatcaaaactaaagtcaggacactagttaatgaatctggaaatgaaggtcaaatgggactttgtggatcaacttataatttaaaaaaaataaggacaaaaacagcacacagcttgtttaaagagacttccaggtgctgctatatctttagaaattttgattatcttataagtacgtactaagtacaatagtcactattcctaaagtacttctagtgcacagatgaatagattatgaaatatacaaggctcaaacgatatgtcaaaaacattgtccagataagtagtataggagttttgaggaagcaggattcacttcaagttaggatgatctggggtaattaaaatgatagatggacttgtttggcaaatgaggtgacagaggtatttctgaatttgtatgaagagaatttaggtaatagctgcaagctacaaaagtttgaagaaatgcatagacttgctagagtggaatattagtaggtccactttaagaaagcaaaaggaagaatgtggttttaatagccaggcagagagccaataatcaatagagtcttgagcgtgaatttctactcagaaacaaaatgactgacctggtattttttgttattgttcagatagttttattattttttctaagacattttcattaactagaatagagagaggatgattatcaatcctattgctttgaaaggcacaaaacaaacactgacatgagataaattaaaaaataaaggtttattttagttacatcaaagcagttctacatttaaaaggcattatacattaatgttttatcactttttatatatgtaataatttttctttgaagtgaagatgcagtttagctcattggatttgtgagtaaaacagatactttcagctcctttaagcaaaaaactgtaaggctatattaaaacttgtcagtctattgataccatagtctctggttctgacttgccaataacttgatctaataataaagaagagaaaatatttaggaaatgacgtggtagaagaagaaaagaagtagtgtgttttttctttaaatgcttcaaaatagagctcttcccactgacttatacacctgcgtgtggggaacaagacctaccagccactgtgtggtctcctttgatacttagaacagcccagaataacccattcaattcattggatgacttcatttcagaaatcatgctttttactgaaatctgaaagccgagaagtccggaactggctttacaaagagatgaaatagttttatgcaagaatagctcaaacaaaatgcagggatttttttgtattccttgtggcttcgttgacagtgatgcattgatagtttgggggcaaatcttcctaggttggagctgatcaacaagtgggaatctgtagcaaattgtgtcaagtcacgatcaattctttgaggtgtaatgatatttttattaaggcaagtcagtggatacttagtacctattaatgttatatacaaggtgtggcatcgaatgtgttcaagtgtaagtctgtgttaactgatgcttctttacaacagatacctacatattcattatgtgtacatttgttttcatttgagagtgaacttgatgttatttgagtccacagtctgtaaaactcagccaacacacagaaaagtacactgctgctagaattgctttccaagatcgtgaaactgctctgatgttttactcagagagaaacctttacaccatttccacagtcgggtttgattgaacaaacaggttgtgcatttgtaatgaagcatgtggatgaaaaacacaaagtacccaatcacctttgtgctcattgtaagcctgttaacatctcacatatctcctgagatccactgcccttttaactaagagtaaagccacttgtctcccctaggatagctgggatgtctgaaatagcagaatgtttgcttttgggctaaatgcctctcctgctagctagtttagctattgattgtgctttagcttatgactactttgccctgagacttctctcaaggattataatctatctaacatttattcagcacagccaatgcctttagtcttcagggtttcctttctgattgaccttatgttcccttcaagaaactaccagagtataggcatgagggatattaatgtgatccctaggttaaatattatttcattccttttatgcaactgttctcttacagtcagagacaccaagtctttaataaattataatttctttaaaattataaaaatgtgttggttagatttaacaaaattaactatgcaaaagaatgcagagaaaagctacataccaagacttccagtatgaatatggaagaaaaatagagcaacttctccctttttctgcatttcctacaaaagtgacaaggtaaacagaaaaaaaaataacctctctattttcattgaaacatgaaggcatatatcaatcacagactgtgtgactctcatagaagccatgtgaagtgaggttcagcagaagcctcgaatgggaaagtgttcactaacagaatgacagtacaactgccagggcaatgccagtaaaaatacacctcacgaaggcataaggcaaaggcagagttggaaaaaatttattatctgcatcaaacaagagttgcaggatctagacagagtagacagagatcaagcagatgctgcatagacagaaaagttgcaacaaagccccgcagagaacagtcaaacaatccagagatgcaaattttagaaaaggcaacaaatcatgtaatctttgaaggaaatttttacaaataactgggccaggaaatctaatgcattccttggtgaaccctataaaagttggaaacaatcaatataaaaatactattggaaagctttgctagaatgatgctgtcataaaacactaaattcaggagaactatcctaaccttgaaagatcaaaatcctgaaactataatgctggaaaaaataattttaaaattattctaaaaaattctttacatatttaaagaggaattatttgagaaacatacaaaagcacaacaatacttcctaggccaatttacacaataaaatacacaatggtaacatatttttgcaagcataaacagtaaggtatactaatgacagtcacatacatgtaatagttacgagcacgtgaattgtattcatacagaaatacatctaaaagcaaaatctataaatgcatatcactatggtcagttagtgtgagcaccaagctttataactggagtcatctgaaataccatggcagacaacctgagatttttgacaagatctatggaaaaccacagtaagttacaactgcatatgcagtcaccaaaagagctgagatcttgagaaactttatctttcacaaatgcacacgtacaaatgggacatttctccatttattaaggaagcttcagtgttttcactttgagaaccagagaagctgatggtgtaattctcatttgtaggctgaaagcttcaggacttagaaagtccaaaggccagtgagctttaagttctaatgtcaaaggtgacataagaaaggtcagccaggtgcctatggctcaggccgggcgtagtggctcatgcctgtaatcccagcactttgggaggccaaggcgggtggatcacctgaggtcaggagttcgagaacagcctgaccaacatggagaaaccccgtttctactaaaaaaaaaaaaaaattgcctggcatagtggtgcatgcccataataccagctaataccagctactagggaggctgaggcagaagaattgcttgaacctgggaggcagaggttgcagtgagccaagattgtgccattgcactccagcctgggcaacaagagtgaaactgagtctcaaaaaacaaacaaacaaacaaaaccacaaaaaagaaaggtctgtcccagctctcagaaagagaccaattcacctttgtatttgttctctccagggcccagctgattggatggtgcccaccatcactgagggcagatcttccccacctgatccactcaggttcgcacactagtctcctctggaaacacccacacagacatattcaaaataatgctttacgaagtttctatgtatgacttactccagtcaagttgacacctaaaactaagtccacaaatctaccccttgtcaacttggcacctgtaagcatcctcttaaaccatacttcatttccaaataaagacaataacaaggtaacagttacacttaacatgaaacaacgatcttgtgattgggatttttagaacttttcttttaaatgttagggattttgaactgtagatatttagacataaggaatttttatatttcaggatttcaacattagggttaaggcatttgggattgagtctttggggattatgatccaaacccaaagttcagaccaaacactttaccatgactttgaaaaggtaacaaaataattatttcaatgaaaataatacagaaaaaaatgaaatgcaagaactcaggtgaagcaacagtagttggttaaaattaatttttagaacacaatataaaaataaaacaagttaaaaaaagaacaaagaacaaggtaaaatggacaatgtggaaaacactgtaattaacatggagtggagtatggaaaagaaaaaatatgagaatgaaaaaccagtgaaataagattagaaaatgttaaacaaataaacagtaagcaaaaatattaaatatttgcataattgaagtttcctttaataagaaaaacaaaaatacttaaaaatattttaaagtgattagagggacataaaacatttaaggaaagcattattttatttttccatattttgtatttttggtacttgttagtctttacaactttgcaatgtgttgtgatgtttttccctaaccaagcaagcattcaatttgtacccaattctgtacttaaaattgtatattatttttctaaagaagacactcagtatgatcttcagataccctaactccttggcctgctcctgcattactgtatttctctccttaagatactataaatattaaatgcattcttaatcatccttttgcaatcagtctgtattaaaaaactgtaggttactgagagtctaatttcataaggtaaacatgattttgttgctgtagtatgaaaccacaaaggaaatagcagatattaggagaatgattatgatttccctcattgattcatacaataacaaacacttattgaagtcctgctatgtgatacacttttagtctaggcaatgtacaagaaaagataagccaaactttccacagccctgaacctcatggatcttacactctggtgggaagtgagcattaaaggaataattacacagataattacacagcttccatactgatatgggttggctgtgtccccacccaaattccaacttgaattgtatctcccaggattctcacatgttgtgggaaggacccaagaggaggtaattgaatcatgggggccagtctttcccatgctattcttgtgatagtgaatacgtctcatgagatctgataggtttatcaggtgtttccgcttctgtttcttcctcattctctcttactgccacagtgtaagaagtgcctttagccctctgccatgattatgagtcttcctcagccatgtggaactgtaagtcaaattaaacctctttttcttcccactgttgggcatgtctttatcagcagcatgaaaacagactaatacaataaattgataccagtagagtcgggcgttgctgaaaagatacccgaaactggggaagcaactttgaaactgggtaacaggcagaggctggaacagtttggaaggctcagaagaagacaggaaaatgtggaagagtttggaacttcctagagacttgttgaatggcttttcccaaaatgctgatagggatatggacaataaggtccagactgaggtggtctcagatggagatgaggaacttgtggggaactggagcaaagatgactcttgttttgttttagcagagagactggcagcatttgcccctgccatagagatttgcggaactttgaacttgagagagatgatttagggtttctggcggaagaactttttaagcagcaaagctttcaagaggtggcttgggaactgttaaaggcattcaatttttaaaagggaaacagcataaaagttcagaaaatttgcagcctgactattcaatagaaaataaaaacccattttctggggagaaattctagtcagctgcagaaatttccataagtagcaaggagcctaatgttaatccccaagaccatgaggaaaatatctccaggccatgccagagacttcatagcagcgcctcccatcaccagcctggaggcccaggaggaaaacgtggtttcacgggccaggcccagcgtccccgtgctgtgtgcagcctatggacttggtgcactgtgtcccaaccgttccagccgtggctgaaaggggccaatgtacagctcaggctgtggcttcaggggatgtaagccttaagccttcgcagtttccacgtggcattgagcgttcgagtgcacagaactagaagtcaagaattcaggtttgggaaagttcgcttagatttcagaagatgtacagaaacacctggccgcccaggcaaaagtttcctgtaggggcggggccctacattctccattctcatggagaatctctgctagggcagtgcaaaagggaaatatgaggtcggagaacccacacagagtcccttctggggcactgcttagtggagctctgagaagagggccactgtcctccagaccctagaatggcagatccaccgacagcttgccccgtgtgcctggaaaagccacagacagtcaacagcagcccctgaaaccagccagaagggaggctataccctgcaaagccacaggggcagagcttcccaagaccatggcaatacacctcttgcatcagcgtgacctggttgtgagacctggagtcaaaggagatcaatttgactgccccgctggatttgggacttgcatgggccctgtaaaccctttgttttggccaatttcttctgtttggaatggctgtatttacccaatacctgtaccccattgtttctaggaagtaactaacttgcttttgattttacagtctcataggcagaagggacttgccttgtctcagatgagactttgttttgggttactgccgaaatgagttaagactttgggggactgttgggaaggtatgattggttttgaaatgtgaggacatgagatttggaggggccagggcagaatgatatgggttggccatgtctccactcaaatctcaacttgaattgtatctccccagaatactcacatgttgtgggagggacccaggaggagataatggaatcatggtggccagtctttcccatgttattctcatgctagtgaataagcctcaggagatctgattggtttatcagtggtttctgcctttctttcttcctcattctctcttgctgctgccatgtaagaagtgccttttgccctctgccatgattataagacctcccaatccatgtggaactgtaagtcatataaaaactctttttcctcccagtctccagtatgtctttatcagcagtgtgaaaatggactagtacaggtatttaaccagtatacacaccaataaagacaatccagttgatagattgttacaatccttaaataccaattggggctgggcacggtggctcatgcctgtaatcccagcactttgggaggctgtggcaggtggatcacttgaggccaggagttcgagaccagcctggccaacatggcaaaaccacatctctatcaaaaatacaaaaattagccatgtatagtgaaatgtgcctgtaatcccagctattcaggagtctgaggccagagaatcacttgaacccgggagaaggaggttgcagtgagccaagattgtgccactgtactccagccttggtgacagaacaagtgagactttgtctcaaaaccaaaccaacaaacaaatgacaacaacaagaacaaaacccagttggtaaagtggataaatggctgccatcctcaagagtgcaatcttccccttccccacctttcctgatatccagcagctaaaacagtaacatcaggtaggcacagaagcaggtctctggttcccagatccagtttaatccatttgtattttgattggtcaatgtaaataccactcagtctcttgtaaatcttgcctcctcacttggttctgtcattgaatccaaaggagacaaagggatagtgacatctcactctctggtctcctgccttgcccaggcaatgggggcttcagtagggagaaggctggtgcctgtcagctgtccagctagccctcttccacccatacacttacactcagggcagagcaggaggcactcagccataaagataccgctgttcactggtgggggtacagggaacccaatgcctaaaggttggaactcatttagtccgaaatatgtgtggtagacattgccagccagcattctcactactccctttgttggagggaaactatggcctccttggaatattagcttttagcgaactggatagagactgagatagccggggctgtggtgtaactggggcagctggggatgtgggaaacattgcagggtccatactcatagagaaaattccgtgggtttggtttagaggagattagacctggggatgctgaagaaaagtcctcctttttaccatctctattaatttttaccttttaatgcaacaattctgttaaaacccatcaaatgtctgccttcttgatcaaatgtaacaaaatacatttgtaaatataatgtgtaaatataaatgtggctgactgccacacggctctacttcacacctttaaccagaaggattaagttgagacccattaaatgagatgttgcaataaatactttttgcgacttggtcaataatatagatactgagtatattaaaaatacagtattttcaagaccaaaagcacgatagtgtaattaccattaatttgacaggagctatgaatattcagcaccaagcatattattgttggtgtaaagataaatgatctgcttattgatagtgtcatcgaatgagcatgattttaatgagattttcatttaaatagttttatctggtttcttatgttaaaccgtaggatagaaaaggactttacgtagctcataacatctgatataaataaaagatcacaaaaaatgccttctaaaaatcaacaaaaaatttgggcatagttagaataatttgatggacaatttatgctataagtcatcatttaataaatggtagtttacacacactcatacaaaaatactgagtgttggtgtatttagagaatggggaatatacttgaatttttgctttatatgttaattatatattattttatattgctgtacaagttgtgacataatttgaatatcaccctgtaatcacactaataaatgtgtaatgccaggttgggatgggattaccattctacaggggaagggtccagttctatgagcatgtagtaaagtaatatttcatatattgggatggtcagggagaacttttgtctggtagtgataagtcaactacaatataaggatgattagaattaaaagcattctagatttacccaagatgtgtgaaaggtggtatgttggaaaggagctggttgtgttcagagaactgaaagaaggctagtggactggagtggaatgaataatagaaagagcactatgtgttgagggttgagtcatagttggaggccagcccatgtagtatgtatgccataggtcagatgaagaatatagtctgcactaatgctgaagccgttaaaggaatttgatgagcttggtgaagtgattacattttaatttagaaaataccactctgtaagtgtaaaaaacaaactggagggagacaagtggcattattgaaagacaagatattaggaactttcagtggttcaggcaaaaatatgatgatagctaatagtaggctattactgtagcaatggaatgatggactaatacatggaaaatttaggaagatttgtgttagatgtggaggatgagagagaggtagataaacagtagacagaatagaaatatccaaatttacgtttagctttgctgagtttgagcttcttatattgtgccacatgaaaattccattcccttctttggtgctatagaaaacaaatggaaccctcaaaatattgttgccaaaatctacttggatcccattagaatcacatggggagctctattcagagactctgattcaattggtctggagtaagacctaggcatgagaatgtcttaaaagctcctcaggggtttctaatgtacagcgaggctgaaaactactgatttagagagaagtgtggttggtttgaactatgaggtttaagagaaatgaatagacagcaaagtagaaatattttacaagtgaacaaaaatacagcaaaatctttgtaaaaatgatgctttctctttgtctctggctttgtctaggttatgttcagttttttttggtaaaaaaatcttccagatgcaggagacttaattgaatccactaagatgcatttagaattattaactcactaaaatattacttcttatttgattccttttttagggtataaaagcgaaaaaatcatgttaattctgattagttttgttttgaatattgatcgttggtgggttgctagcctttcagaaataaaagtatcaaccacattctaaactatttaataggtcagatgatatgtggttagaagggtgtctgtgcatgagagatagggtatacaaatgaatcatttaataggtaaatattaactgatgaaactgcaatgtctttctttcaacctcagaagctaagtatttaaaagtaacatttattctcatactggtggcacttactaatgtccttgtattttaatgcattgtttgattagatgtaatagactattggccttcaaataataagaaaatcttttttttattgaaattggtaactagttatagttaattttaaatactaaagtttcctttaacatatataatattttggaattataaagcctgtaacaataaaacaggtaaaaatatgggaccttgttctggagatgtaaaaatgtctaagacatattctgtgctctaaggaatcttaaaaaccgactggttaataaatgaaataaaatattgaacttacagagtagcatgtaacattgaaaacctgcagataaacagtacaattttgtgcttcctattttaaggatatgaaccagaaaaatacagcaaaaggacttcacaatttgcagaaacttgccctccctcatgcctgggggaggaagaaaagaaccaagtgatgataacactaatagctactgtgttctaggcattggaataagtgagttttatacatgacatcgttaatacccatgacaattctttggagaaaatattattactaactctgttttatggatgagaaaaatgcttaggaagtcctgcccaatagaaatacaaaaagagtcacaaaaagaagccagatatgtaattttaaattttctagtagtcacattaaaaaaaaaaaaaagaaaaaggaaacaattaaaacgtaataaattgtgttataaaatccaatatatgtaatccaaaaatagaatcatttcaacatttattaaactgggatattttacattcctttttctgtactaaagcttcatatatatttgacacttccagaatatctcaatatggactaagtacattttaaatactcaatagccatatgtggttagaagctaccacagctcagacttagagattttaaataagttgtccaagttttagctactggaaaaaggaagagctgaaattcaaacctggatggtctaaccacagagcatgagctcttaaatgcaatcctgttctgcttaggaagatttgatctcatattaagaaatctaacttgagatcatcttattcatacagaattttttgaaaattacagaatacatatcctcatttcgcaagcaaataaatcgtcttaatgaggttaggtaaaatcctaaaagattcacaattagtaactaatacaatcagatgttgaacccacacctgtctagtttcaaagcccatattttaactacaccacaaataaataactagattcactgaaaaggaattcaaaggtaagtaagacccctccccacccaatggaaataatagatggtaattaccaagcagggtgttcttataactaagcacccttcttcgcttctcttatttttaaaaattgtctatgctttctcattctctttaaaaatacaacagtaagtactaccaaccccaccatcacaaccacaaaaacttcaattaatgggttatggcctacagagctcatgttgtctgtggcattttattggcaaacagctgtaagaagtatgtaataaacatctaagaaccatgcctggtatttagactatagtggcatgttaggaacacagtaccccgtggacacgatgctgcagcaatgatacagctttctagggaatagcagaggtagcctcaggcaacaaggaggtgggaggctactctaatgctttatcattaatggcctagaagacttcatgttatggtgtcttgggttttaaattaaatgtcaaatacaatttgccattgaaaatgtgaagtgtggaactgcccttagagactctgagaattcagtcctctaattggtggctgcctagtactgagtagaaatagttagagattattatttggtaaattctcacaccagtctgcagaaatgtgtggacttttacatcttacacttcaagtctgtagtaaaaccttgagacagtattttaaaatatgcagtgttcaatgtagttttaaatacagtggaactgataaactcttccctttgggatcatgccatcatttatgtcctgatctctctgacatttaatctataatatcaggaaatctgtgaaagaaactgaagcagcacacgttctatttacagtggtttatttagttgcccccttccctgctgacaagagtctgttttaataataggacgaataaaaagatttccaatccacttcaatgtgttagcattatatctttctgaactatgtgtatattagcgctaattatgagatgtgtttaagtctaaaactgtaggcttaaacacaaaggcgttatttttactgccggttttaattagaaacctaaagaaacacgtacaattaaatatgctcataaaaataatagatacattcctataatcctcgtcaatttgttgcaccattaatatcattccgcatggcagatttaagaatgtattggagtaagtcaagtggaaaatggcaaagaacaaaattactagcatttaaaccactgtaactgttttagaacagtgagtactgctctaggtatctgctgcaatcactgttttattttgcaaccacaatttaaagttaactgtttgcccatttcatgtatctcttgtttctaagaacaattaatcttgtactaaaaatacacagcttcagaataaaattgacttcaaacatttattttgcaaacataatttttaaaggaaatattaatatgcttaaattttcctgataccaagagaaagatttattttacttgaagaaatatactgtttggcaactctcctcctccatgtaatatgtaaacccaggtggagtagggtatcacaatgccattttataggttaaaaaatgtctccatgacttttccagccacacgatacctacaataagagaacctcaggagatatgcaagctttattcatagataacttgaacttcataccagatttagtctaaatgatcataaattatgaaatgataagtttaaaattaagttttatcacaatgttatagttcattgcaaagtgaaatacaattttatattcctagttaagatgtaaatgttattttgagattgtttatgacatgatttttactattaaaaatcatttggtaatattaaaagcttagtcttataaatctttaaactattaaactgaaacagtagactttaaataaagattaggtcttattattttctccacatgacccaaattatcgttttattgtttgtgatctattccctaaatcctctctaaacattaataattgttcttttatacttaaatcttaagctgaaagagaaaactagtctaagataaaaatatttatggaatccctatatttctagcatttttcatttatttcatgtaagtatcataaaaatttatgaaataattattactaccaattatctttccttttcacatgaggaagcggagtgtcagaatagttaaaagtatcaaacactatcacacagccaggaacatgtccagctgagatttaaaattcatgtcttctcttccaaatctcatgttctttctgtaatattgcacatacttcccatactatagtcacttttgcaaaagtattaaaaagttttaaagtgttgtaggaaatgagttcaacataaaaatccttgtaccatatatgtaaatcattttcctcatctctagccccacagttttaataataattaagctacttgatttagtaatttgatccagtatactcatttttgtcatgtattttaaatcttaggtgctttcttcttttgtgaaagtgttgaattaattacatccaatatatgcaaagatggtgaatttgcctgttacagatacttctttctcctgtgtcatctgagaaaatgtgaacaagtcccacaaggactctctttgttgtgctttgcccctgcatgatgtggccttttttgaaggatgttatgaaaaacaataatatagacaagatacctgtagagtaagaagcttctatattgggaaagtctatagaagtaagcacagcacagataaaggcctaagaactaatgataactaaatatgtgttgtgttcaagttctgagacaaagaaagaacgaaaaagtgcatacaatgtatatttgatattaggattttgttattattttctttgcttacaatttaaagataaataaattaaatgtgatcatttattgagtacctaacaatgcacggcattttgctgggtgtcttcaagacaaatgtagacaacatatggcatgcactttcaatgtgttcacaggttcagatcaggagacacactcataattgctatattattataacatagatgtggcctgggatacaaactaattgctacaaaaagcacaataaagtgttagattaatgcagaggtcaagaaaaaatttttttcaaaggcatgagacttaaaatatagagcagaaatagactaccaagagctaaagaaagtttagtcatgggaaggagcatgaatgaagagcatcttaagtttggaaaggggcaaatgatactcaactgctaaagcagtctgagctacggggctatgtctgtctttctcactattatatctgcctatcacagaaatttggtatatgatagatgtacaggtgctcactgaggaatgaatgaaaatctagggtatgtatgggaaaaatattagataagtctacgaaggcaaattataacgaatttagaagtatcttgataaacatccaaagcagtctgaaatgtattctgtagcccaatgactgccagtaatactacgttaaaaagaaataatcagttttgcttttatgcaaaaacactaccctttaatgtgtagcattcagtcaggatctccctgccctcttaaatctttacccttcatcttctgacagatgctgcccaaccctatatgaagaatcgtaacaactccacacttgagaaataactctgccctactctggaagatttaaggacaccaggttaaaaatgagcagtacactagctgactgaatcctctgacatgcacagtgggcatgcctgaaacttcttgtagtgtagagcttccattgaattttaatatattaatattcactgtattttgtgttatgaaggttttctatgttctaacacatgatctccttgaaatacagttcatctcttgtttatacttttctcttagcagctagtatggtggttggtactttttatgattaataaatgtttattaaagggtgtcagttggatgttccagaaatcagaactcttacactgaataagaaatgccaagagagagttaacaactggagggccaaagaggagatggagcacagttgaataggaaaggtattggactgacctgcagctctgacacctgtgaaaaggaggaagatacaagattgctcagggaaatcctcaaatcatgttttgatgtgatgaattctgggtcaaggtttctcagcctcagcactattgaaattttgggctcagccaggtgcagtgaatcacacctgtaatcccaacactatgggaagccaaggcaaaagaatggcttgagcccaggagtttgaggctaggctgggcgacaaagtgaaatctcgtctctatggaaaatcaaaaaattggctacgtaggatggcatgtgcctgtagtcctagctactccggagactgaggttgtgggagagcttgaacctaggagattggggctgcagggctacagtgaggtgtgatcatgccattgcactctggtcttggtgacagagggagatcttgtctcaaaaaaaaaaaaaaaaaaaaaaagaaaagaaaagaaagaaatgtggggacaaatattttcaataatttactttccaaatttatctctttgtttttaattgtcatataataattgtacgtatttatgggatataatgtattgtttcaatacattaatacattgtgtaatgattaatgcagggtaattaacatatctatcacctcaaacatttataacttctttgtagtaagaacattccaactcctctcttctagcaatttattgttgactatagtcaccctactgtgtgataggacactgtaactttttcttcatttaaatttgtaactttgtacccagtaaccaacctcttcccatgcctcctcccttacaccctcccaagtctctggtaaccactgttctgttcactacttctatgattttaacttttaaaaattccacatatgaatgagaacatatggtatctgtctttctatgtctggcttatttcacttaagataatgtccccattgaggaaggctgaatattattaggttgttccaaaataattgtgggttttgccattactttcaatgtcaaaaccgcatttacttttgcgccaacttaacacaatgtttactagtctctctggcccctactactagatgccagtagcataccagtgacaacaacaaaaaaatctccaaatattgctaaatgttccctggagggcaaaatcacctctggtggaaataagtagcctgggccacccctctttgtacatccagagccaagattgcctattagaggcatctctcattaggcagaaatggacaggtccttgtaccaccaccctgctcagtcagtggttggggctgctgggaaatcacatggcccaagctaagacacagaggtggatcctggagttgcaaacaactggaagctggcagctcactgctccctttgcagctgaactgaaagtttttccttggaaggaacttagagcaaggtatcttcaaggctgcctcataaaggccataggtcctccttttcagttgaaggccttgtgttgtgccttgtctggtatgccttatttggccacctctattaaatttatccttgatatataatctgtgctctgttatatatatattcctggaatagaattctttctgtcaaaacatctgcaactttagctattccctttcctgggtgataaaaatctcagtttgactctacagaatcatatttctctgcattcaaaccttgaaatataaagctcttggacttcagaaatgaagtgatttctgcaaatgaacaatagcacaagaatagctaaatatagtccacattcattttatacagcatcttatatttgggtcactggccaattgactgtggtcacctatttcttgtactttctgcttttattatacatttctggaaaatattaaggtatctgtcaagtggatctttctggtgggtggctttgctgaccatcacatttacttgcacttctgatatcaaattcagttaggccataactctgctagacttactttcttaatctgctctgacatttctcagagcatctcaaagattgtgtgagtcaatcacaatggtctaaaaatatcaaggcacaatgaacctagataaacaatacatagttattgttgctttattagatataatagaaattaggccgggtgcggtggctcatgcctgtaatcccagcactttgggaggctgaggtgggtggatcacctgaggtcaggagttcaagaccagcctggccaacatggtgaaaccccatctctactgaaactacaaaaattagctgtgcgtggtggcacacgcctgtaattcctgctactcaggaggctgctgtggcaggagaattgcttgaactcaggaatcggaggttgcagtgagctgagattgcgccattgcactccagcttgggtaacagagagagtctgtctcaaaaaaacaaaaaaaaaaaaaaaaaaaaggaaataaagtaggggtagtattaccttgaaaacttttctaaatatagggacattgtgttaaactattcttgtgttgctgttaagaatacctgaagttgcataattcataaagaaaggggtttaattggctcacagttatgcaggctgtataagcgtggcactggcatctgcttagtttctggggaggcctcaggaagcctttactacggtggaaggtgaagcaggaccaagaggatcttgtgagaactcgctcactattgcaagtatagcactgagaagacggggctgaactgttcatgaaatatctaccctcaagatccaatcacctcccactaggcccgacttccaacactgcgaattacaactcaacatgagatttagaggttacaacatcaaactgtattaggcatattctgagatcagcagctattaaaagacatttaaactcatgtaaattaaatgtgctatttatactatgtagaatgactgcttcagattatttaggtactgtgctgagaacataatgaaattattatctgcttgaagaactgagtcagggattgaaaaatccaatagctttctttttgagtaattattttaaatgcttgtttctgaaataaacagtattaagaatttttaaagccatttaactaacagaaacaatgtggagaaattatagtgactctactgaattttttttttatctgtgaggtttcaaaggagttaatgaaatcaggtaactggttcctaggagtctgcaaaggctggtgctacctggacacagaataaagaagctaaaatagagagaggcagtttattagggacttggctttgcccagaattcagatttctttactttccttactagttcctatctacttgatcacaatgcttctcagtcattactgtgtgggggaaaaaatcaataatagccatttggattaaagtttgagatataaaaacatccactgcatatccctgtagtatctctttttccttcattgagatttctttgtaattcctttgccaacaacatagaagaccactcttacagattcttgtcacattgtgagtaaaattccaccaggggatctgcctaatattttataactatagtatatatttttacagaatacgttcccaagtttgttgtttgtttggcttattttttatcagacatttgccttgcctttagagaatatgaatatttcaggtaaaaaggtttaatgtggaaatgaagtacaaaaatgtatatgactcctaagggtatttctatttgctgtttcaaacattgccttggaattatttacaattcccagtttaactatgtgcctataacaagacattgtttaaatgcaatttagccctgtggtttcgactgccagatgaagatagtgattcaaaatgccaatttttccaaggggatgtgggttaaattttaagtaaatcattaaaagcccaatttagccaacaataaccaagcataattactcttacttaactgccttccaaagatccttattttcatatttaattaaattaaaagagaatttaaataacagagtaaatatgggtttatttctcttgctagagaccatggccctaaaatcttattcatatcacgttatacaaaggaaatttttaaaactcaaaatctttcaggtttcctcattgctccactaactttttcagaaaacaaatttatccatgtgaaatatttattacctctcactgttgtgcagagtatatattctgcaaattatatgttgaaaactatttaagtcagaatttagtcgacttacttgttcatgcagaaccctgaacaggtgttctcatgttctcactggtttgttttccaggaagcagtaacccaagtccccttttccgtaagttgcacattttggaatgtgtgagacattctctccctgcacgtagccagggcttcatctcctaagtcgtcccactcattattagaagaacttctcctaaaatggatacaaatctgttctcttaaattcttcaacaacttggactttgaatagattttcctatcagtaggaaatgaaaaagtcagcatgagtacattatttagacctgctgaccaggaatgagaaggtgcagctctaattctgatgccgagtttgaattactgggggcattagggaaatcctattactttgtcacgtctctttgtcttctctgtaatgatggaatgtcatttgatgctgtgtactgtcaatggaagcttgataagatctataaatttggaaagatttcatttttcataaagggttatgtcctgcaaggtggccattctgatgggctagaaagggtagccttccacaaagaccattagcaggcactttgagggaggggagggtggaacaggaatttatacaaacaggttgcttaaaaatacatattcaaaaggatacaggaggaactatgaatcccattcagaaccccaagctcatctgtcagatatatcaactgaagaatcacaagatctataaattgagagaggaaactttagttgttataaagagttacagcctgtcaagatggacaccctgcaggctataaccctttataataaataaagtctcctcctcacatttgtagatctcatgactcttcacttgacagtatattatattgcaaaaaatatataggtagtattggaagttatcagagaacttttgaaatttagttatatgattatttatttatgatggtgtttttaataaaattcacactcctttcactgacctatggatactttgcggtctggccttctatgatcctcaggcttgatctcctaccacttactcctgggcattactttgcactcatgatggccttttctctgcagcttggacacgcaaagcccattcttacgttaagatctttgcactgactcttaattaagtgacttatttcatttctgacaaagctagatattttgaagtaagaaatgttatagggaagagtgtgagtgtgagtctttcatgaaagatacacaacacaaattaggtttgtgaatgaaaattattttctttttttttttttttttgagacagagttttgcccttgttgtccaggctggagtgcaacggcacgatcttggctcaccgcaacctccactccctgggttcaagcgattctcctgcctcagcctcccaagtagctgggattacagtcatgcaccaccacacccggctaattttgtatttttttagtagagacagggtttctccatgtcggtcaggctagtcccgaactcctgacctcaggtgatccgcctgcctcggcctcccaagtgctgggattacaggcgtgagccaccgcgcctggtcgaaaattattttcattagctgagctataaatgtttgaagtggagcagtggaaggtatgtgggcagacaaatcatttgagatagactatagggagcctgcaatgccagactaaaaatttaggtttctgttttataggaaatgtagaaagttgccttatatgctaaactgtatgtaaaagagtttttaataaataatttcaggtgtgtatctgttttattaccaaacagcaggaggttgtaaagatttaagatggatatgaattcattttcagaataatttattttccagcagttaccctagaaaatttaacatagatattttacaaaaatctaaagttaattgcattatcctccttctgagtaatacaagttgaatatttaacttcagccactttctcttaatttatatgctactatcttccattatcttaactttatatttgtcttactttttaccctaaaggatatgattattattgatttataaagacaatcaccacatttttgactcattattctttcagatagttcagtgtgttggttaaagacatggcttctggagttagactgtctagatattaatatgcagtttacttagtagttgtgcaactttagaaaatttgcttaacctttctgtgccccagcttcgttatctgtaaaatggaaataatatatttacctatatggttctttttgtaaaatgaattcctctagaaaagcacttagaacagtacctggcaggtaataacaattatatgtgttttctattgttatttttccctttatgaattttatagcttacttctgcagttactatttttccttttgtctgataaatattattatttttctctgtaaggatttatttttggaaaaatcagtttttgatttaatagaaagaggtatttctctcctgtcctttacataaattttcactgggtctggaatagtacattgctaaaaaccttagacaagttaaatttcacagtttatttaggcaaataatgattcataaatcaggcagcactcaaaattgaaagaggttcagagagctcttctctatcagtctgagcagtgagaatttgtaggctgaacataaaagcaaagttgaaaaattacctgattggctacagctaagtgtttgccttatttggacatgagctgactggaggtccataattgtatagccaatcgctggttgaatgtttgtgattggctgagacttatttttcttcagtcagttacggggaaggtttccaagttaagtttcagtttgcttatctaagtgcttgaattagggagacatcctccggctaatggattccttatttgctttagcaataaagtacattattctcatttgtttgtatctcacagtacattattttaattttttgagtctcattcttgctatcagaaagtcaaatgcgagtctggttttcctacttttatagttactttctttttctctctggctgctttttggttttagtattttccattttcaatatgatgtgcacaggtatttcttctttttggatttctctggtctttaagaatcttaaaattggtaaattttatcaattctggaaaatcttagcaattatctatcttttcacatgttgcctcatcccattttctttctcactcaaaaaaatctgattagacatattaagaccttttcactatcattgtgtttctttcttccatagcttccagctattgcctttctgggctacttttaggtaatctttttattcctatttcctctttctcatggtgtcaattccttttttttttttataacacaagtaatatgcctgaaaagtcaaatatctgaagtctttgctggtatgattctgacctttatcatttctattgactctcacttttagtgatttcttttcctgtaagtgacatgactcttgactgaatttttgactattgagattttctttattccttctacttctatttattcccatagtttagacctgaaaattctattttactcttttatgaatggagtatctctctagagagatatccctttgggatcttagacatatggattctcctatttgattacccagctgtgtgggccctaggctttggttttggtcccccacttccaaagcagccatatacataaatctgaagtacattgagaattgcaaagtcactgaatagtaaagtcttctttggttcccagcttaccactcttatttagctttcacatctagtacgtttttctcttcctaagtagttcactgaggcattcaagaatattttataatattctctgtattactttaagaaggacatactccttcttagtcatgatatccagttcccaaattgccagaaaggaaatctactgccactcagccatgaaatggtattcagcatcccaacacaacacaaggcctgtcagaatttatgtggagtcgtgagccatagttgtgtctttaccctgttctaatatcagtcactaggtggtaggaatcacaaactatttctggcatcagattctagagtagttatctttttttctttctgattccagtatccattaattatacttttgagtagtaagtaatctcgaaccatactttttctactcttatattttaaataaaattataaagttgacttgaagtctcagaaaactagtgtggctccttttaaaatttttgctggaccctattccacgcaggttttgttgaggcttaaaaaatgtttatatttaaaagagtaagaaaaactgatcttcactatgcctcacggtgtttaacacactatagaaaatcatgttaaaaagaatgcctccaaaacatgtgaacactgtgagctcagtctgctcactacatctcttagcactttgtccaggacacaaaactgtcatttgcttttctaagataaacaatatcataactcaatctggctaaatttgaaagccaaaatatttttttgctgcttggtcctcaaaagatatatgacagcaagcaataaggagacacattcttctttattcctgctataactttggccacattttgttatctattttttttccccaggtgcattgagctagataacttcaaggatatcttgaaagcaattcacctcaaaaacttattttatgttccttttctatgagccctattccaaccttattcagcctttcaagggaacttccaagcaaaatgtcacaagcttcagtcttagcaaagagtcatggttgagatggagaataaggtccacggaaaaagagatgtttcttcattttattcctttcaccaaaatttacatacaaggccctcacattgaggccttatcacatgcaagtgggagtagaaacacttttactcaacctctactgttctaatttcacagaataactaacatccatcattaccttaataaatgaaaataactcagaatatagatgatattaacaggtaagtaggctaatctctagtttattcactgccactttttcagtcacatatttaccaagattcagttgtgtttgttacaagtctagttatataagttgtccatgttattgtaattacgtaagttaaataagcattttggaaatcacagattacatgagagtaccaagagtaagagcatttggcaaaaagtttgtttaaggctaaagccctaaactttataagatagtcacttaaaaatgctataatgtacgtatgaaataactgcataaaaataatgaaagcctccaagaatcctgccatcagatcacttcatatgtttttaggccactttaaataaatttaaagttgtatatgatgcaacacaggcactatttatacactgcagtttcctgtgatgctgagttaaaagaaatcattttttccaccagaatctttataatcataaaaagatgtcactgctatataataattggcatatatattctgtatattaagaatacagaattaaatattagatggcaaacatttaaggcatatgtgaattaagtgtttttaaagggttttttattaactcagtaccagtcccaattgtgtcagagtaaaggttgtctggtctctcacagggattgctttggaatcttaagacgtgatggagcttaagggttaacattatttattaactggggcaaattagcttcatcaataagagatgtcctagagattgtgtaggtaaagtgcttaacacaatgcttgtaatttatctaataaatggtagttgttattaggatagtcaagtatcccttaatgactgagccatattctgagaaatatcttcttaggtgatataatcattgtgtgaacactgtagagtttatttacacaaacctatatggtgcagcttgctacagatctagcctgtaatatagtctattgcttctaggctacagacctgtacaggatgttactgtactgaataatgtaggcaattataacacaataagtatttgtgtatctaaacatatgaaaagtacagaaaatataattatcttatgggaacatcatcatatatgcagttcaacgttgactgaaatgtcattatatagcacatgactgtagtatgaaaatctaagaaacactgagttttttctttttttttttttttgagacagagtctcactccatcacccaggctggagtgcagtggcacaatcttggctcactgcaacctctgtctccctggttcaagtgattctcatgtctcagcctctcaagtaactggtattataggcaagtgccaccaggcctagctaatttctgtattcttagtagagacaaggtttcaccatgttggccaggctggtctcaaactcctgacctcaagtgatctgcctgccttgcctcccaaagtgctgggattacagacatgagctacgcacctggtcagtttttgtgtttttttttttgtattatattttgccaaaaaatttatttcctagagacttcagtttattcaataattattatctaaaaaataataattgaatactttctatggtggtcactgttctagatgctggttctgtaaagataaacaagacaaaaatccttgcttccatggatatgacattctagtaggagaaaaagataactaagatgtaaatagactagtttaacctcaggcactgataattgctaagaataaaaataaggcagggcaaatgtaagaaaaatcagtgacagagctgacaggagggggcttgctattttaaggagagtaaccaagaaaggcttctagaaagaacagtctgcaatgatttaaaactctaaggtatggaaaaaactgatgttggagaggcctaggcagaggacacagtatgtgcttggcatgcttgaggactagcaagaaagtcagtgttgtgggaatggagttagtctaaaaagttagaagatgaaattaaaaagttagacagggaccggattgcatacggccgtgggcaaaactgtatagaattggtgaaaccagcagtctgtaatagatatttctttctctcgctggttctctccctctctctctctcttaatttgcagatgtatgcactattaacaccttgcatttttaaaagactaacttgtaaccaagtggaaatatactattattacttgacttacttcgtagacatatattcagacctattaaggtgtaatgctttaaagtatttgtacatgcagtcaacctcacaatgcacttattctttgtaatctatgactgaatccgaacactattatctacttattgcactctacttgcaaatatttgcaatagttcagaggaaaatgccaagaaatgggatgtcatttcatacattattctttgaatgtaatagttgacagaaagtacatattctaagaattgaaataagttattttaaaaatgtgagattaaacaaattccaattagtagtttccaaattcctgtttgtgactttttaatctcacaatgcacagcagtttaatgtaaactggtacattaaactggtagccaaaaaggcatttccaaatacacatccttctctttgctttggtaacttttattcattgattataacttaaccttgcatctagtaggaacctaatatatgtgtaattaattatattgtcatttctttgatgcaggaattttattaaagtcatcggataactatgttttcaaaagaaacgtgtaaaaagtttacatatttcagaatcttaaatattatttcatttactttttattttactcagaagagttattttacttagcttaatgtccttcagtattatgtattttaaaaaaaccaagagagtaaatttcagatgtctcatcataaaaatatgatacgtaagtgaggtgatggatatcttaattagcttgatttaattatactatattttatatacatatcaaagcattatgttgtactacataaatgtatacagctacaatttgtcaatagaaaaagcacaaactaataatctcaatactagaaagagacagaaagggagaaaaagagagagagaataagggaggagagcaaaaataaaatataatgtaattatgtatcttaaaaagaatgactttttaagaaatattatgttgtgtgtatttaagaaatattattttgtttatgccctaaggaccaagcactggtgcttgaaaatgaatacacacacacacacacacacacacacacacatacacacacacacacttcttcttttacaagagattttaacataaaataagttattttagaaatcaaattcagtgtaccatttatatttgagagtaggaaaaatgtgcctggagtttatacttaaagattatttcataacacccctacatggcatcttatgaaaagtgcttcacatgcattcctactaaaatctcaccttctatcctccggtcacaggttgtccctttactctgttaatttcttcagagtatgtatcactgtttgacactgacttatttatccatgtgttccttgtcagtctttccacactgttccactcaaaaataagttctttatctaagaccaataactccttgaaattttactgaagatcctttgctactgtgtccagtttctcctgctatcttcatgagtcaatgctccttttgatggctctcaacccatgtatgtgtgtgcacatgaatgtctgtgggttttccctctgacagtcccagaaacagcccttaagggttgtaataacatttgtatttgtttatgaagaatatttagaacaacagaggaccttaggacattgtaaatagagcgagaagtaccaatttggggagtatgggactgagcacaagctcataaaaatgagttaagccaaagctatattaccttctcagaattcacaatttcaaaaaaggtcaatttaatcatgaattgaaactttgctaactcaactgtgcagttctcatgagtcataatcatacttctggcaactttaatctctccagttattatgtgtgatatgtggattttattattttcctttctggtaaaaagcagtgtataaataaccaagatgctttaaattgtcacaattagctatgaggttgttatttagtactttgaattatatgtatatctgatatttactcataaaatacagaaaatgatgaaaaaattcttttgtttaggcttgttataaataaattaaccattattgtcttaactttcttctccattaatgatccccaaatataaagttaaaatagactaccaagacttatatttaaaattataaataaaaatggaagtaacttcatttaggtagaggtactaacaataaattcctttctttgacataactatattacattatgatctagctaggggaaaaaatacgtgtctatatttttcagatgtttcctaaaatatagagataacctagacttctaatttcataaggagggatcagataccaagaaggcaatcattattcaaaaatcattgacatactttacaattatttctcaactgaacggctttgcgccaaggagaacatagctgacacgtgaaaattctggaggtacttgtggattacagaaacttccaatatatatttgtcaagttcttgcagaaagtttagtgtcagaattttctattcttttcatgtttattgtatcattcagggaaaaaaaggaaccaaatatattaatgtgctatactggttattgttataaaaatggcattagacaaaaacattaaatattcatgaaaatcctttttcccttacgttccagccagcaaaagatactgaaagaaataattcaccaaaggagagaactataacacagtacagataatcataggagttataaacaaaggaagttgacattaataattaaatgagaaaaattccctgtggtggttttgatgagctacaggcacaatgtgtaaaatcacttggccaaccgatcattagttatgctctagaccaaaggagtatatattaatgtaactggtttctctaccctatttttctagtccaataatttgtctaaggtaataaatatagctattacacattccctgtgaggaaaaattatccccattagaacctgatgtttttactatctgtatgggagtattcaatgtagataaatgtgaaaaggagagttgatcacatttcctaagtacttgtattgtgtattacatgaattctaacagaaactgtattattgctgtctagtgcatattaatctgacctttgcactaatggttatttatcatgttattaggagatttttgcattggtttgtatttgttggcttttctgtttgtttatttcctctgtttaagaaaattgttatctatctcaaacagggcactctttaatgaagaaacaccagagctgttaaacacattgagacacagaagattctagtgactgaggatggcttcctcttggaaactaatgctgtttctgtcagtcaccatgtgtctttcaggtaaaagtcctgattaattaattatttgattttctaagtatcaaaataaccaaaatatatcaaggtctccattacaaaatatcctcaggtattaatttaaatttatatcagtatttatactttccaacaagagaaaggcagcaacccttaagccgctgttaacattgcaaaatgccatatacaatttaatataataaggtacactataaatgttaataaaatgagtatttacctccttgacattcatttgcaatctaaaccatctagctttcagaaggcttggaaatatatatatatatatatatatatatatatatatatatatctcccacacatatatacatacatatgtgcatatatttatgcatataatgtatatgtatataaataattatgtattttatagcagctaattataaaagtgtctcatcacaatgctaaatttcaccatataaaacagaatcaggttagctttattatatataacacagtatctaaaggcatctctaacacaatgtattttttcagattgtctcaccttctctgactttgttgtaattaaacttatttttctatatcttgactctaaaatgagatactttattccgaagaaaagtttatagtattggtagtaataatatcataatgcctaaagttaatatgtcagagcttatttgctttaattgaagaatgattagaaattaaattgtggtcataatttaagcgctatgcatgtaacatttacagcttgattatatttaaatcagtacctatattgtgggctaaatttaggtagtatgtatggtaagagagtctgaaataaaatgtaacagctgataattttagattaaaagattgctttcattttaaacacatttttaatgtgttaattatactaaatatatttttaaagcagtaaaatattcattttgatatatatgatcattcagtactctatgcaaatattgatataaatacatacatgttccatttatacatatatatgaggataacacatgttcaagatatgtatttatgatcatatataatatagaatacaaactacataaagatatagaacatgcatattatttacatatgatcactaatattgcctcatcttctatatggttatattactatgcaacaaaaatatctaattgattatactaaatttctttatttcaaagaactaaacacattctcctgtcaattaagtctttcctgtattgtgtaacatgaagaaaactgcagattgtctaaagaaaaaaggactgatagaagaacaaacccaaatacaagaaaatataaactctttttagaatcatttaagctatattttttaaattataattttacaatggttattctttagcctttatactattattactattcgtaatgtaccaaaagtataacttcaattatgtatgatatatgagtcttctttataactgaaaaggcaatcctcaacttatcagattatgctccaaaacattatttgaaatctaaaagaatttctttatatacagaaataaatttagtatttcagttatataagttgttatgtgttgaatgtaatatctgcagcatacctgcactcatctaaatgcttttacaagatatataaaagcctttttattgcaatactagtaattaaataactgaaaaaacaaaaaaccaagtaattatttatatattagtactattatacgttcaacacgttgcttacagaaaaaacaggtttaataagagacatgcaaggaaaaaggatacctctataaaaagttggtagagacatctatgacatgaaaaggtaaggtatctcaaaggcattaagagttaagtgaaaactgtgattcatcaatattatggttacttaaaaaagaaatcaagagtcttcagatattttattcagtgttgggtttcttttttttgtgcagcattactgtcttccctgctgatctcagttgtttctcttttatcttctcaatgtcattttcctcttgaacttataagccaactgaaggagatggaggtagggttgcaagatgaaataaaggacacccagttagatttggatttcaaaagaaagttttgtgtgtatgttttttgttgttgttttgtttttagctctggtatgttccatgcaatattttatttcattttatctagaaattaaatttaacagatgtccagtgcttttatttattaatctgacaatgctagaaagaaagaaggtggtgttctataataatactgtaaagtttcattctcttgtatttgtccaatattgtttcctcaaataaacagtccctgcaaaagagctattatacagtggttgtggaaacaaacacaaaaatactcagcctgatatggggtccatgatccctagatttccagctaatactggaatcaagttactattcatttcatgaaataaaggaaacattggaagacagaaataattaggaagagtttgggtatgagtggcatttcaaatgttataggcaaagcagaaagaaaagttgaaaacaaaggtcatgtacaattgctacatgggatttgatctttaatcatcatatctgcggttgatgtgcagcaaatattcagttgcttttttaaacagatgaatttcttttttgctgtagatatctgtttaaaataaaattgattaggatacttgaaaggatcatttatcaagaatgattatgttcaaaatctttcatttgccttcatcctcattttatcatactatttcagaggtggagcccctattctgcttttgttccttggttaatgcttacactctatattgccctcactattttaaatatttagtattttattatttcattttcactggttattgcttttagctgtatatgaatgtcacattatagggcctatttggcacactgagttaattactattacgaaaatgagggccattaagctgtggatcacgagcacattttacgttgttggtgctgtttgaaccaaaaagactaactgaagaataccctgattgtattccatatttcctttatttattcagtttttgaaaatctacggattatcttgggtgtgtctaagaaacggaaaagaactcttacctaactctatgtttgaaaactcactacaggtagtcataaaagcttggcatctttcacaagaacaggcaaccttatattaaaaatgaatccacaattaaaacaacaatgatatattgctacagatatcaaaatggctaaaatccaaataaataaaaattaataaaaacaataccaattctggtgaagatacagattgatgggaactctcattgacagtgagaattcaacatggtatagccattttggaaggcagttttgcagtttcttacaaagctaaacacaattttgtcatatgatcaaacagtaggtcttctaggcatttacctaactgatttgaaaacttatatccacacaaaaactaccatataagcgtttaccagagatttagtaataataaccccaaactggaaacaacaaatgtccttcaataagtgattaaactatggaattctatacaatggaatactattcagtgataaaaaagaatgaattaccaataccaaactacacaaacatattaatggattctatatacaaatggctaattgaaaaaaagatgatagtttgaacagactacatgctatatgattttctttatataacaactggaaagagaaaagctgtggagactataaacagatcagtgattgccagggtcagggagaaggttgaatgggtaaatgaagcaaaggacattttttagggcattgaaactactttgtatgatactataatcatggatgcaagatattacacatttatcaaaatcaactagaactttccagcatggagtaaaccataatgtttgcatatttaaaaaatatatagtagtaggtcagaggatctgaggacaaaaagcagaatatgacaaagaatctaactgtattattattattattattattattattattattattattttgagatggagtttcaccttgtctcccaggctgcagtgcagtgaagctatctcagctcactgccatctctgcctccgggttcaagaaattctcctgcctcagactcccgagtagctgggattacagatgtgtgccaccatgaccagctaatttttctatttttagtagaggtgggtttcaccatgttggccaggctggtctcaaattcccaacctcaggtgatccgcctgcctcggcctcccaaactgctgggataacaggcgtgagccaccgcgcccagcctgtattattaataggaagcaacttcacttaggggagttaggggataaacagacttaaataacttcagaaatgagtctgcaaaactaaaggcaaaaaatactgtacttaagcactgcactctagttaataatattttttcccatgtcagcactcctaaaatccataaacatgtatactggaacaactaagtccatggaaggcagatggtggaggccaggtttctcactgttggtgtgggagattacaataagcaagagaagaagtttagaatgatccatgtgataatggattagaatttgagacacacacatgtgtgtgtgtttgggtgggtgtgtgtatacttctgcagatatactaatacctatttcatttctctaacagctgagaaggattagaatctatgtgtctgagtagcaaccaacacacaaagtatcaacatttcggtttctaataccatttataccattttctactcaaagcaaccagggctgtttagagagaagcctaattctaggactgggccaagaaatatataaatcattctagagtatcctgtagtgccagaaagtaagcgagtgctaaaacaaacaaaccaaaaccaaaacaaaaccagaaagaatatgagagtctggtgtgtcaaagagatgtaggagccaactgggatagttcccagtaaccaaaactgggacaatttcagcaaataagtaagtaagtaagtaagtaaataaataaataaatattgggttatagtccaaataaatgaatattcataagtccatattgatatagataaaagattaaataaataatgaatcaggaaaattgatcaatctttatgtagattaatttcaaataatttatgtagatacttcatcctcaaggaggtgtgaaataaatatctcttttcttaagtattcgctgtgcatactgacttgtttccaaagagtacagaatgggaaatgggggccaaaagagaagtgatttcatggtggagaaaactggtaaacatttcctcagccatgtaataatcatgatcaatattagcagagataagtcatgttgatgatattacccttggtatgatgagaatgacagctcagctttgtggttttcctccccaaaacctataaccccaaaactttcgaagtcatcaaaacttaggaaaattagggaaacttttgcacagaaagaggagactaaggagatatgataactaaatgtaatgaggtatattggataggatctcataagagaaaaagagcattacataaatactaaggaaatgtcagtcaagtatgtgtgttagtgataatgctcaggacatttcatccccagaatataactgctggagatcagaatatgccactccaaagtatgcctccttggcatactagttattttgagttggttattttgaaaaactgcagacacaggactggctctgagaagttgcccttttgtaagaaaaatgtgtgtttgcataagaaatacctgtttgtaagagtgtctctctctctctgcaccatgaagaggacaactaaattactagagactcataatcaataaagcaggcattgactaaaatctgcatatcaaatcttacctttgtttaagctgtttttctggccatcttatcttaactgagccttccttgcacttttttttcctttctattaaaaagcaatgatgttgaaacctaaagtttaattttattttctttgagatctgctctagacatttacatatttctctgagttatcagtcatatacagggaatatacatgttaataaacttttttactcctgttgatctgtctttcattacaggaagtcttagttaagaactattaagtccacagaaaaaaataaattatcttttctcctctacattcgttacaaataaaatataaatattagtttattaactgtggtacatgtttcatactaccatgagatgttaataggaaaaactggttatgaatacatgagaattagactaagcatagcattctgaatacttgaataaaatatgatgagggcctgaaaataagactacagtgaagattatcaacaggagtgaaatatttaaaaacatactggcattaaaatatataggacttagtaattgattaaatatttattggtagaggaaatggtttcttaccttgcttataggtgtagatgatcttgccatttacctggattcttaataaaatgggaagtgcagatttaaagctgggaaatactgagctcaacaatgtacatgttgagctttagatgtctacaatacccttaggtgaaaaatatctaaaatttagggaagatgaccgagctaaaagtaaatctgtgattcattcttgcatggatgacattttaagatatgggaaaggaaataatcactcaacaactatggatgtaataatgagttataagacaaggaagcatgtctgagtagcatgtacttttttaaggggaaagaggaagtacaggctgaaaagaatgaaaggcaaattataaattttgggaaacggtgggaaagaaggaaagcaaaacatctccagaaagagagtggtcagcagtggcaatgcattaggaagtttaaatgtgactggtactaaactcttttcttttaatgatagtaatagttacatttaatgaagtagtagaaaccccagcgttacggcagtgagttgtgaattggttagtagaagaggaaaattagacaattattgtcaaatctgttttctgacaatgtaaacctaggaaaaggagaaagaatggtagagagcttggaaaagacaaaaatttgaggaggagtgtgtgtctttccatttgtggatatgtgttttaaggctggagaaactgtttatggaaattcaattcactttatgcccaatgtacatgaagaatgcatattgccttagttagcttttgcagcataacaaatcagcccacaatttattcacttaaaataaaatagcatgtattctttcctacaattccaagggttagagctcggtggttcttctggtctgggcagcctcagtttatctctgcagtacccatgacgcacttgatggtgttatttggccttactcacattgcttgtgattgatgccttgttagcaaaggcaatgggaatgacttggtcatgtctctgatcatccagaaggctagcttaggctctttcatgtagttgtaggctttttaggtacaggaagaaacaggaaaatccccagtttacaagcacttttcatgcctctgttatatttgctaatatttcattggacaaagcaaatcccatgagccaagatcagattcaagaggtggaaaagtagattcaatctcttcaagagagtagctgcaaaagcacattatacagagagcacgtacagcaataagaaaaacgtgggctcattttttactctaacacatatttatatatgtctgtgactgtttcacatgcaaatagaagcaattctgttttttttaaaatttacttatttatttagacagggtcttgctttgtcacccaagctagagtgcagcggcatcatcatagctcactgaaacattgaatccctgagatcaagtgatcttctcacttcaccctcccaagtagctaggactacaggcatgtgtcaccacatcagggtaatttttttatttttattttttattttgtagagatagggtgtcactaagttggctggttttgaattcctggcctcaagcgatcctcctgcccaggcctcctaaagtgctgggattacaggcatgagccaccacacctggccaacaattctgtttatagcaaaagtaaagtagactaaatatttctctgtatcctcattttcaaatacagtagcagtgaaagaactgtgtcctaaactcattagctgaacgtaaaaaaacaaaaacaaaaacaaaaaagaactttaaaactctgtaaattaatttagttttcttaatatgaaattaattaacttcaagaaaatctaagctattatcaaagaatatgtgaaatcatttgaggtaatcataattactgtagcctatttttaatatatatgtgaaaaaagcatcaacattttaatctctattgtgccaaaatctgttattgttctctttgagaattctttttttggaacacatacatcccccaaatgtgtgcagagatagcaattggaagaagacaatacggtccaggatttatctactttcaatttataagcagctttcctgatggttttcggctctttgtaaattcagtctccatgtttaaacaaactcaacaacagaaactaaaattttatgttcctttactctgttatgcagaatttctccagctaatgggtttttttaactatcatattctttttagactatggccagtaattattctaatttctttataagtatttaacatttcaataagtatatcacaataatatttagtacaaatagcttcctttttgtgaaatataaattgttctttattcatgtgtttgggcttaaagaacaataacccaaaatatgatgctttgtcatgctgagcactttcaacttgtcttaaaggaagttggaagcccctagaagccgcctcataaccaaggactttccacctttcccttgtttctctcctcccaagggcactttctgtggaagtgcccttatctgactgaggaaatttcttccaaaagaaatgcaattgtcttaaagcctcctcctcagaaatctcatcaaatgatcaggcaatattaactagcagagaagagaaaaagactaaaagttgtcaccatgcccagatagacttttcatgtattcttctgagggtacagtcaagagattacttgagagactttatatacataataagacaacctttgtttacagtgaagtttcacccctcactttctcacaatttgttgccatctgccccagagctcagaggaaccttgtcccttgctattttctgttccccattaccacttggtattcaaagagaatcatttacaaaccattgtctgctctttgggaccattcagttctcctgaaaaatgatttactactccttaaaattgcctacattctcctatctctgtctttccaatgaagaagagtatatacgattgtgaacctgattgggttgttaggtaatcattctcccatgatttccccccatgcatgttagtaaatttgtatgccttttcttctgttaatctttccattgtcagtacatttcagccaaccttcagagggcagaagggaagtcttcccttcatacctataggtggaacacaaaaccatgtatgacatccgtttaggtcatacagagtggtataaacaattaataataatagtgatatcattgctttcaataagagtagctttatgaaggcagataattatctgaaattgttttggcttgctagcatgctgaaagagtttggatgtttgtcttctgcaaatctcgtgttgaaatgtaatcccccattttggaggtgaggtctagtgggaggtctttggatcatgggagtagatccttcctgaatagcttggtgccctcctcttggtaatgggtgagttctcactccgaataacgtgagatctggttgtttaaaagagtgtggcaccttccccctcactattgcttgctcctgctctcaccctgtgatacaccagctcctcttgctttctgccattgttataagcttcctaaagccctcaccagaagccaagagtgttggtgccagcagaactgtgagccaattaagcctctcttctttacgaattatctagcttcagatatttctttatagacacgtaagaacgaactaacacacatgcacaagggttagcaggatcactttcatctcttttcccagcgtgttttgtcttcctgtaaattttacttaatgtcacattcttttttactactgtcgtcatttttttggttgtgtgtttagttaaactaaaaaatataggtaagaaatgagatggaaagacacagagaatagcagtggccagctcattaaagaggatttgcagaaaagggttatgtatatgaagtcattaatatgagtctgactatttcctgactggtgtaatagagattttaatagaacagcctaataggacactgagatcaggggaaataatgcatgggagatatgtcatatacaaatattattagtatttattcttagaataggctggaaagccatgattattaattcattaacattctatcctttggttggaggtttttgaaaaagcattcattttgtactcctcagtactagcatatatttttgtcaacatcctaaatttacctatatatttctagcaaaagttgtagactaaataagaataatacttaattaggtttattaaaactaggtatatttatatcttttccttgactaaatttataaatcttagaatcaaaaataatttgaggtttatgtagtctgtatctttgcacttgggtaagtaaagtatttttttcttctcaatagggatgaggctcagaaagattctgtctgtctataggtgttacctagtaggagaataatgggaggactgtctcctgtagcagcgcttttcaacataccagacaatatgaaggtgagacaagagaggaaatctaattcctggagccacagtgacctccttcctagacctacattaatacatatagtttttttcttctgaatcactttcagatgcttctaatgtcagctgtattgctttaaaaacaacaacaaaaggcattttttttttctctactttgaccccattctcctccattgagttaaatccattttattggaaaggtgacagtttgttccttctgccaagatgatgatgtactgttgaacagagagtgtctgtcattgataagcttatacaaatacagtccttcttggtggccgtgtggtaaattgcacagaactttgtcactgccagttagtgctgcctaagaacttccaaaggaaaatgaaaatagaagtgttacagaaaacaggtgcctgctaatataaattctgacttccctgctgcagttgagaaagagaaatggattatggctcctccatgatcaaattaaaattatgtatttgcacattgtatctgtccctggggaagttatgatgataatggagactacctctgtgtggaaacccaagttgacttttatcagctgtgccctggcggtattagacgtgtaattaatcagaagacaatttaatttctccttgtcagtgggcggtgggaactggattacctgaacttagtgagctttgttatttttatattaaaagaaaagaaaatgttaaaaggtttctataattgtcacaaattcctggggtgatataaaattaaactatcaactaaaaagccaggttcagcatcctagagaaataagagcaaatttgtgtctcagtgtattggagattaaagaaaaagttaacttattaggtcagctaaatattactttttacattagaaaatatttattgaaaaatatttttccccttgagtattggctaaggagtatgcaatgtacatcaaaagtgttttggaatctagaagatgacatggacatcatctcttctttaaactggactaaccctttctggcaagataactttcaacaataatacatccttcctgatagaagattaataattacattgattttctttattattataaagtaatgctccaataattcacattatatcaagtgtccatgagaacttgtgaatgaatgtttatattatcatttgttaagcagaaataaatttgtaccactataatactgctgtaaaatatgcttgcttatggtaagaattgttttactgcttagcacgagcatctggggaactgcctctatgcagtcatttgaataatttgtgagcaagaaaacagcttattttctgtacctcacctgttcaaattcaggtctctttggaatataaagtggaaagacaattacattcattgagcactcaagcaagcagacataagtgcgatgcagaatgcaaaggaagattcttgatctcctttatattaaacaaattttatagttttatcaggatccaaatatggattatatataatatgtaaaacgaaccatgtataactaattacaagaatgagttaaatgccatatattttctgtttattttagctctttgagaaaaatcctattttgctagccattaataaagttaacaattgactttttgaaactctgtcaactttcatatctgataatatttaacatagacatcaaccagaagatttttcttttctattatctggaaaagaacattttccattctaattttcgttatagctttcacactgaaatttgtcagagcacttagttaaatatcaatgaagtcttcaggttggtgactaggcttatagtatggctttaacctctctgtggctctagggtatgctggaccatctgaatggtccagatcatggataaacatggtttgaagtgaaaattttttatttttcagcatttgaatattttgcaattatgatttttacatgtttatacaaaagtacaagatcatctgttctataagaatagataaaatatctatctgttctatttgctgtttcatatacaggacctagcataatccttgctatgaatgcttgctatgggataactgttttttatttttattatttatttatttatttatttattttttgaggcagagtctcgctctggcgcccaggctggagggcagtggcgcaatgtggcctcactgcaagctccgcctcccgggttcaagcgattctcccgcgtcagcctcccgagtagctgggattacaggtgtgcaccaccatgcctggctaatttttgtatatttagtagagacagggtttcatcatgttggccaggctggtctcgaactcctgaccttgtggtccgcctgcctcggcctcccaaactgctgggattacaggcttgagccaccatttttaagaacttccaggctccagaatccttctattgtgtggctttcttatctcaaaatcttcactgctaaccactagtatggaggcatgatgggataactattttttaaatgaatgaaaagaaatatttactttaatttttttcttgggtttagagggacacaaactatgctccctgttgcagtaatttctggtgaagaaacatccgaataggatgaataattttacattctccaaatctgatcattctaatatttttaatataagaaataagctgagatttctttgggcatttggaaatcctactgaattaaagccatagcaattatcttagcttagttcaggggattgtaaaaacaaccaataaaaaattactaaaggcaaaagaaagaaagtaaagaaaaaaacaaagaaggtaagatatttgaatagtcaatgtcttcatcaggctgctcagcctcatgtcatccattttcacacatcactgaggcctgcaagaatttgcttcaagaggttctaaaggttactttaaaaaaaaaaaaaaagaagaaaagaaaaaagcttgggtcatatgcctctttacttgtttctctatggtaattcagagatgtactggctcacagtgccgttgctggcccaaagctatttttatttaatacctaaattcagaaagaactatttcaacctggccccaggatccttatttgttccagaatagccctgaaggaattgactgtttttaaaataggattctataaaacccaacatgcagcatttgtttcatttatggttcagtcgttcttctaagaaacatcatagctatagatagaaagtttcaagtagtcgtagcctatatactttgtcaaagatattgtgtattggggataaagattacagagatcaaaggcatttaaaaatattatttcaggtaccagttacataataattttcaaggatcttttagtataattcatttgtctgttaatttaccaagtatttattatgtgcctgctagatattttgctaggtgctaaggctataggagtgaacaagacaggcaaaatccctgtctttctggaactcacattcttgtagagaagacagacactttagcaagaaataacataatatctaataggaataattcccataaagaaattaaatggaataaaatgatagtgagtaatattgggggagatggggtggcaaggtgttattaaacatagaatgatcaagtaagttcactctgaagaggtctctaaggaaaaacgcaatgaacatggaaatacaagccacatgaatatctgaaacagtatttcaggcaggcagggaaagacaaatgtcaaaaccctcaaaaggaaacagatactgtacataaagaataactaatacagatgagagaagaatcaatacagacaaagagtctgtgacaagaagagtgataggtggtgaaataatgagatagacaatggccagagcagaggagaggtataagttaataacacgtaaaggcagcctgctttctgctttatggaaaaccaactgtccagcttgagtaagaaagaaggcctggacatgtgtaggatgctattgtagtagttgcgagagaaaaggtaacatgaagtatttagacctgtaggttttcaatggctatttgttagcttcattatgagtcagtactggtatgaatctaccaaataaggagctcacataatcttcagctgtatcaataatgcctagaataagggagaggttagatctgtattgctgtcatgctaacaatgactgattttatgttcagttccagactcagtcttataatggaaacagataatcacaaatgtattcaggggagggaaaccaaagttaggaaaccttgacactttaaactctgttgtaacagaaatgagaattgaaatggaatgactagaatgagaactgaattaaagactcagctattatttaggggaatttttgaccaaaactcaggaagcacatctttcttcttgcaagatcttcactgaattaattattgctttttgtaagtcaatgagtaaaagatgcagaaggttaagatacaaatgacttaggagggaaggcaaaaaaggtttatcataatgaagtatgggtacatatcctggtcatacttccatagagtgatttggcctgtctcttctctcatattcaaattaatcatagtgaatttcagttatagatttcttctttacttaggacatcaagagttagcctttgtatattctctaataacaagcagctatcattgtaaatgacataaagcaagctataaagactttgaagaaagtaatattttttcttcatataatatacataaatataatttcagtatcctgctctaatcttaatgagatacgaaagcctctcagttcacacagcaataatcattacatggcccatagcaagaaatctcatctcaaaaagacagaatttccaaaagttaatactacatacaaccactatcattaaatagctaaaagtttgttatatgtaagccatttagacttattttcagagatgtaaaataggaatgttcaatcctttggcttccatgggccacactggaaaaagaagaattgtcttgggtcacacataaaatacaccatcgctaacgatagctgatgagcaaaacaaaaacaaaaacaaaacaaaacaaaagctaaaaaaaatcgtattatgttttaagaaaatttacaaatttatgttgggctgcatttaaagccatcctgtgctagatgcagcctgctggccacggtttggacaagcttgctctgaaagaacaaaccggtagaagctacagaatagcaaagggtagaattagtttgcctaaaaaggtcctttttagtttgcctaagtgtccagagttggtcagtgatagaattggcactatcataagagtttttcaagaaggttcatgtcaagcctgaacttccttaacacggaaatgatcattatttagtaaatgatcattatgtaaagacaattttagcatcaaagggcttgctcagactgatgatataatgctcccctccccttgtccatagatctattatactgtaagtcagactttcagaaatagttaaaagttttattttattttgttaatttttaataattgagggttttttttaaaaaatagattatcaaatgagaaaacagtgaatgattgtgggtagaagaattgagaatggaagaatatattggcggttagaaacatatgatggacttaacacatttcagattacaggaaaaagagaggaggggttaaaatatatttgtgtttgatgttttgagccagcatgcgggagaacagtggagccagcaatagagataaaggaagactaaaaagaaggggactatttttaaatttaaaatagccaaatatgatggaatatttaatttaagaaataaacagttgttattgtcaaatggaatataattaatttagtagaaaatttaatacactagaatcagttttaaaatgaagtatgttgccaagaagctactctgttttggattccacccaaggagtgtttttttttttaaataataaaatggacctgattacataatactctttttatgaactcagataattccactctgccaggctattctacatggtaggaacgttgttttaaatagttcctggccgggtgcagtggctcacgcctgtaatcccagcactttgggcggcctaggcgggcggatcacgaggtcagcagatcgagaccatcctggctaacacagtgaaaccccgtctctactaaaaatacaaaaaattagccgggcgtggtggcaggcgcctgtagtcccagctattcgggaggctgaggcaggagaatggcgtgaaccaggaaggcggagtttgcagtgagcccagatcacgccactgcactccagcctgggcgacagacagagtgagactccgtctcaaaaaaaaataaaaataaaaaataaaaaataaaaatagttcctaataagcttccaggaatgaatttttttctattgagacggagtctcgctctattgccaggcctgagtgcggtggcgtgatcttggctcactgcaacctctgcctcctgggttcaagagattctcctgcccctgaccatttccttttttgtcttcttttcattggccatgcatgcattttggagaaacctttctagagcatatgtaattctttgaaacttctctaagtttccaagacatgttcttctaccaccgtcacacgtttcaattcttaaaagaaatcaaagctaaaattattattatttattatactttaagttctgggatacatgtgcagaacgtgcaggtttgttacgtaagtatacacatgccatggtggtttgctgcacccatcaacccgtcatctacattaggtatttctcctaatgctatcactccctataccccccactccccgacaggcccaggtgtgtgatgtttccctccctgtgtccacatgttctcattgttcaactctcacttatgagtgagaacgtgcagtgttttcttttctgttcctgtgttagtttgctgagaatgatggtttcctgcttcatccatgtccctgcaaaggacacaaactcatccttttttacagctgcatagtattccatggtgtatatttgtgccacattttctttacccagtcaatcattgatgggcatttgggttgattccatttccttgctattgtgaatagtgctgcaataaacatatgcatgcatgcatctttataacagaatgatttatattcctttggatatttacccagtaatggattgctgggtcaaatgttatttctggttccagatccttgaggaattgccacactgtcttccacaatgattgaactaatttacattcccaccaacagtataaaaacttttccttatttctccacagcctctccagcatctggtgtttcttgactttttcatgatcaccattctgactggcattagatagtatcacattttggatttgatttgcattcctctaatgactggtgatgttgagctttttttcatatctttgttggccacataaatgcctttcttttgagaagtgtctgtttatgttctttgcccactttttgatggggttgtttgtttttttttcctgtaaacgtgttttaagtttcttgtagattctggatattagaactttgccagatggatagattgcaaaagttttctcccactccgtaggttgtctgttcattctgatgatagtttcttttgctgtacagaagctctttagtcagaaatgacttcttttaaaatgaaaaatggtacatttttgggaaatagactggaaataggagggctatatactagtttcaactttgccatgaattgtgggactttggagaagtcattatttccttctctgtaacaaaatgggttaggctacattatttgaatcttcttacatattctaatgttgttttccaataatctcatatcttttattataaagtctcaaacttgggaacaacagaccttaagtatctcaatttttgaagaaatggtgttagacgtgtctatataatatttactaaaatatgtaaaatagaatcccccttaaatattcagaaaatttgatacttaaagaaagttaagagaagtgaaaaagaagtcaccaggctaaatgatgctgttggcagtggtctgagatttcttttcccctcactcagagaaaggaaaaagtgatgattttctttacctcggaataggtaccagaggaactgcttgtggtcattggagtgtctgcagagaggaaagatatgccttttactctacatctaaatgtttactaagtgacagaaactcagatttgttaagaacatgctaaaacaatcttgagaaaggctgacgtgcttcctgtggattttgagggtcgctaacatggcagcgtaagagcatagaaactagattctgttttccaaagtaagttgataaaagctactcttggagcaaaataaaattaaaaggtggtagagtacatactgaatcccagcatttggaagagcaaaggttcatgaaccttctgtgggacagaagttgatgcttcataagtagccaggcatgacccttattgatggattctagccaatgccaccagacaggaggaggtgacttcagaagaaagaggaaggtagtctccccaggggtggagctgggagaagagcaccagcataagacatcagttagagagtagatttctgtgtcttagaactaagcagcatggcagattagaaggaacttccaaagaaccaataggggcaacccactagagaatccgtacttggacaactaccacacagagggccccggtggccacatcacagctgcaccattcagctaaaacttgtggcctgtatattccagcaacattggaaggatttttcaggagaagagaagggagacaaataaagatcaaaacaaaaatagaaacaaataaccgctttttccctaccacaggttccgaagcaccacggcaagcctgatctgtgaggagaagagagtggaggaatgagagattgaattttttgtctaggcagagctggatatattagtattctcaaaatgagtcttaattgccaaaacaagctttgttttaataccttaaggtatatggaatgctgaagacccatcaagaacctcatctatggcagagaaagggaaatctggcaggaggtgtttaaagcagtaattggagaaatagaaagtgttttagtccctattataaatgcattacatatacttggatattttctccttattgacatataacccttttggtagcctttcattgatgtttttctttcagtaaaaatgtaatgaatactactctgagtaaggcaatgtccaggacagacactgtagataaaccagagaaaaaggcaacccttcagtcttaattcatagaggtaacagactctcttaatccatttgggctgctataacaaaataccataaactgggtggcttataaacaatggaagtttatttcttatatttctggaaggtgggaagtccaaaatccagttgcctgcagatttggtgtttggggagggtgtgttttgtcatagatggtgccttctcagtgtaccctcatcacttgttggaaggagcagggcagctctctggggcctcttttataagggtactaatcctattcttaagggtttcaccctcatgacctaatcacctccccaaagttctcatctcttcatactatcaccttgggggattaagatttgagggtatatgcattttggagggacacaaacattcagaccacagcacaaatctttggactgagtaatcaaatttgaaccacaataaagggaaaaaatgttgagggatttctatggtattatgaatttcttttattaatcaaagtttcggtagaggtctttattggactttttgtggcacaattgttaaataattcacaccaaaagacttcaggaaaagacagggcttaagagggaggttgaaggattgagggtatttgaataggtagagagaaaaaaagattgcattagtgcattaaagcagggagaaatgtccagcacttttcacatagagttgtagctctgcctgcttgtgtcctttgacacattacagagattcttgcccccatccctctccctttgcctcaagcactcatattctacaaccatatgctctaaatgggctcttcacatttaggaaaataaattgagagtacatgactagtgattctaccaatgattaatcttaatgtttagagaaagcatggagtccaggacaaatagatgtttttactagattaacgtacagagttatgacatttatgtttctatgaagcaatttgctgtaacttatgctaatattgtagtttgctgtaggatgtcatgattttcatttaattaaaaataatgtgtgacagatgattatttttccattgagcccgatcattaaaaatttatttctagagtaataaaataaaaaatacagtgtttaaaagagtttgtgggactatcacaaggtaattaccatagacatatatattgaaaacaaagtttggacagttctttagttattgcttctaaaatgtttaaagatgattctgcatttgtgcagatctttatagtgaggaattaattctcaaagattttcttttattattattattattattatactttaagttttagggtacatgtgcacaacgtgcaggtttgttacatatgtatacatgtgccatgttggtgtgctgcacccattaactcgtcgtttagcattaggtatatctcctaatgctatccctcccccctccccccaccccacaacagtccctggtgtgtgatgttccccttccagtgtccatgtgttctcattgttcaattcccatctatgagtgagaacatgcggtgtttggttttttctccgtgcgatagtttgctgagaatgatggtttccagtttcatccatgtccctacaaaggatgtgaactcatcctttttcatggctgcatagtattccatggtgtatatgtgccacattttcttaatccagtctatcattgttggacatttggcttggttccaagtctttgctattgtgactagtgccacaataaacatacgtgtgcatgtgtctttatggcagcatgatttataatcctttgggtatatacccagtaatgggatagttgggtcaaatggtatttctagttctagatccctgaggaatcgccacaatgacttccacaatggttgaactagtttacagtcccaccaacagtgtaaaagtgttcctatttctccacatcctctccagcacctgttgtttcctgactttttaatgatcgccattctaactggtgtcagatggtatctcactgtggttttgatttgcatttctctgatggccagtgatcatgagcattttttcatgtgttttttggctgcataaatgtcttcttttgagaagtgtctgttcatgtccttcgcccactttttgatggggttgtttgtctttttcttgtaaatttgtttgagttcattgtagattctggatattagccctttgtcagatgagtaggttgcaaaaattttctcccattctgtaggttgcctgttcattctgatagtggtttcttttgctgtgcagaagctctttagtttaattagatcccatttgtcaattttggcttttgtcgccattgcttttggtgttttagacatgaagtccttgcccatgcctatgtcctgaatggtattgcctaggttttcttctagggtttttatggttttaggtctaaccatgtaagtctttaatccatcttgagttaatttttgtataaggtgtaaggaagggatccagtttcagctttctacatatggctagccagtttccccagcaccatttattaaatagggaatcctttccccattgcttgtttttgtcaggtttgtcaaagatcagatagttgtagatatgcggcattatttctgagggctctgttctgttccattggtctatatcctgttttggtaccagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattgaatgtataaattaccttgggcagaatggccattttcatgatattgattcttcctacccatgagcatggaatgttcttccattggtttgtatcctcttttatttcattgagcagtggtttgtagtcctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatgagcttaaggagattttgggctgagacgatggggttttctagatatacaatgatgtcatctgcaaacagggacaatttgacttccttttttcctaattgaatgccctttattcccttctcctgcctgactgccctggccagaacttccaacactatgttgaataggagtggtgagagagggcatccctgtcttgtgccagttttcaaagagaatgcttccagtttttgcccattcagtatgatattggctgtgggtttgtcatagatagctcttactattttgagatacgtcccatcaatatctaatttattgagagtttttagcatgaaggttgttgaattttgtcaaaggccttttctgtatctattgagataatcatgtggtttttgtctttggttctgtttagacgctggattacatttattgatttgggtatgttgaaccagccttgcatcccagggatgaagcccacttgatcatggtggataagctttttgatgtgttgctggattcagtttgccagtattttagtgaggatttttgcatcaatgttcatcaaagatattggtctaaaattctctttttttgttgtgtctctgctcggctttggtatcaggatgatgctggcctcataaaatgagttagggaggattccctctttttctattaactggaatagtttcagaaggaatggtaccagctcttccttgtacctctggtagaatttgactgtgaatccatctggtcctggactttttttggttggtaatctattaattattgcctcaatttcagagcctgctattggtctattcagatattcaacttcttcctggtttagtcttgggagggtgtatgtgccgaggaatttatccatttcttctagattttctagtttatttgcgtagacgtgtttatagtattctctgatggtagtttgtagttctgtggggtcggtggtgatatcccctttgtcattttttattgcatctatttgattcttctctcttttcttctttattagtcttgctaacggtctatcaattttgttgatcttttcaaaaaaccagctcctggattcattgattttttcaagggtttttttgtgtctttatttccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatatgtcccagagattctggtatgttgtgtctttgttctcgttggtttcaaagaacatctttatttctgccttcatttcattatgtacccagtagtcattcaggagcaggttgttcagtttccatgtagttgagcagttttgagtgagtttcttaatcctgagttctactttgattgcactgtggtctgagagacagtttgttataatttctgttcttttacatttgctgaggagagctttacttccaactatgtggtcaattttggagtaggtgtggtgtggtgctgaaaagaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccgttatgtaatggccttctttgtctcttttgatctttgttggtttaaagtccgttttatccgagactaggattgcaacccctgcctttttttgttttccatttgcttggtagatcgtcctctatccctttattttgagactatgtgtgtctcagcacatgagatgggtttcctgaatacagcacactgtattttctttatccaattttccagtctgtgccttttaattggagcatttagcccatttacatttaaggttattattgttatatgtgaatttgatcctgtcattatgatgttagctggttattttgctcgttagttgatgcagttgcttcctagccttgatggtctttacaatttggcatgtttttgcagtggctggtaccagttgttcctttccatgtttagtacttccttcaggagctcttttagggcaggcctggtggtgacaaaatctctcaacatttgcttgtctgtaaagtattttatttctccttcacttatgaagcttaatttggctggatatgaaattctgggttgaaaattcttttctttaagaatgttgaatattggcccccactctcttcttgcttgtagagtttctgccgagagatcagctgttagtctgatgggcttccatttgtgggtaacccgacctttctctctggctgcccttaacattttttccttcatttcaactttgatgaatctgacaattatgtgtcttggagttgctcttctcgaggagtatctttgtgccattctctttatttcctgaatttgaatgttggcctgccttgctaggttggagaagttctcctggataatatcctgcagagtgttttccaacttggctccattctccccgtcactttcaggtacaccaattagacatagattttgtcttttcacatagtgccatatttcttggaggctttgttcatttctttttattcttttttctctcaacttctcttcatgcttcatttcattcatttcgtcttccatcgctgataccctttcttccagttgatctcatcggttactgaggcttgtgcattcacacatagttctcatgccatgcttttcagctccatcaggtcctttaagaacttctctgcattggttattctagttagccatttgtctaatttttttcaaagtttttaacttctttgccattggttcagacttcctcctttagctcagagtagtttgatcttctgaagccttcctctctcaactcgtcaaagtcattccctgtccagctttgttccattgctggtgaggagctgtgttcctttggaggaggagaggcactctgatttttagagtttctggtttttctgctttgttttttccccatctttgtggttttatctacctttggtttttgatgatggtgacgtacagatgggtttttggtgtggatgtcctctctgtttgttagttttccttctaacagtcaggactctcagcttcaggtctgttggagtttactggaggtccactctagaccctgtttgcctgggtatcagcagcgctggctgcagaacagcagatattggtgaaccgtaaatgctgctgcctgatcgttcctctggaagttttgtctcagaggagtacccggccgtgtgaggtgttagtctgcccctaattgggggtgcctcccagttaggctacttgggggtcagggacccacttgaggaggctgtctgcccattctcagatctcaagctgtgtgctgggagtaccactactctcttcaaagctgtcagacagggacatttaagtctgcagaggttactgctgtctttttgtttgtctgtgccctacccccagaggtggagcctacaaaggcaggcaggcctccttgagctgtggtgggctccacccagtttgagcttcccatccgctttgtttacctactcaagcctgagcaatggtgggtgcccctcccccagcctcgctgcctccttgcagttagatctcagactgctgtgctagcaatgagcgaggctccgtgggtgtaggactctctgagccatgcgcgggatataatctcctggtgtgccgtttgttaagcccgttggaaaagtgcagtattagggtgggagtgacctgattttccaggtgccgtctgtcacccctttctttgactaggaaagggaattccttgaccccttgtgcttcccgggtgaggggatgcctcaccctgctttggctcatgcatggtgtgctgcacccacagtcctgcacctactgtcttgcactccccagtgagatgaactcggtacctcagttggaaatgcagaaatcacccatcttctgcatggctcaagctgggagctgtagactggagctgtttgtattcggccatcttggctccaccctctcaaagattttcattgtgtttatttattattgactgtaagtaacagccatcattataaaattaatctcatgaaatagatcagataattttttactgggatcaaagggattaaggaggatgtgatttctctaccaaatgttctttatgctgggttcttcaaactaatttttcaatttgaaagtattaactttaaaattgaatatttaaattgttcaacgttgttcccttttgggggacaaagtatatagtacattaccgggacataacactcagagtattaaaattagctctgtattctcctacttgaaaaataattgcatggcttttctcctagctcaccatacttattcacactggccctgattactgttatatccttagtgcagagcttctcatgctgttggccacagacagaaggaccttggagatgctccagagtgtccatggtgttaaaactattttccttataatacaataatgttattggcctgctttattctcttgacattgttactaatggagcaaaagcaatggtgagaaaattcgggagccatggcttacacatggcactagcaactgtattaaataaaatattaaatcttgtctcactcaataatatctcccatgaaacaacaaaaatattaatattattaaataaaacccttaaatacacatatgttagtaatttgtgtgacaaacaggaggcatacacaaagcacttctgcttcacgcatgcagaagtacagtggctgcctcagggaaaagcattctgctttcatttgagattgtgtagttgtttgaactgtgaaacaaactagcagcagctgctttttcatgaaacactgtttttacttgaaagaaagaacaacagacaaactgttattcaggcttgcatacttggtggatattttcttaaaagtgaactgagtaggcctgttgctgcaagggaaacaactaacaagatctgttgccaatggcaacattcaagcttttgtgtaaaaactaaaatttttgaagacttgtatccaacttcatgagctagaccatttcccaattcttagagacttacctgattgttaaggatttgtgcaattcagtggacacatattttccaaatgaccaaacacacagtgttacaaaatcacacatggataaaagatctaatctataagacagatgaaaggattttaattttacagtatgaaaagttcactcaggtgatttcagattactcattacaactagcctttaagaaacttgagttttggtatagtatcaaagaagaatattcataattatctgaaaaggttattacaattcttctctcttttttgactacatatgtgtgagagcagggttttctttagctgcttcaaaaagaacaaaactacaactggttgaatgaaaaaaggtaggaggatctagctgttttctattaagctaaattcagttttacaaaacttataacaatgccactcttcttacaggctttacattttgtcttgaaaaatatggttatttaaaaaaatatatatatttaggttaacttatagtgggattttcatagttattttaagatcatttaatacataattttattttttcagtattgatttctaatatagtaaaaatacagatagatataactcacctaaacaaagttctttcaagacttccattattttccaactgtaaatgggccctaatatcaaaaggtttgagaacaactactttagcacaaagttaaatgggatcgtagacactggaatgaagatgtgaggagtaaaggctggagagttagtcatgtttgagagcatggagataatatctgaaacattttgtaattcataaagaatttggacgattgcaaaccactgatatatccaaggaaattactgaatttaaaatttccgtggtgaagcaggtgaatggcaatgacaaagtcaggattttcttgtaaaataaattgttctttctttccttccttcctatttttcttcctctgaattcagtcagctaccgtgttagtttatttcttctattataatatatcatatcatttattcctttcttgatatatatctcatatcatgtatttcattcatttaattaaatcccgttccaaatggcctcatgtctagtctgctaatttctttctggtttctgtgcaatcagtttttatttttttctctttcaacccatcctgaaatctgctgactgattaacccacttcaatccagtcttagctctattaccatcatcccacaagctcaatcaaatataatgaaaacatttgtgctaaccattggtgagatgataaatctcaaacttctcagcataataactgacataactcagcataataacggacataactcagcataatggctaaaggaccctctctgagcatgttttaccctttctctaaataaaaaatgctctaattaaagtagtttattcgttttctttttaatgtgccaaatctgttttaaccatggtacctttctgcatatcatgttctctagcctgaaatgcccgcagtctttgccttatcatcttatacagataaaatgagataatacttttcaataaattagtacaatacctgaaacataataagcagtaaattaaagccagttatttttcttattaatattacgactatactgtaaacttctggagggaagatactataccctatatcatagttgattctccattgtatagtagatgtctctctatgtaatatatgttcacaaaatatatgtggcttatagtgatgattatccatattttgactgactttatttaaagttttaaggaagggccactcatctaataaatctgtccaacaagacataatattttaacatagtcaccaaaataaagtaaaaaactctaactcagggcaccataaagtgctagatatgtaagcttatccaggaacgttaatgcacctaggcagagaatcatcaacaatagtctagtaattggcaagagtatcattaatcaacttttttccaggcaagtaaagttaaatcagaattcagttaacaattcgtaatgtgtgtgcgagtgaggatcagttaaccatttatgaagtttatgccatatgttgaaaaccaggtcatattgcaatgaagtcatgttggctactaagaaagagcaactcagaaatgaagaggttttgcagtatgggtaatccgctggatatcctgtctctgacaacagagagagaagcggctatagaagctgcctactctatactgcacaggatctcctcatagaatagaacatggaaacaaagctctatttgctaccattatatagagaatgagctttctttggaagaaagtatacatgtggaggatctaaacaaaacaatgcacaaggtaaactgacttaaagacacagtgtctcccataaaggagcgacaaattcaatagcaggtatctgctatgggagctagttccctgaaaagaagagcaaccagattcaattacaggatacctgagagaaaaacctacagtttgatgctgtttgctactaacgaggatccattttcttctggtaatctgcccagggaatcatatgtgtggctgcattagatggtacgtttcttctttccaaacaccactcagaatttgaaagatgtgtgtgggagtgaggatatgttatgaagatgggggtcatttgcaagtagtataaagatttgataaaggaaaattgctgagaatttttttaaaagtaatgatcagcttaaaaactagtagcagagttctctcttaaacaaaataaatgccatttgctagcaaaacactttgaaggattatctaggttttcaaaagagtgctttaatagttgggtcaaaatgggttcatgctgagtgacattaggagcagaatggttctgcttaataaagtggaaacatttttattttcttggagctgatctagagaaggaagaagcaaagaggaacagcataacaagagaacaagaaccttaggaaaatatgtggccagtgagaaagtcctaagactgctataccttctccactgtgagcccaaaatccatagtttaagaccaccggccgggcgcagtggctcacgcctgtaatcccggcactttgggaggccgaggcgggcggatcacgatgtcaggagatggataccatcctggctaacacggtgaaaccccgtctctactaaaacacacaaaaaattagctgggcctattggcggacgcctatagtcccagctactcaggaggctgaggcaggagaatggcgtgaacccaggaggcagagcttgccgtgagccaagatagcgccactgcactccagcctgggcgacagagcaagactccttctcaaaaaaaaaaaaaaaaaaaaaaaagaccaccatatacaatcactttatgtaaatggcattttgtagaagtcaaggcaaaggtacaatgttccatgtttgtgtcattttcagattaagaagaggaaaagaaattgttcatgggtaaaattaggaattctgggaaactgggactttgggacaaggtataataatgaaacattaaacccctagtgagctcttagggggcacgtggtggaggtaggagaatttcaacattccaccctctgtggggtgagtcttcaatccattttatttaatacgttaaagtaaaaggaaaattcctaaaaccagaggacttatggatacctagcagttgacatctgggctaacatctgacctgtatttaccttcagaaatcagggaaatccaggatggtggcaaccgtgtcaatatgacacagtgaagcaggtctcaccacagaccaacctggttgcaatattcctgcctgcgttgggagctaagtaactggaacaagtttttgtaacgtgattagagtttcttagaatgagtaattgtcacagttgctgttgtggaaaagtaattaattatatgaagtaattagttttccctcaagcatacttaggcttgatatttttgtgtatagaaatgaaaataacaaaagcaataatatatgtatcttgataggtagtgtgctggattgtagatagaaaatggcgttgatggaacgtgaaacatgaacatgttgtgaaactatagaagtgcagcaaattggtacacaaacactgtcataatacaaggggatgactttgaaggggcagctttaaaatcaatatcttctttagtagtggtaaatgctttataaatgctgtctgcctgaataacaagatgggaataagccagacaaatgtagtcatgattttacaatttcagaggaaatcaccatcaataacatgcaaaatgcaataatttggaagtgttgtaaatgtgcatatttaagttctttaattaatttcaacatataattcaataagttctaccctgattattcagtattcatgtattcaacattctaaaccactaaaagcagaaaaatactgcttccaaagaaggatctgaagtaaagcacatgtatatttagaatatgaaaacagtaattttgccttgaagaaatatactaatagaaaatgaatcaaaggtgatcttgggaatatgttttctatagtgaatacacatgttagttcaagtcacaaattccttcctataaatatttagaaagtatattgatgttcataaatcattatgctttaaatatatttgaagaaaagatatatgagtagaaagaaaattcaaacatacacatttacatgttaatatcaacttaaaagttaatggctattatcagtcaagtgtacatgaatataaaacaaatactatgtctctaacattggaatagaaggaatggcacatgtttacagaagtataaaatgagcttcctatcctcataatatttttctaatattcttgagtataggggaaagttaatgagcagaaaaattaaggtgagtaatacaagatgtgtcatattgtatgcagtgcatccacacactatctaaacaatgaaggaagagagttttacagaagaatgatttacggagagattcactgggctagtgagggtatagccagtccttgagagatgaacttcaggtatagaggaggaaggatcatccagaggaagataaacatcatgagcagagatgaacaggcctctatgtaagcggaagagaaattcagtgaatgcagtgggaggggaaagtggaaaaaaaagaggacagcaatgattatacaagtcaaataaagcataaaagcatcagttacacagagtacaatttcaaaaactaccattgataataataaaaatagataagaagagactgctggatacagaaaggcaaaagcatgagtgatgtcagagattaatgcaaaagagatccaaactcagaaaccctgggttcaaaccctggcattgttgtttattagctgtatgactttgtgcaatcactaagccactctgaaattcctccactcctcaaatggcaatgatattaattaattgacaagtggcaaagttaagataggacaatatttccaagtagataacacagtacttgatataatagaaatatctgttatacaaaggtcattgaatgtaaatctggaaaaaatatttagatctctgtacaaattatgtgttgtagatatgtgtcagtaaagccactatgcagagtcatggcaagaacattccagacaaagggaatagcaaatgcaaaggctatggcaggaaagagtttagagtaagaaatgaaaaggaggcaaacacagaaagactatagtaagcaaagggaacaatggtttgagatgattaaagaagaaggctaatgccaatcatcttgaccatgctagggtttattctgaaaagtgccacaacaccagggatgctagcattaagaaaaagttgttcagaatatattttttccaaatatgtatagaaataaatatttactatatttcaaataaagatatggtaaacatgaaatatcaaacaaagcataaactaatataactatacatgcaaataataaattacaattataatgtaaattgtgaaccactgatgactctgctttttttaacttcagcccactgtgtgtgaggatcactgagctgctgctgcctttgatgtaacatctccacgttggcccaggctttcctgccctgtttagaggctttacgagacgtttagttgatcttttatcttaggcccgtgtatctttttgatggttctctggagggaggttgggatagctttttcttggacagcaaatttaaacccctgctaacaccagcagagcccatctcatgatttacctcttctcctctccaccagacatctgcttattttagagtactctttttacatgactcaacaaaaccttttttttttttttttttgagacagaatcttgctctgtcgcccaggctggagtgcagtggcgtgatcttggctcactgaaacctctgcctcctgggttcgagcaattctcctgcctcagcctcccgagtagctgagactacaggcgcgtgccaccatgcccggctaatttttttgtatttttagtagagatggggtttcaccatgttagtcaggatggtctccatctcctgacatcatgatccacccacctcagcctcccaaagtgctggaattacaggcgtgagccaccacgcccagcccctcaacaaaacctttttatttggcagctggtgcgggaagagagataacgagatactgtcatggatattgtaagaattgtggagtaaagagaggctgggggaacttgagatacaggtgtcctgaataaggataagagaaggcaggaaaggggagagtaagaaaaatatacagtgccaaacatttgcaggaaaatgcccaaaataaagattttatgcaaactgaaataccagtattttgacacttaaaattgcttagtataatggaaaaataaaaatcaatattgaaattccaatagagatggagaaaagtaacaatttttttaagaatatggaaagaaaacaagggcaattcctaagtttttgccttgagcagctaagtatagttttaaacaggtggactgtttactaaagggtgaagattggaagcatatgaaatttgaaagaaaaactaagagctccactttgaatatcttaaatttgagattcctctaaacagaggttgcttaggtggttggatatataagtctggagtctccagaagtcagtgatagaaatctacacaaagttgactgttttcaagatatctctggctttaaaagccatggaacaggatgagatttcctagagaggggttattagatgagtaacagtagaagttcctataaaatctgcagataagtttaaacaatgtccggggaaggaatagagataaaaactcaagaacaagttgccagcaaagtagaaagcaagccagcagagcataagtcagagaaaccaagttaaagaaatgatctaaacatgaggaagacgtcagcatatcaaatgctgcaatgatgacaaatatgatggagatggagacacagccatttgagtatgataacatgggaagacgccaagctggagttggggaagtgaaacagaggtcaagaactggacatcatgagtagagaaaattccccttaaaaattctctgttgaagcgttcaaaaaattagacaaaaaagaaagaaaagaaaagggaaaaaaaggtaccaagatataagagtaactaaggggaatgtaaaattaatatcatgtaaatatttttgtttgttttttctttgtaaatttgaagtagaacatgatcatatttcaaaagcagaaggattgttttgaggaactgtaggaggtgagtgggaagaatgtgaggaggtgaatatagtagtctgagtaagaaatgatggtgggttggacaagcatggtaacagaggatgtggagcttaattgtcagcttctggatgtatgttaaaattagaagcaaaaacattttttaatgttttgcaaacgaaatgtgagagaaaaagggaggcaatggtaatagatatgacaactcatagaatatgacaacataggctttcaacaaatagatttttagcaagaatgtgtaaataaatgatttttccctaccaagactggcttttataactagcttagatacctctctaacttttggccctggatttccctattctgatggagagtgttttctctccttcattataaccctaaaatccaaatgcatattttagctgtttatggattaagagcataaagatttttgatcttatcttgtaatatccccttgattgctagaatgcctgaaggatatgtaataaaaataaataaataacaacaactctgtgttccaggccaacaaggcacataagacataaaaatggaatgtaaactcttgtcactgatttgaaaggaactgtcagttgtttgattctttaagtgattctgtcacacactggggacccccgtcagtgcagtttcactcctaaactacttttattaaaagtatgtatcatcatgtggccacaaaagcatgctatgacagaatagtaattttttctttctcttatcttcactatcttcatcatagaaaagtgttgtgtttctatggttgcaggaactaattaattctatatcaagcagatatattaatagaaaatactttttgggtattgaaaaacaaagttagtattttaacaaattttaggttgttttgttcttcccatcaacaaaatcccaccatttaaaagctattcctgtattattgttttcaacctctccttcttctgtgtttacagaggatctaggccagaatgtgtaacttctgccagattcccatgatgtggattatatccatctctacttctgagtgttttccagaatctctttcttattcccagtgtaatgccaagatgagatcaatcactggaatgtgccaattatcttaatatatgcctttgtcagaggtcaacagcgtgaagtgtgtcctctcttttatatacagagattgtggtgttgttagggatttttccctctttagaattggtgcattttaactgggatgttctatggacatatctgatgattacaattactatataggcctgattgttgttctgcctagaatagtctctatttttcatgcatgctctatccagtattgttatactttttaatggattcagcagatagtgttgctttattgtgaagaagcattttatcctcaaccttacatgacctagccttgtctactcttctagcattgtggaaagtagtgtttatttgctacaaacacttttgctgagtggagtgctttggttggtagctttttccattaagtgcagtactgtgaaaagctgcagctaatgcagacaagtgaggctttaacactctgcctgtctgggggatgttgctgatatctggacaaagcttgcactcagaaggtagtcttggtctgtttctttgcgtttagaccattgtgtaagctcaattcatagcatgcagttgttcttcacctgtgcactgttaagaagggtcctgtactttaggaacaggtaaaggttaactattagaatccacccagcacataataggatacagtgggatttgtggttcactttggccggttctatcaatatgagctcttaacttggagtgcaactgtgaaaagaagtactttagtcacaaagcaataggtagcatcaggtttgcccagcacaaagctgcaggtggttaacgatggtttgccacaccgctgttaatggtgctgctttagatcagtacaaccctgtaagtggtagcatttaaatccagcacaacaatgtaaaaggtggtgttttcatctcattcagaaagaccctggtgtggtaatcctcactttctagttgatttttgataggacacataggtgataatatggactgtttccatcattattctcatcaagtcacagatcattaaagacaacattaagtgaaataagccaggtacagaatgacaaacactgcatgatctcactcatatgtagaatcaattagttgatttcctgaaagtagagagtaggatagtggttaccagaggctggtaaggtagtggggagatggggggaccagaagagggtggtcaatgggtacaaagttagttagatgggaagaatgagtttcagtgttctgttacacactagggtgactatagcaaagaacaatgtactgtatatttcaagacagctagaatattttaaatgttgccactacaaaaaaaggtaaacgtttaaagtgattgatatggtaattacaccaatttggtcattatactttgtatatatgcactgaaacatcacagtgtaccccataaatatgtacaattattatgtgtcaattatatattaaaaaataaaataagggaaatatttttatgtatttccttagtaccaatgatttccttacccataactcagtctttgttttaagataagtggacttaatatgaaaatattctaaacctctcaaacatgtctcttttaaacaagtatcaacatgaaatattagtaaaaataataggtaaagtgcaatattaaaaagcgatttgtggaaaagcaaaggtaaatatgccacaggaatcaggaacatatgataagccataaagcacacagtttatgtatgaattaccagtgtttttctctaataccttattctaaataaagaaaaactaacaatacagaggctttgtcctcgatgtatgaatctcaatttttataatgctgatacttcactgaattcctccttctgccatatatatatatatatgactgtatatactattagttgcaagaaatgtgtgatctttataattaaaatcaataaatattgaactttagtgtggtgcatcatatccctcataagggtttaaggccttttaaagcctttgtgcttcaagtctaagtccctaaccagccacatcagtatcacttgggaacttgttagacatgcagaatcttaacccaatctacagactccgaaatttgcatttcagcaagatccccctgattcaagacacgctttaaagtttgaggatcactgatctaagagacccagataatcttttgggtcttgccttggtgaagatactttccaaggctcaggcatcacaatctaaattaaagcttttgcaggatagtcaagaagaccattactaaattttggagccacttcaggactttgctaaaaattacagagatcatttactttgtggctgagaaatgtcgtcctataccaaaagataggattaagatatgagtttaagtaacctggaatcctgctgaagagatgaattcagtcattgactatcctactaatagcatagtaagagcaaggagttctggaaactcagaagacaatatagatttttattcatagaaatgcaatgtgaagaaaagatcacagcaaactaccaagggctactatctcttatgtgaatctcttatttaacacacattcattcaatcagcattttgtaaacatctcataaacacccactaatcacagatttagggaaaaagctcataagcttcataaagaagtctgaagcaaattatcttaaagaaatgttttcttatatgtctttgcttcagaagtaaaattaacatagactgtatattagtatacttggtaccattacataaacatgtgggaggaaaaaacatatttgttccgattgaattatttgtgttggcagatagccaattctcttttcagaattccactactggaatacttgaagttgaatgaaatataaagcaacttctgtttgccaggctataaaactaaagatgtccatcaggccaaaggattcaaaactttataaatagacaataataatcgcaataaattatattgggttgaaataggcatacatataaaactaatatgcttgaaaaatgatgacctgttctggtattattattattaatcctgttatacatgggaagttttcttcaatcaatgattagcaagaaaaatgatcagcacttagtttttgagataagttttctttatacatctaattttttagaagctatacatagtattcattttcagatctcaacttcttgatgcgttagagttaggaaatggtttctgatccagaagactctcctactgttgtaagaggatatattaaacaataccaatcatatgattcatttgagtaacaaatataattgaatatttagcatcagatataagcaaatataaagctggagtctcacggaatgttcttggttctgaagcctcagcatgcctcacccctgtagcaagtcgtctacaagtgattctatcccaattagttaaattcagtccacctttgtatgctttcaattccttcaggtttgagtagtctctagtagaatagaggtaggaaaattaagctattttgaattcttctccttcctattgcacgttctaaactcccaaaatatttcaagcccgtccaaagagtagtgaggggagcttggaaggagtggaaactctatttatgtttaagactgaaaaaaaaaaatataggttgtttgtttagtgtgtgctcagttatctactggctctgactgtcagggtttttacccagcctgttttccggtactggttatatctagctgtttaattttaggtcctctgctttctcagatatcttatactaactcttttgtgttattataagactaacttgtggcacattaagtgttcctccagtgcccagctggccacacactccataacctcagggtaccaagaattctacagagaaatgattacttctacctcacattttcaatgagtaatcaccccacagctttctccggtatttttcacttctggatgccttcttggtgtggggccatggaagtggcaagcttatgaatgccatagcatctccttggttccttgggtgtgtgggaagcccagggattccttcccaggttgcatcagctacgcagaaatagtaagccctcattgacaccttccttcttgtaataccactctgtcatctctttttggcatttaccacaattctgagccattaggatgtgtctagagattctgttgattggaaaattccatgtagggaatatgataccagtttccttcacttgcaaatattcctacatattgtggggaggtatgtcaagaataacaatttttgctccctaaaactgtatccatgctacccccattcctcaggcgggaaccttttcttccttcctcccttctttccttcctttttcttagctttccttttcttttcttttcttttcttttcttttcttttcttttcttttcttttcttttcttttcttttctgtccctctctctctctctctctctctctctctctctctctctctctctccctctctctctctgtctccttccttccctccctctctccctcccttccttcctccctccctccctcccttccttccttccttcctttttcccttccttctttccttcccttcttccttcctttctttgtctctttgtccctttctttcatggcagaagccttttgcctccttaatatcttaagggagatttttgaagtttgccctttggaaaggtacttctttttaatttaggattaaaaagatagcttttttttttttctcatatgtgacctaacagtccagcacttccagtttagcactcagatgggaaggtgccagtgatagctgagggaagcaggaaagggcatatgtaggtgatatttcacatcatcacattatatttggccataaacttttgctaatattactgtggaactttaggacttttacagtagggaataatttatattttaatatgcaggaaaaacaccatttttcctgacaagcaatgacatatttcattttaatctatgataaatgttagttaaagtcaatttaaaaaatactgtaaagctcaaaattatgcctatgatatatatgtctttaataatgtcttttattaatgagataagattaggagaatttgatatgagagctaacatttaagaaaatcaaaattatgagtcatagtttcactttttaaagttgatttttgaaataatgtagatacatggttaattgattttaaagcagtgaaatattgtatcctcataatatacactgtgtctaaaaactacctgtaaatctcaatttgttacttggaggtgttttttttttaacataaaataagatatctacattctgaggcattgaggaaattggattttataaaataactacaataacccttttaagttgtttttttgaaaatgtctccacctttcataggttgcttattgacacatagcttgagaagagaacgattttctgagagatttttttaacattgatttagccatttagaaatggattttaacttgttattgatttgtgtattattttacatattatatctgtaagattttataagaaatcaaacatcctttaagatgccagttgcctgctaagttacttgtcattttgataatatttcggtgttatttccaaatagtgttctatgttgaagggcacagatgttattacattatgtattttaaagtaaagtgagttatactaattatatgtaaaacattttatcacatattaatctcccttcctcctgatataccaaggttaatatgttcacatccagaccaaattctttgtgcaaatgttcctcaaaatctttgggtggccatcatcaatgcatcaatgacataataagaatttattgaatgtttacaacatattgaatggtgtattatttgatttattaggcacagacactttgtcagaagtttaaaatccatataggaaaatgacagatttacaaaaagacatttaaaagtcaataaaactagatcattaatatttaatatattatacataaaagctataggaatgtggagaaaggaaaccaaatggggtcatctactttaaaagtaaagagaaaaaaacctttcctgatgacggcaggactgaagttgacttttaagaactgatacgaggatgaagagaaatgagtttaagggtacaaacaagggaggaggaataaactcagtcgttgatagcagagtaaaatggctacacttaacaaaaatgtgctgtacacttaacaaaaatgtgctgtgatggacaccctgagtaccctgattttttaatcactatgcattttatacctgtaacaaaattcctcatgtactccataaatttgcacaaatgaagaaaaaaactgacatgtaaatatattttctctaattttaaacctagtaaccaattacttgctatgtgagcaatataagaccagcgtagaaggttcatgttccctgctgaaataggatgttgtgagctaatgcaacttacataaaaattaatgtgacacatttaattatttgcataatgattattttacctcatgttaattaggtataaattgtaatgggtaagggaaaggccaaggactaactttgcccacttcagctgttgcctgagtacatctaggctaagaatacggtcaccctcaattcatcccagcttcccagggcaaactgcctctccttacccctaggataagtgttggactccggaggattggggtactgttctctgaagttctcagccagccctctacaactataataccagctcaataggaagatgggtagaagccagttttttcaaacaatttttatacaaggttatccaccagtgttggagcacctaaatgaggaattttagcttctcctttctttttttcacctttacatattaaaggagaaaatattctgtttaccatggaaatgaaaaataaataaacacataggatgacattttcaagaagctcaaaggtattttgggtccagttgatcattgttaatttctaagcatctcttcactgaatttcgttgacactgaacttctactgtatcaagcagcatttatatctactgcaaatgtaattggcttaggacccttctctccttgttttgtcttaaatatttatttactttttgtgtttgtttgtctctcctactaaacaacaaggatcacatataccttatttccctttttatctccaaagtttggcacttggaaggtttttaataagtatttgttaaataaatttctgatttcatctgccatctctctataaattatttccaaattacaacaaatgtgactttatttaatctttactcaagatgttgaaagtggaactcattgcttcttacattttctactttataacctcaaaaaatatagtcctttctgagggttctgtcttcccttctaagtccacttagtaaatcatcaaactttgttttctttccttcgggctgtcttggtaaacctctttttctttctacctgctagtcctagcagttaccacttcctgtcaatatttgtcatccctcaagcctcttctaaacattaataatagaaaagatccttaaatcacaccttctaaactttgcctagaaatatcccttgagagtaagaaaataatctaaattaacttgatattcaaagtactccacagggatttccaccacaacctcctcaaattcattatacataaactttttgacaaagcaaactttactaaacaacgaatttgtatttctccttctttggtgacaccacaccctaaaatttttctttccttaattctcatcctgctctgagactaatcaatcccacctcatctctgttctccaacgcccagtaggatactggcttcctctttaaattctgtgctgcctgctttctgagccagccacctggcaactagccataaaagactgtgtatgcttttttacatttagaggtatatgtcacacttctgcacataaagttactttgctcaatagtagagagtatgccatatacctttttaatcatatcactttacacactagcttatatctacaaaatgcataaccattttacctatatactatatatacctatatacctatatatacctacatactaacaaatgttttaaatattacatatacagagatatgcatacatatataataactgtgttatagaaattccaaattcatcagataaagtacaagttcttaagaatctaataatagatacaaatcatgtagattactgaagaggtgcagacaaaatagttaccatgagatagagacacacttttatacgaatatatattatgtatacataatatttgtgggggatataattttgtatattaacttctagtttctatcttgattatttactttattgaataataataataagaaacatatttttgatggagaatagaaatagatttagttagtagaaatagtacttgttaacttagtgaattcagaggagatattaaagaggaaagcgcagtgtttacattcatatgaactcaagtgttaggtgagccaagaacacagcagaagagccaataaaaggagcaaaaggttcattgacaattgtattgatcaggcacatttctggctacttcaattgagagcactacccatatattaatatagttataataaaaaacacatacaaatgaactgtggccatttaaggaaaacaacacatggtttggctcccactactttatgggaaggtctggggaggagtttgtgcaatgtaaaaaaaaaaaaatgtatcaaaaatcacagtgttgaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaatgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagcagaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccgatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcagcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggagttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtatgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacagtctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactagcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtgcaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaattaaagaggacacaaacaaatggaagaacattccatgctcatgggtaggaagaatcaatatcgtgaaaatggccatactgcccaaggtaatttacagattcaatgccatccccatcaagctaccaatgactttcttcaaagaattggaaaaaactactttaaagttcatatggaaccaaaaaagagcccgcatcaccaagtcaatcctaagccaaaagatcaaagctggagacatcacactacctgacttcaaactatactacaaggctacagtaaccaaaacagcatgttactggtacgaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggattccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaatgaaactaaagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcaccatcactggccatcagagaaatgcaaatcaaaaccactgtgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaagggctataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaagatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaatcacagtgtttgtgaactcaaaacttctatactgccaatctcttttaaactactatattatctgctgaaaagtcataattttcaataaaatgtttaataaatatgtgttgtcccatctatgctgcatactaggaattggaagtccttttagttactggcagatgttacagcccactaccttgtttgcttgcccaggaaactgatgtcagcaagaatgatcaggtctacaaaacagtaagattagactaggtagtaagggcaatgcatgggttgaattttgtcttacaaggaaaacaatgttgaccttctaacctccctggtcagaatgtgactttatttggagattgggcctttacagaggtaatcaatgtaaaatgagttgatgagattgggacctaatccagtaagcctggtttccttataaaaagagaaaaattgtacacagaaacaaacatgcataaagtgaagatgatatgaagagacacagggagattaacatagtcatctacaagccaagtagagagaccccagatcagattttatcctcagagcctccagaactgtgagatgctaaacttgtgttgcttaagccactctatttgtggtccttcattacactagccctagtcagctattacaggcagtaaacttaatcatctagctttccattcttctagttcacatatgtatgtagattattatgacaagaacaatgtgtgtctatatgagttctaagtctcaatagttatgaatgttcattaagtggcgatcatagaactgtaggagtattaaaatctagcaatggacatagacattgcaatctgctctattaaaattaatttcaacacttattctcctttctcactgataaatatgcaccccattttcttaaacttgtcctttagctttgtatgccagtttcacatgactattcccaaatgtctccctttcttcctggaaatgacgtggttatgacagatgatccatatagcttagaatggatgttttggataaatgtataaaactccagttagaattcaaatttgtgttctcttgccttgtgcttatttatacttatggttgtttaaacttgtgttacaatactgatgtctctttgtatttgataaacaacaaaacagtagataaacaaggatatatagacccaaagagataagtggcaagcaattattctgagcaaggatacacagaccccaaaagatgagtggtaagcaattattctgagcatctgactaaggaagggctcctcataatactagtggttatgggtgatacctgtgcagatcagaaagaccccacctgtctaggttctttttcttttcataaggttatggctgatgcctaatgtaatcattaatgtattcagggagccgtggaacacacagaagtccaggaagacacaagtagaaaattaggaattgattattagggaaaagaggaaagaaacaggaattggttgatatgcctatcctggttctggctgatgaagcaggttcatcaggaacataggaacagattctcaggctcattcacttaggaactttagattattgagataagataggtatcatcatctctcagagccactgttgaggtgatgtttatattgggtagaagattatagtggaaagaatatagactttgaaaacagaaaaagaaacaatattagtgctctggctcaactgtttactgggtgtagttctttttgcaaggtccttagttttactcagtgccattttctttttcttagggttgttagaaagacagaggtaatagcagttaatggaaattcctcatgttctatgtgccaggcactatgtatagtgattcacatgtgttaccttattcaatccttataacatgtttataagataaattgcactgttaatccttttaatacaaatgaagaaatcgagattcaggtacttgttcaatgccacaaagacgatatatggtagagctttgtcagtctagttcaaaagtcaaaacacttaaccctgctttctaatgtgtgcaaaacacttagcataatgtatgacatacagaaggattaagcgaatattaagtccctttttcccaactaactctaaaatattcagactgtaggggttctattaatgggttctctagtctgccaataggaaaatatcactgatgtaatggcctatttgagtctggccctgatgcatcatattctatctggtgttatttctcagtcaggtatagattctcagtcccacaccaatatttaggaccaggactagacataacatgatgagaaataatgggatccaaatgatgaatttatggaggaaggtggatagggatcttagaacatattttgttttccagacagtgctttaatcagattcaaagaggtaaaattagtttgtaagaagtcgaactattacttcatgacatgggtctctgtaagagaggatggtgacatttatataattatcaggtgaaagcaaaacgtagtttcagtgcagacgggaaaattactacaagggaacatgtgaagaacatgtgatattaaaccgagcagggattccagtggccgcatgttaggaaatgataaaagttagatagatagctataatgaaaggtcgcaagcttagtttaggttgttttcattaaatattccaggtaatgggagcaagtgtgagagatttccccaaggtaagggtatagcagggatggaagaagcaatggtttcagaagcaaaagagaaatatttgttaaagagagcaataaataagcagcgctatgtgcttagaaaaaagcggggagtagacacacaatcctaagtacccaagtacgcgtgcacaccaaagcaaatcattgaaactgcttactaatgtagttgagccttcatggtattttgcactcaaggtgctggtgaatgatcacaaagtaaaggtctccattcacttttttaatgtgatgcaaatgatttcaaactttattttcaaggtgccaacaaagacagcttaggctgtcattttcctatagatgctgctgtaccttcatacatcaaaaagtttatttgaataattacatattgtccacattcttatcacaggagtttcctaacccataataactacatcaaaagaatactcagctacagcatagtgcatttcaatagtgtagtcagtaacagatacattctaaaagcttttcaaacccaccagtatttagagattcccccaaacagatataattcatctgagtaaaatatatacagctgtaatttatcaggttgactcaagggagataaatcttactaaagacgtacaattaatcacagtccttctagtatttatctggcggcttagaaaagttaaatgtaaaataagagtcagttcaaattctctaagtgtgcattaatagagtctgtggttgagtaaatacacagaggaaaatggatttgtgttcaatttaaagtaaactatatttaaatcagtagtcctattcaatagctatgaatttaccaatttcaactctttcatgattcatgtatattataatcaacccaagtagttgaaaaaggtggatggaggaatacacaatcttcactacaaaggtataatatgcttccttttttccgtcattctaatagcttcatttgaccaggaaacaaaattacatatggaaaagttgtcttaacagccaattggatagactggcagttttatacttttggataactttaagaaaggtctttgagaatagtacctgaacacctaacatggataatagaattctataatcctacaatgaaggaggtattttgtggaatttattccatatgggagagtaaaaagcagagttaacaggggttgtcatccatactcatgattgcattttgtatttttcaagggctcactagagccacaaccttcaaaatagatcaataacattactcagcaactgatatgtaggaggcacttgcaataagaatttctgagtctttatactaactctgtgaggtacatcatattatttagaccatccctacgaggaaactgagactcataattgttcaacggaatgttcaaaatcagaaagctactatattgcaaagtctgaccaggttttctgatctcaagactgatgtaatttctacttgagcaagatgcagcagaaagtgaatgggtttttggagtttggggtcagatgcacctgcttgaaaggctgtctcacttatcacctgtggatctaaggattattctcttaatccctctgaccccatcttcctcttacgtaatttaaattgagtaggtaaaaagttaattttttataaaagcttaaaaattacaccacctgtactatgtaaaaaccctattgaattcccttcctagtatattgaacatctattatagtacagtaattaaacccatattgtcttctttagtctttttaaaaacttttgatctggaggattctaagtctttcatgaaacaacaacgtaggagcctgagctctccaaagctgcctttacaaaattgaaaggttctctagtttctcaaaacacaggcattatcatttattaatctttttaacttcactttatgcattcaatgactcattccctttttcatataacatttcatatgattccctctttcaactatttattattctttatttgaaaggcactctgccagattcagaatgcactaagacaaaattctggccttggagatgtcaacactgttgtgaagtgaagttgacacaccagtagacagatgagtggtataaagaggagcgggcaaggaactgagagcactggacccagaaacaagaactgaggttagaaagccaatgcaagtgtggagcccagggaattggcaggtttcagagtcacttacactccaggaagtttggaagccaaatggcaaagtagagctagatttctggctcaaggtctttagtccacaaccacgatgctcacaggcaccatccatcattaaagaaaaaaagccaaaggaggatgatatggttaggctttgtgtccccacctgattctcatcttgaattgtaagcaccataatgcccacgtgtcaagaaagagaccaggtggaggtagttaaatcatgggggcggttttccccgtgctgttctctgccatggtgagttagctctcatgagatctgatggttttataaggggctcttcccggcttcgctgggcctgtcttcttcctgcagtcttggggagaagggtccttgcttctctttcgccttccgccatgtttgtgagtttttctgaggcctccccagccgtgctgaactgtgagtcaagtaaacctctttcctttataaattacccagtcttgggcagttctctatagcagcatgaaaatagacttatacaaaggacatagcaaaaagtaaagcgagaataaaatcaggcaagaagcaggcaataaagatagcagggataagaagagagagaaaaagtaccgataatatgcagcaaaaagattgaaattttaatctttattttggcattaaatataaaaaactaaaatccttatagtaaagtaatatcaggatgatatatttgacaaaataatgattcaccatttttattctgaggataatagatacttgcatttgtgatttgatggaattaaaaagcatccactaaataaagtttgtcagatgaaataaaatgaagggttatttgcacaaatatattttagaataaatatttttgatgtaaactgttaacttgtactttatgtttggctaattttagatgtttaaaatctagattttgctaaaaatattggaatgagtcaaaatgtttcctgaattgttttctgcattgttataactatagaataattataaaactctgttatagctatatagcatgtgaattatgtttccaaaagattagcaaagttttatatgtgtttgaaatattcattttctgtcagtcaaaataaacttgaaagtggaagaatttaggctaggcagctttaatcattttttatccaaatgtagcaacaagctgtaattgcattatttcatataggtattacactcctatgtgcttgtttttactatatcaattccaaatatctatgtgaagtattttcattcattgtttatttttgtcatgtacatacaatcatttctcaggtttccgaatcaagtcataataacagtgaaacaatccagagtaaagggaaaaataaacatggttttctcaagttcaagctttcatacttatattttgcttttttcattgcaccacgagtggagggatggtgggagccacaaatagctgacttaaggactccatctgttagcaaggcttgtctcagtggcttgagagatcacatacaccctttggctgtttaagggaagaaaaaggcactgaattggattagtgattcttagccttaggggttgggaggagttagagctgggaggtggaaaaggaatccagtatccactgtgcatctcccagttctctgggctttgctggatgtttctgcgacaatctgttacagatctttgctcctcgatccaggtgcttaaatgctaacaataaaaatttgtgttgtgaggctggaactgtggaactgatggaaagtaaccctattttcctagtccattgccttatttttttttattgtaccccacttgataaataacttggcagccaatagcaacacaaagcacaacctataaagaagtatcccctttttctgtaagcttataatccttacgatgaactttctcaagaacaaggtagaatttaagtttttcctaagaatggccgtactgttgtttatgtgtgtgtgtgcatgtgtgtgtaggtaggtagggagacagataaatatagaagtaatactatatctattttattatatatacctattatatataacaatataatggtatatatcataaatatataaaaatatatattatatagatataaaatgtgtatataagaaaatgtatcttgccgaggaagagtgaataagaaaaaatttaccaagattaattatttgataactaagaaatcataaatacttgaaactactacttatatttgttcttgtttcatgcaaatgagaggatctgcttcatttgttattgggctctaattgtacttttggcttttggacttctctaaactgactatttttaccatcaaaattacattgttttgttaatagatttttctttataaaatcacaagattagaatttaacttcaagttagtataaacccaactttttaagaagaatttttattgaaaatttactcaattattactgattttgtgaaacctaatccacaattttcctacctatatttggatgaatagtgatatcccttcttctgatgatgacagcttagctactgaaactgacttgttcttttgatttacttttcttttggggctttttgttttgaaataattaggaattcacaggaagttgccaagaatagtacagagaagtcctatgtacctttcaactagttacccctactggtattaatagtatgttgtgtaattatagtacaacatcacattcaggaaattgacattgataaaatccacacactttatttggattttacacatcttgttttttttttttaattttttttggagcagagtctcattctattgtccaggctggagagtagtggcatgatctcagctcactgaaacctccacatcttgcactcaagcgatcctcccacctcagcctcctgagtagctgggattaatttttgtgctttttgccgagacagggttttgccattttgttcaggctggtcttcaactcctgggctcaagtaatttgcactcctcggcctctcaatgtgttgggattacatgtgtaagccaccatgactggcctagatttcacatgttctacacctgttctgtatacacttctccatgtaagcattgtatgtttttagttctgtgcaactttatgacatttatagatttgtataagtcaaaatatagaattattctatcacctcaagaatcactcttgctacccttttataagtccgctctgttccctctacttcccctaacatttgccattccgatgtggcagtcactagaaataaaaataacacataagatatatcattaagaataataatagtctaagctctaaagtcagactacttgattctgcaccctggctttacacttcctgccatgtgactttgaacttaatctccttaaacatcagttctcttaactataatgtgagtatattataccatgtacttcatggtgttatgataaaataattctgataattcactatgatagaaattgctatgatgtttgtccctgactagagaattacccatatcctcgaccagattataagatatagatatgaatagaatatggatattttcttataatctagtagagaatgtggataataggctattatatagcagtttatatagcagtataagagttagtggaggttgctgtggcaaaacctatgaagaaatttaacttagaatttggggaaagaatgtgaggaagtgataaaaactgatatagatgatgatacagatgatgactacatgggaggtaaagaaggtgaaatatttttcacagagggtagaggctggaattaaggaaagcataggtcctttaaaaaactgtcaattatggcctggtgcagtggctcacgcctgtaatcccagcactttgggaggccgaggcgggtcgatgacctgaggtcaggagttcgagaccagcctggccaacatggcaaaaccctgtctctactaaaaatataaaaattagctgggcgtggtggcacgtgcctgtaatcccagctactcgggaggctgaggcaggagaattgcttgaacccaggaggtggaggttgcagtgagccaagattgtgccattgcactctagcctgggcaacagagtgagactccatctcaaacaaaacgtaacaaaaacaaaaacaaaaacctgtcaattgtttgatatggctgcaactcaaagattgagagagaaggaccttttaagatatgctaactagtctaatttccaacctgagaaccacgtagcatgatcagttcagatctgcatttctgaaaaaccatcctggctgcagtgtaagttattattgaaggggatggtgacaggtatgtttctttataaatgaaacatttataaagttctaagaaggataatagtacattttcaaggaatattagtgcagatgtttgttacatgatttttgatagacacaatggaggtgatttatccattatcttcccgaaggctctgacaaagtttccataaagcttggctatattagtccatagaaaagtgacacataaactttagtagagactaatgacaatttttctttgaaaagatactctaatctcttattttcctcaatgacaacttatgaaacattttagaacttgagatccctatagttctagaggagattttttcgatgtgcaaaggaatattgagatcaatatattaccaaattctgtgcattatccattggggagacagaagaacttaacacatgaagacaaaccaaaaggaagtatgaataaataaatgtataaaatgaaaccactgagacaaatgagtcggtaaaatgaatgttgaaagacaaattccacctaacagttcatctatagtgccctacacatagttttatcacagaatttattacctactttgttcattattggttaacattcccatgtcctgtactagagaacatattactcaacaacaaagcttttattttatctgtaattacagcccctaatacagtatctcacacaataaagtactcatagaactttaatgaaggagtggagtagtgactgaatggtgtcaaagtatgtgggggtaaatatttttaactatattcaaggatgagaattttaaaagaaatacctaaaacttggcagaggtctggaaagtggttttcaaatttttggtctcagtatacctttaccctcctaaaaattgtgtttacagggcttctattaagactatattagatgtcaaatttcagattataaaacatgtattgattcatttaaaacaaacacattaatataaaaattgttggaagttgaatagtcttcatgaaattcttataaactaaccgaaggcaggaacatggtgggtggaagcacttttattgctttcaactgggcaatgatttgatgtgccagtcattttacaaatatatggtaagtatattgattcatcacttgattaatcactcacagtttcatgtactaagcttcatcttctgtgtaatctacgtgaaagcagataaccaaatttaactgttctttgtcacctaccagaagaggaaattggtatcctaagaatttctatcttcagcacaaagtttcactcaatagatgttgccattattctttttcaatcatagtgatttactgaggaaaactacaatgattaagcctgtcatcagttcttctaatacatggacaataaataagataaacatataatctagttaacctgggactgttgctgattgtgtctgttataccaggctaatactttcactctcagaatatttgggttttctaattttccatgatgtgatgattatgcattgcatgcctgtaccaaaatatctcatttaccccataaataaatgcatacacctactatctgcaaaaattaaaaataaaaaatttaaagagaatatctaggtttagatattaaactgtttggctaacccagccataatgcacaactttgtcagaagttttattaatcaatgagtctgacttcacatgccaaatgcacatctagatcatgtagtgaataaaataatagacatttcaatgaaagcttataaaatcatttaatgtcaccaaatggaaaaaaaggtgcagaattgtcaatagaatgctttagttatattatcccatttgtcccattcaagatcaaaactgactccatcaaaattcttaaaatcagagttttttgttaaaacaaaaaaatcaaaaaactatattagattttaacaatgttatttatatatcctaaaatatttctaattggagatcaatagagcctatattaaattctaaatttttcacaaaagtttacaaatttaattctgagtttgtaaaatgtattataatagctcaatgagcaactaattaaacataatatatatttctgtctggtttttcgttatgtttctattgtggttaaatacatgtaacctaaaattgaccattttatgatttttaagtataaaattgcttccatttcacatttccatggagctgtcatcaccatctatctccagaaatttgttactttactgaagttctgcttgattgtgatttttaagagtagaaaaagtatttttatacttttttgcatcaaaacgagatttaaatacattactcaaaaaataaactataattttggaactctgtgatcgaggcctagtaaataagttggtttttctttagagtgagtcttaaagattaaaaagttctttcaggtcttacataaaatgtgaaatactaagaaacaaagctgtcgggcgtggtggctcaagcctgtaatcccagcactttgggaggccgaggcgggcggatcacaaggtcaggagatcaagaccatcctggctaacacgctgaaaccctgtctctactaaaaatacaaaaaattagccgggcatggtggcgggcgcctgtagtcccagctactcggaaggctgaggcaggagaatggcgtgaacccgggaggcggagcttgcagtgagccgagatcgtgccactgcactccagcctgggcgacagagcaagactccgtctcaaaaaaaaaaaacaaaaaacaaagcttagatcagttgagggctctaagcaatgttaatctataattacttttcattaaacttaaattttaatatttttataagtgcttaaagtaaatctgcaggatacatattggttaagagacgaaaagtatttggctgcagaagcttgccacttttcagcgttaagcttgtcctcaaggctgagtataattattcccagttgtgttcattgttattttatccataatgagttccagaacctctttttaatatttttaacctcgtctttatctctaaatgtacatttaaaaatatcttaatagtatacaattaaataaaaagtaaacattcattgccagcatataatatttaattataaatattgcaaattcttatgtctttcatttgacatttcagtagtattttgctttctgagtagagttaatgatttagcaggatcttaaaactctttttttcttttcttttttttttttttctttttgctctttaactacatgaaaagtaaaatgaataaataagctatgcctaaaatagttaactgcatgcctggttttaaaggctgatggccaagcagttagtatcagcagaaatcccaggaaaggtaacaagttgcatatcaaatagtgggcatagaaaatcaaacgatggaaagctaggcccccgctcccccccggccatcagcagcacacaattttatagtggttttcattttgaaaaaaataggggactctcaaaaatcagaaagcaggttcctgagactgtgagttatcaagatataaaactgtgaaatcatcaaagagttgaaagtaaatatacaccaatagagacagaaaaataaaaactttagagaaatttaagcatctaactatacttagaattttttttctttacattttctaataaaataattcaatggatacttgtatgcctattttttttcattcaaacaatgtgaggcactatgttaggcaaaaggaatacaaataacacacataaagtctacctgcatggagtacggcgtctgtggtagaacgggcaactataatacaaagatacttattgtaagggccctgataggagtaggcacaggatactatggagcatgtaggattggaaccattgttcagtcatggccagtgatgaaagactacccaaaagcattgcatttaagttgaggtgttaaattcgagttaaccagacagagcagaaatgagaaaagcaatcagaggtaatgatgtggaaaagcctggagtcaggagatggctaaattggagtcaaaaaacaaataagcaaaaccagtgtacttgactgatgaatataaccagattgtaaattttaagttacacacaaaaatatatcaaaaaaggatattttttcatatttaaagtgaattactgtatagaaagatgccaagattattaaaacagctacaagtagtgagaacactgttttcatttcaagaataatatatctttataatacaaaaatagtaaatattaaaatatttgcttgcgatatttgggataatttttgtactgctctataatctatcacgagggctttgagcaggtgaacattactcctaatttttgcattggtaatatttttcattggtaatagaacaacatatgaatttgttcataatatttaagattgcaactgtaacatttctttattaaccttcttttagtaggcaagttatcctgaaaattagaaaagttgatgagcacacatgcgaaattgtcttcccagcactcttatatttgcccacataagtctaattgaaaagttagaacatttaccagtgagtatagaattatatggcatggttctatagcatgcctttaagcagaaatgttgaccacaatttttttgttggcactgctatccactgaccatttcctaaatagctgactgaattctctaacatcatggataaaatctgactcgttttatctggaacactttagagctacacacatttgggtggttaatatctaattgagtataagcccttacacctccccataccaaggcagccattgagcacatcttctatctgttgcctagtacttggctaagtgaaaatcctttttcatttacataactttttcattcacatgtagaattcagcaagttaataactgtatatttgcaatagcaggtgactgttcccctaattttgttgtatcatatattccaacgatttaaaataaaatttacaacacgtggctgtcttaaatgtaaacaagcttgcaatcaatttggtttaatgaaattaaagccctatagtatgactaaagagaagaaagcttttggttctttcctgaatttgtaatggaaacaactgttttggtctaaagagataatgaaaaacatgattgtgccaaaactctaggaaaagatttattcggtattagtcaacaaagtagaaaattctgattatctggggaagattatagagactgcattttaaagtggtgtggtttttcaggtactttatattgctcttgtgtgttaaggtgtggaataggatcaatcactttttcaatgaaaggaagatttaagcatagatgctgagccaacttctctgagcttttagtagaatgctaattaacagagatggtaatctaaatttcattgtattcttaaatttgggaacaggtgttatagcattgattattcaatgaaaaggcccgttccctggaaaggttatacacatgacttttgctaacttgttaattgatttttccccatggtattctgtttcacctttttattagaaaactgaaaaaaaaagtgccaagtgaacctgcatgctctttttcaaaaaattttaatggctctccaaacataaccctccaacattactgggaccctacacagtcctctcgctttaactttaaattagtgtctgtctcaattagaatgactctacattctgtaaaaatcctcgggcttctcttactcttgaaagtagcattgccttctttgttatagatagcagtacattgttcatttttttaagattcatttcaatgtaacctctgtttcatgaaggttttcctgataatccccctcatcctagtgatgtcttctgagttacaagtgtccttggtacctatttaccgcttaaaattatattagttagggtcttttcagctgtaggtgataaaacctcactaaaaataatttatgccacaaattatgtggggagttattaacccaagttagtgggaagttcaaggagtagcaataacttaagctcaactggatcccagggctcaaattatatggtcaagatactatctttgactaagttttgcttttctttgcatgaacttggctctcagccacttcatccccagtaggatggcactgatagtcaacagtcttgccaagcttacattcttaggaggtagcatccattttcccaaatatttcaacagtgtatctaagaaaattgctgattacattagcatattttgacttacataacctctccacagataaattactgtgacaaagaaaatgaagaaggccatattctcacccacaaacccagggtctcgggtctaatccaagaatgtcatatgagttgagaaaagggaggcatagttccataaaagaaatctcaactagttttaccaacaaacagtagtggagaaaaagaatgtttagcagagaaagatacaaaaaataaaaaaaaaaagataaaagctgtgcactaaggtatctgtatttatttgtactgatatatactatttgatttataaattgatattggggtgcgtagtaacctggatagctatcaaaacctttgtttctgacatacatcatttaaataactgtagttctcatttaaaaatactgtttaatgaagatgttacagaaacttgtaaattaagggtgagaagttgatattctgtcttcagttgttaactttgttgatcaaaagataaaattgtatctcaatatactaagaactaaagaaaagttaacagggaaatttgatggtaatcttctgaaccctcatttggtttatcagcatgtctcctcataggcttattctcattacaatagtttaatgaatgtattttgtactgtgtccttaggaatactgagtggtctttgaaagcagaacctatttctcggtgcccttctgtgtatgcattgcctagatcagtaccttatctatataatagttgttttaattgttgatccttttaaaagtgaaacattttcaaataaaagtacggcctgtattaaaggattattttgtttacttctgccttaagtagtctcactgttgacatttgagcagtttagaagctgtccttctaattggctagtcatttcttagctactgataatttacaagttgcatttgttttttgagctcacttcaaataatgtttgagtttctaggtaagtgttaatcctccttatcagatgaggtggtgggttttgagagtgaacataaaatttgagaaaaataacaatttttgaccatatattgccagaacaagtttttgctttagtcaatttagttgactaaagttcattttagctttcttttctcattttcaatagatagctgtaacattcttatatatttgagaaagcataacatggtgaaatccattctgagaagcaccctgccacaggcagcacggttattaagctcttggcaaatgtgactgatacatgtctgatggtgatacactgttgcatgtacacaaacttcatctttctccaaatatagctcattgcttctgcaaatacaggccatcagtcaggaagatagaatatggagatggtttaggaacccatcacccctaaagggagaatgtagaaaaacagctcaaacccttgcctgctagtgctgacaccatggtgtttgtttcacttgacgtgatcagagagcattaccagttacctgagatgctgttttgtttaccatgtggtgatttccatttcattctgcctagtatctagtccagtgttggacacatggcagaagagtaaataattgttccagaattaatgaaagattatctattggttaaagtcaccctgcaggacaggaaatagattaagtgcctttttcttttatactcatctgctattgaatttcacagtgatctattgtttgtcccaaatccatttcttgtttggcttttctactgaatgatgagaattaactttgtggaagaatgcaggtgggtgctatgagtgagcaaacaacttttgttacctctaagtcactaagcctcaaagcaattgtgtttcagagggataaaaaaacacattatttggaaagtcatgagtctaaatagaagagtaacatcaccagtaacataattctttccccgtcagtggaggttctactaatactggttatttcctagtatatctgaattatttttaaatgtatattctgtgagattcaatacagaaaaaggaaatgtcaattttcattattgtaacaactgtaccaaagggtttcttaattaatgaccaaaatacattaagatatgtacatattttatctaatcattagaagtcattttcatttctccagaaatttaacagctattaataataaatgactatggaagtacatcattaaatcttataaagaccttttttctgtacatacatcccatcacttttcttcaggtgaggtaatgaaactattgactcctttatcatattcaattaaaaagatattgattgagagagtttcatgaaagatactttttagatatttcacgatgacgtaagaagtagaaagatgagtgaaatatgatctttatgtcaagtctcatgagctcatgataagggcaagattatatatatatatatatatatatacacacacacacacacacacataaatctaatgaaatttaggattaatatgtattctcaaaacacataaaaggagatcaaagcagggaaatatgtaaaatgggagcagaaagaggccaacttcatgaaattatgagggaggccgtgaaggacacacagagatgtgttaaggggtgaatgggagaatggagagaagcgctgtagaaattgcaggaagaaggagtcatgcaagcgaagacatgcacagagggtgacattgagcccggctctatggatggggattaattcagcctgatggaaacatagattttctgtaggggactaatgagaattgacagtggaaaggttgcttggatccaaattgttcagtgcctccgacttggtaaagaggttttaagaaagttggaacatgagaaactgttttttaacatcacggaataatagaaggacactttaaagactgttttagtggaagtattcagagtatttatagattttttttgccttgttcatttagtttgatgcagctgaaatgcctcttctttacatctctgtttctccaaatcctgcctatccctcaagtccagtgcaaatgttgcccttcttcaagaagtcttctattgccccaccagactgaaggaatcactgctagagattgcagtgctggctttctgcatgtaattgcaaacatttttagtatgtcattttattttttttgtataaaatactatatatgaggataaagatctatgtaatctaaaacatgaatcgctgacattttaagggagacctagagagtactacgctgttaagaacatactgtgtatttcaaagtagttagaagagaaaacttgaaatattcacaacacagtgaaacgatactcaaggtgacagatgccccaaatactgacttgatcattatacattctatgcatacagaaatgtatgttcttttagaaagtattcctgtataattgcacaatgatcaagagggtgaagaaaatggtaaattaaagtaccatttctctgctatattatccttagtcagctcagcctcattgttcaattttccgtagtttccttttctccatgtagtttcagatgagaatctgccaagaaacattcaaggcttggaagggagaagtggagaggttagttgcagaaagattggtggatagaagcctgtcccctgagaggctcgctgttcgtgttgcaggcagcgaaaattgttggtgcccacactccatgagattgccaagatttgtcactgaccatgtgaatgactagattctagcagctatatccctcgccttactttcttagcccttccaacagtttttaaagcctctgtttctccatattgaacatttccaaactgaactacctaaagtggcttgtagcttttatttttcttaatgaaaatttgactgatacaacttctgttacaaaaactattcttaccatagttgaaggtttatctgatgagtaataccaaacatgattaatgttacgaaatggaaaaatatggtttttaatgtgagaaaaaactacaccgcattaaaatagtaaacctcagttcctgctacaagtgaaaataatttaaaaataacacttcaaggttatcatgtagactataaccccagtggggaatttagaagaaatatgtgtctcagaattaatttattatacgagtaaggagaatgagctggttacacacccactcaagtattaaaataagctcaggtggcattaattaccaagcactgccctaaaaatgtagttggaggccagaaaaagctcttatgcacttgttggtctttaatatctgggccagccaggcattgaaaggacaagatctgaaaggatataaatagagcactgacaagtcttgtgcagacaggttaaatgttttatttatctcaggattccccatatcatgcagattattcccctgttcctaggtttgttgaccattcaccaaaataaaattgtgtatcagatgggtaacttggctactagatcagggaagcacattcagctacaaattgtaggcatttcattcttatttgtgttggattactttgacttaaactgaacatgtttggtagaatgaacccctggatttaatcaggcaaaagtcttaatgtattcgttggttacacaaggtctcttgcagccttaaaaggagcaattagagtattcatttcagcatcaacttggttcaaattgcagacaaattgaagtctaatttattctataatttatcatcattatcactcacaatgtaactaggaaacttagtagtagtatttttagggtaaacatttgacccatctagaaatttcattacctatgcattgtattttctttaactgtttttaagagacaacactgcctaaaaggaaagacaactctagattgaaacaccacatctttaatgaaaacataacctcacttatttctggtacttgggaaattatgccagtgttaaagtaaagcatctgttattcctgagatcatgttgcattatttaatcaacctccaatgctttgtaaaactggtctcccagttggctgcaatgtaccgtgtattatatacaggtattaattcaaccaaaacgtgtataaaaatctgaattatgtctatctacacacacttccattggccaagaaacagaaagctaaataatgacacacacacacacacacacacacacacacacacacacacagaaagagataaataatatttatcaacattgaatataacagctcataaatcttataggtaagaaaatatttagagagctaacaaagggcacagggaaataaactggcatcaattacttctgtttgatttttttcctactttgtcagggaaatggaattgcatctaaataatggccttcccttatattttagaagcaaagttgtttacaaacctcaaacatgtaaaagctataaccagttcatttataaataatttgctgttaagataattgagatagtggcacttgcttgtgagagcattattggaaaaaatctggtagactcagcacatattcacaagtacaaattaaatactaaaacaaacaaaaagtcaacttttaaaattattaactgctcctgaaatttgccttactaaatactcacagaaaaaacaataaatatgttgggtcaatgccagaaattacaggcctactaatgaaaagaatgtaaagcttattactgttagcatagtaagaggcaaaaatggtgatgataatttaatttattttgtagccacaaaattattatataaaagattgaattaaggcattttggattgttcctttgctttagaaacttcagataagaaataactaatttaaaacaatgatatttcactaggtggtgagattttattcttgtctctatttggactagagtcccaaagtttaaaaagtaatttcctctaaattctaaaaaccattgtttgaggtctttactcttctggaacagacattttctcaggatctattaagaaatggcccaaatggtcttattatcctacagttatctatgaatatcttaacatccttgttcctagtctatacagttaaataagtattagcatattaaggggataagataaaggaatgatcaggggtacaggatttatggggaaagtatattaaaaataaaaattattagatttttctcatcatcaaaaaattaacaattgatgtacatataattttaaaaaaccttaattcttactactcgatgtttatgtaaatattctgatgacacaattatacagagcctattgctaggttccgtaaaaatataaaatgagatactcaattcatttcttagcattttgtatatataattacagtcaaataaatgttagagtggagactgatttgtattatattttaatatggtaatatttgatataaaatataaaaatacttgatataaaatatttgataaaaataatacttgatataaaatatttatgctcagattattattaaataaaaacattccaatagatatatccaaattagttttaatttaattgaagtgaattgatgatacgcatggatttacacggtgggagatataaaaacaaaacaattggtaactcccatgctagactgaaaaaaatcaagtgatttaaatgcctatcagtaggtatataattaaataaattacgataaaataattcattaaaaataaagatggatttgtactgattaaaaataataattgcaaaaatatttggttttaagacaaatttcaaaatgtactttgcttatggatgtgtgtgtgtatatacatatatatatatatatatatatgtatatacacataatatggttggaaagatcatttaaaaagttaacagtaattgcctctggagagcaattttcaggacatcagggtggcagggtttataaggagactttcctttagtctaatctctcctatgttgatttcttctaatcatgtgaacatggtttacattaattttctgaccatggattcataggtgactcaaatgattacattagctgtctttcaccaccccgcacccccatagcaactatcatgcctcaccccccgtttcacacagtccaggcacatggccacatgtgataaagaacacaaatttctcaagacaaaaatcttcctatttcttagtcacaattcaggtctgcttttaatatttaactattaattctacgtgctggagttcgcaatttacttcaacacattctctgtccggggtatacccttgggcctcagttatttgtggattagacagtagaaactttatatcaagtccttgaccaatctcttaattatttaccatgtcaaagattcttcagtgttgttgcttttattgcacccttgtggaccatttgctaaaaagcaatttgctattttggagataaattagctttattacttcctgttcatgcacattgaaaagcaccgtggactgttattttccctaactcatccctcatcctcagcatcaatgcatctattaaatctaaaggcgtttatttttcacatcataaaaaggtagagttaggttatttgtcctgactaaaaacacaaaatacttttgctaatttatcctgcagagttgctgggttttatttccatgaaattaatcatgacaaaccaacaagcaaagaatcacactgagtgcttttcagtttattgaaatacagtgttagtttattctttatgtatatggagtataagattttgagatttaatactgtactaaatttctagaaacatagaattattaaaacatttgatttttaataagagataatggatacaaatattcctcttaccttaaataactttgatgtgtttcagacccatataatgagccatttatgtacagtgtaatatcaacctgtatagtaatagcattagtaaaatacagagtgcactttcagggtacttaacaaactgcttgaattagtaaagaacgaaatcaataataatataaatgtttaattataaaaacattattgaaaataattataatgctgaaaattgtagttaaaccaaactgtttattatagactaaagtttattgtattctatttatttccttttaattcagttgtatttacttttttgtgataaatgttacattgctaagcagtagtaagtttttagtaatatcatgtcagtcatttcaaatacttttttttttactttgttaaaataaagctgactaattggtattgtcacactcattgggaaaacacacacaaagacacacacatacaaactgaggttcagagaagttaaatgatttgtataagataacagcaagtaactggaatctagtagtctccccttatcagcagttttgctttctgtggttgtagttacctgtggttacttgtggtctgaaaataggtgaatacaatacaagtaggtattttgagagacagaccacattcgtgtaacttttattacagtatcttgttataattgttctagttttattgtcagttattgttgacttcttactgtacctaacttataaattaaactttatcataggaagaacatatgtataggaagaaacatagtaatatagaaggtttggtgcatccatggtttcaggtatcccctgggggacttggaaggtataccctgcgaataagtggggatactgtatctgaaatacaaactaagatttgtctgattatacaaaccatcttaaaattgtcttacaatttagtgctaaaatgtaataatgtacaaatatgtacatgtaatctaatgtagctaaatatgttaattgaaataaaattatatactgtaaatgttcatagtaattatcattaaatttgtaataatgcaagtatctttatagcttttctcaactgaactgcaactagagttctgtgattatgcttagggtaaacatgtcatttttcccatttcacagctaaagtacaggggttggaacagtcagccaaggtgaggatgattttgaatgactccaaaggcccaggattacacagacagaaatctaagggttgtgtcttactagggagtcctctactcttgaaatccttttctttctttacttgtaccccaaattgatttttactctaatactgcaggcttgtggcctgaactcatggctttcaacttcacaaaattgaaagtagagaatatttaaaaattagtttcccacatatatttaacagtgttattaaccactgaatcagtagagtctagatctaaatggtatagatccagtaatttttaatgttcccattatgtatagagaaaagtctgagatgttgttttgcattgattggcattagattttcagatttgaaaagtttttggggtaaattattcagtttccatatattcagaagagttttgttgaaaccatccaaatgtccttaattacttaaggtatcttcttgggggggttacaaaaatagtcatctttgagttctgagacaaaatactgcaaaataatggatttattcattatctgaacggaaatgtaactgtttgcatgctaaaaagatacaccctctccctaagttagttcacaatttttaggcatgaaggactgtaaaagtatgagtcaggtcatggtgaaatggggaatcagctcccatttgaaacctccagaaataactctcctccaagtaagtggctacagaattcttaaaaagaggaaagaactttcagtttctcagtggccattttttattgcataataaacctgacaagaatagacttctattcctagaattgtcaatttgtcatatctgatgagcacaaagtgtcctatttttaaactgacgcatacaggccttgctcctgctatgcctgcattgtatagtaatggcatatttagaaatactgtacaatagaaatatttctgctaattttcagatctaaaaaggagacatttctcacatgtctaataaagagcaaggctctactgaatattagtcagaaaaatttgcccagtatcattggatattgcgatacatatttatcaagcagcttctacaagcaagatcatctaccaggtacttcatactgaaaggtgacataagacaaaataaatatttatcaagcagcttctacaagcaagatcatctaccaggtacttcatactgaaaggtggcataagacaaaacaacaacagtaaaacacccagaaaagtaaaccatttaatagagatataccctcggtgctataaagccacaaaagaaaagcccattgctttctcctgatcaggaaaagtgcagcaatattagggtttatgtttgtttgtttgtttaaggtttcacataagatgtgtagagcttttgaaatactgtgagaaaacatgggcaaagtgagctaggcaagaagcatctaaaatgcacataggcctggaaggagcatgacccacatgggagacaagaatttcaggagagagtacaggacacgtgtgccagcgggctgcagatcaggtcgaagagaaacgtgaggtccagatacagcaaaagtttaatactgcttgagaggttagcatacactttgtctcattccaaagcaataaagagtgttaagtaaggaagagatcctcgggtttgtgtttagaaaagttaggcagtaatatgcaggatgtattggaagtggacttgggagattaaaagcaagaaaatagtgttagaaagtagtttgcatggttgaagaaaaagttgtaagggctaaattcaaaacctgattaacgtctacacttcatgggtatttaaagataaatgtgtacaactttaaatgggataaaataaccagagaagaagagggaacagtgatgaaagtcaagggatgagggagatttaaggaaatacagtgttcaccagtgcacatattactaacaagtcaaattagatgaaagtggacaggctttattggatttagaaattctgaaggtgtttgattattgctggcaaaatttcgggggaaaggtagagagggaagactgactgcagtgggcacgaacggtgtctgaaggttgtttctatgaataagatatactaaaatatttacttgtattttaatcttggccctgatacttagtacttgattctgtctatttaaatggaaatatggttgaattagactatgctaatgttcctgttagtctctcttagtctaatctatacactactcctcagataagcatctgaaagcaccctccctctgtcaaacaccttacatttgtgaatgtattcctaaggattaggaactctgcccagtctcttctctgtcactccactttgtactttccacagtcagtattgggcaagaacggagatggattggaacagaagtaggcaagatgacagctctcctggtgaaaggtgacccgtgtcatcaatgtccctccacccatagcacctgtttgttccaccctattgtctagcaagagacagatatggaactctcaccggtgtaattaacgtaaggtttgctcattgcaatgaaaataggaaatagataaatagaagacaaaatatatactaatatctgtatacatttgtggggaataaagaaggaatgcttctcacaccattaatgtttattcctggacagaagtggaaatggtgtgggtttgactagaaagagaagtcttttacttttcacttgctataattgcttttctcctttttaattttcagtatttttcaaacaaaatcttcaacatgtaggttacttatgttgatatataaatgtgaaaattacagagtgttctgaatcaaaagcatgaaaatcagcaattgcaaacttgggagatcagcacaccctcatggaaatctcagtttagctattttttgcttatgcgagtcagttaaattctttgaggcccagtttctttaagatgaggaaaatgttaacaaaatttcacagttcctttaaaattagagattacatatttttaaacagcctggacagcgtagagcaggagcttagcaaatggtagatgataaaattggaaatcctagcagaagtaataaaacaaattgagcctactacatatgactgctctactccctacctttctgcttgccaattcctgagtcgaggaaggtttttgtgttctgagtagtaacctctgcagggaatttgaatcccagggatgtggtggcatttttatttttacaaatatatttatcagctatgtgtataggtgtgaaaacaaagaggagagggagaaatgtcctttaaatgacagcatccctagggaaaatgacaagctcatggtaggtaaataaattatgtttatgtatttgtatgttcatgtcagttttgttactattttcaagctggcatttgggggttcacagctttcagtttattacagtcactttatttataaaagtataaaacccaggaaaaaatttcccaagtggtgcactaaaccagtactctgaagcaagaaaaagcttttgtctgctttctttgactatttgcaatggaaaatgaatttgaaaaaagaattagaagcctttttacatggataaaatttaattaaaatttatttttagtctcttgaatatgcttcattcttaaaaaaggactgaagtagaaaactatataactaggaaagcatttttttttaatgttctgtaaattcctgacctaggaaaatagatacccatatgcatataccaatggacacttcataaatcatctaagaacaaaaaagaatgggaattctacttttatctttaactatttttacattttcagtactatagttatatgggggagattgggtggcctagccaaataattacccaatgaaagtgaaaaagcatcttccctaatatatgccaagatatttagacatagtttgacatgagcatagaggaaagttgttaatcaaatgagttctttttttttttctttttttttgttgttgttgtttgcaatttgctcttcagatccactttccacccttttctgttctggcctatcagtgttctaggaggctgggtctttgtcctgtaccaatgacctttcttttccttttcctccaggttttatttgggttgatgctatcagtgacaggagtagaagattgaagggcaaaagaaatgtaggattagaatattagttccctggtgtcctccagaccaagtcactgttagttgcctgtgttcttctactaaaggccaaaacttgatcaggcaactcttcatgtagctgtattttccagcatagtaacctgttaggttaaaaagtaaatgactcagctgggcgcggtggctcatacctgtaatctcagcactttgggaggccaaggtggggggatggacgagatcaggagatcaggacgatcctggccaacatggtgaaacccgtctctactaaaaatacaaaaattagctgggcatggcggcacatgcctgtaatcccagctattggggaggctgaggcaggagaatcacttgagcccaggaggcagaggttgcagtgagcgaagatcatgccactgcactccagcctggtgacagagctaactttgtctcaaaaaaaaaaaaaaaaaaaaaaaaaaaaaaagtaaatgactctgtattgcagaataggcactgtcactttgatggtttcctatattctagtatctctttggcaaagtgtcctattatttaatgataataatcattaaaatgtaattgttttctaccttaccctgtccaaattctgagacagtttatagtagcaaaattttagaaacaacttaaaccattagctatgagtaaagtatgctaagcctcataaataatatatagccatatagaataccttatagcatataaatgaataaagtagatgtacacagatcaacatggatgaatcacaatgtcatgatatcaaaggaaaaaaattagcgttgtatatagcataatacttgtataaattgaataaacataagcaaacacatcacatggcaatcatgtacatgtatacatagagggtgaattgggagaactcacatccagctcatcttggagaatttcaggtggttgatgaagactgtgccaattactaaaaaataaagttacatataggggttactgaaaaataattttaaaaatcagtatttttttaagtagtaggaaatgggcatttctcatattctttttagtttgtttttaaacttctcacgttttttgagtatattcacataatgtcaaaaatagaaaaggtgctcaaaaatatataactatttattttactttaaaattaactattatatcagtcttgcctttacatttcctatttgtctctacttattacttatatataatattatctacatattattttatacatattcaaaagactccattttatattcatagctctggttttaatcctcctgtgtctctgagccagcctttcagcatttcctctctttagcctagccttcatgttaagtgttaagagggctcttgtaggttgtttttatttttggtttatagtcatgcatctcataatgatgtttcagtcaatggtggaccacatatgtaacagtggtcccttaagattattgtatttgtttttacactgctgataaagacatacctgaaactgagaaacaaacaaaggtttaattggacttacagttccacgtaccttgtgaggcctcagaatcttggcgggaggtgaaaggttctttgtacatggtggtggcaagagaaaatgaggaagcaaaagcagaaatccctaataaacccactgaatctcatgagacttactatcatgagactagcacgggaaagaccagcccccatgattcatttgacctcccactgggtcccttccacaacatgtgggaattctgggagataaaattcaagttgagatttgaatggggacacagccaaaccatatcattctgccctgacccctccaaacctcatgtccttgcgtttcaaaaccagtcatgccttctcaacagtcccccaaactctcgactcatttgggcattaacccaaaagtccaaagtccaaagtctcatctgagtcaagtctcatcttaactcttctgcctatgagcctgtaaaatcaaaagcaaactagttacttcctagatacaatggtggtacaggcaattgggtaaatataaccattcccaacgggagaaatcggctaaaacaaaggggttttcagggtccatgcaagtccaaaatccagcagggcagtccaattttaaagctccaaaatgatctcctttgactccatatctcatacccaggttacactgatgtaagagatgggttcccatgatcttggccctgtggctttccagggtacagcctccctcccagctgctttcacgggctgcgtttgagtgtctgtggcttttccaggtgcatggtgcaagccatcagtggatctactgttctggggtctggaagatggtggccctcttctcacaactctactaggcagtgccccagtagggactttgtgaaggggctccaaccccacatttccatctgtactgccctagaagagattctcgtgaggtccctgtccctgcagcaaacttttgcctgtgcatccaagagtttccatatatcttctgaaatctaggcaaaggttcccaaacctcaattcttgacttctgtgtaccttcaggctcaagaccacgtggacactgccaaggcttggggcttccaccctctgaagccacagcctgagctgtacattggccttttcagccacacctggagtggctgggacacagagcaccaagtcccttggctgcacacaacacagagaccctgggcctggcccatgaaaccactttttcctcctgggcctctgggcctgtggtgtgaggaatggccgtgaagctctctgacatggcctggagatattttccccatagtcttgaggatgaacattaggctgcttggtacttatgcaaatttttgcagccagcttaaatttcttcccagaaaatgggtttttattttctattgcatagtcaggctgcaaattttccaaacttgtatgctctgcttcccttataaaacaatgtatttaacagcacccaagtcacctttatgtttttttttttttttttttttttgagacggagttttatcttgcttcccaggctggagtgcaatggtgcaatctcggctcactgaggcctctgcctcctgggttcaagcgattcccctgcctcagcctcccaagtagctgagattacaggcatgagccactacgcccagctaattttttgtatttagtggagatgaggtttcaccatgttggtcaggctggtctgaaacaccagacctcaggtgatccacccacctcagcctcccaaagtgctgggattaccggtgtgagccaccacgtcagtcccaagtcagcttttgaatgctttgttgcttagaaatttcttctgccagataccctaaatcatctctctcaagttcaaagttccacaaatctctagggcagggacaaaatgccgccagtctctttgctaaaatgttaccaagattcacctctgcttcagctcccaggaagtttctcatctccatctgagaccacctcagcctcgattttattgttcatattactatcagcattttggacaaagccactcaacaagtctctaagaagttccaaactctcccacattttcctgtcttctgagccctccaaactgttcccagttctgcctgtcacccatttccaaaattgcttccatgtttttgggtatcttttcagcaaggcccctctctactggtaccgatacactgtattagtttgttttcaccctgctgataaattcatatacaaaactgggaaacaaaaatttaattggacttatagttccatatgcctggcaaggcctctgaattatggtgggaggcaaaagagaaaatgaggaagaagcaaaagcggaaacccctgataaacccatcagatctcatgtgacttattcactaccatgagaatagcaagggaaagaccagcccccatgattcaattacctcctgctgggtcccttcctcaacgcttgggaattctgggagataaaattccaattgagatttgaatggggacacagccaaatcatgtcaattataatactatatttttagtgtacttttctatgttttaattaccattgtgttataattgcctacagtattctacacagtaatgcacatgctgtccaggtctttagcctagaagcaataggctataccatacctatagtctaagtatgtagtaagctgtactacctaggtttgtgtaagtatactctgatatttgcacaataaaattgcctgacagcacatttctcagaatgtatcccccttgttaagcaatgcatgaatgtatttttaagatgcagtgtcagctatttctgtaaaaacacaactcttgttctcaaagatttggtctctttttcatacctaccttgatgttcctgtaattgtttgcctagtcagactaacatctcactgatgaccatcagttgatgcttaaacatacttttgtaacttaattattggaggagacatgaaatgtaatgagttaagatttgaagtaagtacacttaaggaggttaaaaattgggagggggcaaagttgggagaaacagatggctgtgaagagcttgatcggataatctttttccaacaaattgagatttaaactatcaggtgtagccattacacttgaaataatccagctattgggatttcttaaaaggagatgcagacaaagtctgcacactgaattatcagaagaaatactgagtggaacaaaagggccaagaactacctgaacagtgaggatcaactttgataataataatgaaacaataggaaaagcaacctggaaaagtttataatacctcaattctagttactaaactgtgaattggttccaatcctcctcccggcctggttctcaaagggaacaggtagaagttctcacctctgtatgggactgaagacagagggatttaaaggaggagacgtaggagggcatgtcctggaagttcacgggtggagaaatggcaagccaccccatcttaggaagtagaaatgtgtagtgaaccggaaattcctacatcattatctggaatctggcctatgaaagagatgtcggctaatggggatttctggagtcagtgccattattgtcaaagtcccagccatcacaggatccatagtattccattaatatttaagcaggagaggtggaaccaaacctcaacttaaacctgggcagatctgatctcatggtcagcttagcttccctccctttgcctatctcccaacttttccaaccctgctcaatcctgctattaaatacataatagcaacaatagctaacattatttgtttgccataacttccagtatttgagagcgttacttcttcctcatcccacctctttggttcagttgagggttgccaggactgtaccctagctcccctaaaagcagggaagcatgtgacctcctccctttggatatgataattgggccaaagattgagatgaaacccacattagatcttcaagcatccttttctgggatttttctaagtgtagctgatagggaagatttcattctacttaagagaatgaaagagtgccagtcttgagtagcctctggtcatgttccctgctgtgctgaaaaattccatttgatgtgttatgtaataggagaaaatggcatgaatacagaaaaacaagattcagagagaaattgagagtcctgagaatatccaggtttcttgtttgattgtcactgattctacagtggtattctgtcatttggttttatgaagtaaaaaacctccctgtttttgaaatttttaattcttaatatctttcaagttggatctctgtcatttgtaatagaaattttcttataaacactccatatgtgcgaaatgctgaattaagctttttttattgatctttttcattgtttactttgtattttgtcattagttgacacatagtaattgtacatatttacagggtacagtgtgatgttttgatacatttatacatcgtgtaatgaacaattcaggtaattagcatatctgtcacctcaaatacttggcatttcttttggtaagaactttcaaagtctgctagctattttgaaatatgctttatttttaactgtagtcacgctactgtacagaacaccaaaacttattcctcctgtctaactataactttgtacacattgaccaacctttctccatcctcttctcccctctaccctctcagcctctggtaaccactgctctactctgcctctgtgagatcaactttctagattccacttatgaatgacagtatgaggtattagccctgtgcttgacttatttcacttaccataatgtcctctaggttcatccatgttgttgcaaatgacaggttttattctttttcatggctaaatcgtattccattgtgtatgtataccatgttttttcacccatttacctgattgatatatatttaggtctattctgtatcaacctattggctattgtgaatagtacagcaataacacaggaatacagatatctctgtggaacactgattttatttcctttggatatataaggttttaaaaatggattatctcatacaaaacttagaaatactcctatgggagtattttatgcaaccaaaacaaggatgtgcaaaatctcaataatggggaactagaaaagtcttgaatatgtgtgtgtaggtgttggtatgtctctgtaaaaatgtaggtgtatacgaatatttgattctttatataatacacatgcacagaggtaatctgaatatagatacataatgaggcaataccttgtgattaagagaatggatatgtagctgtattacctcagacattatacattctgtttcgagcatttgtaattccagcaatgtattattctggaaactcttctactacttggtatttcaatttttatatctataaataaggatgataactatacttatctcataggtttgttgagtattatatgagtgaatgtacatatattatttagaacaataaattgcaatgcataaaacaaggaatagagattgccaagacatattaatgttgttaatattaacaataattataataatagctaccactggctgggctcttactgttattccacatatattctaagcacagctggtatactttctgactgtgagccacacaaaccctacatagatgggaaccctatggtccttctaatggaatggaattgagtttctccagtaacatatatttagaaaaaaatgaaataatgtttcctatgtttaaattcttatatttcaaaataattttaattaaaaatgtaaaagaactatattaactttttgaaacaatatatgtggctttaacaaatttcagtaatttaaaaatataaacaattttttcagtatgccagaaatacatgtcccatgcaaagcccatattctatatgcacacatgataattttacccttaaaatattttgaattaaatatgtaagaatttctatatacaaaaacataaagcttcacatataaagctacttacaccttcatgtgttagcctctaaacatatgcccatatgcccactgaacttgtaaatatcatttccaaaaaagactgtctctagcgtagaaagaggaaatttgacccatgtcttggagaggagtcaaatcagaaactcctcctattacgtctttttcctttgctcgttttgctttgagttccagttgagcactttgaacacatatgtgaagaaggaaaactgctacctcacaattggcaaggtcttagtttcttttttaatgttgcctttggattgtactgtccttgaaatgtggaagaattgaggaagcaaacagtagaaccatatttagctctatatcacttcataactaataatttagaaatgaatctcaagtcaaataattaattcttcctatctataggatttcaaatgggcaaaacgatgttctcaccattagaattctgacgtttaaaattttttcacagattcccatcaatattgtaaaaaaatccttaaaaatatgttgtaaatataagcgcaagaaatcagtcaaaattggccatttaaaacatgttttgcttgttggtcaattcaactaaatttattttggcaaattatattaaatatttactaattaagcaactgagcaaagcactacaagttattgatatatttgaacatttagcctagtagatttttgttctaatatgttgtttttattctgatactcaaagaataaacactaaaggaactatacaacaggattccttttaaaagacattttcttttaacaataaatacagctttagattcttatatgtaaaattgcacttcgtattttaaataccttccagaaactgtttccaaactttaacattaagaaacaaacaaaaagatatgaaaaaaaaaattttgaggtcaggcgtggtggcttatgcctgtaatcccagcactttgggaggctgaggcaggtgaatcacaaggtcaggagttgagaccagcctggccaatatggtgaaactccgtctctactttaaaaaaaaaagccaggcgtgatgctgggttcctgtagtcccagctgctcgggaggctgaagctggagaattgcttgaaccagggaggcagaggttagagtgagccaagattgcaccactgcactccagcctgggcaacagagcgaggctccatctcaacaaaaaaaaaaaaaaaaaaaaaaaaagattgagaaaaagcctatgaatttctgagacttaaactactctgaggatgtatatgtttgtcaataaaataattgcctaatgtatatacccagtacccagtaatgggattgctgggtcagatggtattcctgattctagatccttgaggaatcgccacactgtcttccacagtagttgaactaatcattctactataaagacatatgtacacgtatgtttattggagcactgttcacagtaacaaacacttggaaccaacccaaatgtccattaatgatagactggattaagaaaatgtggtaatatacaccatggaatactatgcagccataaaaaaggatgagttcatgtcctttgcagtgacatggatgaagctggaaaccatcattctcaggaaactaacacaggaacagaaaaccaaacaccacatgatctcactcataagtggtagttgaacaatgagaacacatcgccacagggaggggaacattgcacacttgggcctgtcggggtggggggctaggggagcgagagcattaggagaaatacctaatgtaaatgacgggttgataggtgcagcaaaccaccatgatacgtgtatagctatgtaacaaacctgcaagttttgcacatgtatcccataacttaaagtataacttaaaaaataattgcctaatatgtaatgtattccttgattggattcctgacacaataagggttaagcaatagcagagcaaaagtttactgaacaagtccaagtcactagtgcagttaatttgtttttgtggagtccatctctcagcattgatttttgatctgggcatactttgccaggagctggagttatttgcagtcgaaaacattggctctgttttgtttattttgtcgggcagctcatgtctatgtacaatcactgcctggaataaaaaatggaaaagcctgttacaagtgaagaagctggatagcaaactacataagtaccttctttctatctggaaggattacatctaccctaatatacatatgcattcaacttgttttcccttttttgctataagtcaaatatgagaaatttattctatctgcattgacactttgcttgtgtcttcagctagagaagcaaatgtttttaaggccatgcttttttctacaatctatcagaatattcaatgtaagggccaaccaaaaggtaagatggaaaaactcaaggcagtattttccacatctctgtcagaatatacaatcaatccactcacacacgtttggctgactggtcaatatgactatttagaacataaagttggcatgcacttatgtccttagaaggtgtgtcttccctaatattttgagagctctttaaggaaaaagagtgcattttatttactaatgtaattcctattaagtatattgcccattagtatatctcactgaaattgacaatatgtgtaaatgacaatatgtgataaaagactgaacaaaaatttaaaaagaacttgaagcacttcatcaatgtcaattcttaaaaaaaaaaaaaaaaaaggaaaaaaaccctagacttgctattcagatcatttgcccatattacaagtagatgattggcttttttgctactgagatgtttgtgttccttacatattctgggtattaattccctgtcagatgaatagtttgcccatattttttcccattctgtagttgtctttttactcttgtttcctttgccatgtacaagcttattagtttacattaaccccatttgtttgtttctgcttttattgtctgtgcttttgaggtcttagtcatcacatctttttcacagatcagtttcctgaagcatttcccctatgttttcttctagtagttttatagtttcaagtcttacattgaggtcttcaatccattttgagcttcagtctatttagtgcttcaatacatttggtaaagggtgtagtttcactcttcttcatttggatatccaattttccccgaactgttttttaaagagactgtactttcccccgtgaaagttcttggcacctttgtcaaaaatcagttggctacaaacgtggatttatttctggcttctcttttctgttccattggtctatgtgtttgtttttatgccagtagtatgctgttttgtttactataatcttgtagtatattttgaaatctagtagtctcatactttcagtcttgttctttttgctcagtattatttttcactattaatgatcttttgtggttccatacaaacgttaatttttttctatttttgtatagaatatcatttgtattttgatagaaattgcattgaatttgtagattgctttgcatagtatgaacattttagcaatattaattcttccagttcatgaatatgagatttctcttcatttttttgtgtgtcttctttgatttctttcatcagtttgttatactattttttttttggagggaccttttacctccatcattaaatttattccaaggcattttattttttttttgtatctatactaatggggttacttattcagctactttgttatttgtgtatagaaacactgttgattcttgtatgttgattttgtatttgcaacttgatcaaatgtatttatcagttcccaaaggtttttcttagggtttttaggtttttctatatataagatcacatggtctacacagataatttaacttcctctttccctatttggatgttccttcttgctttctggtttcctcattcagtatgatgttacctgtgggtttaccacagatagcctttattgtgttgaggtactttccttctttgcctaacttgtcgagtgattttatcatgaaagaatattgaattttagtaaatgctgtttctgcatctattgaaattattacgtggtttttggcttttattctgttgatggtgatgtatcatgtttattgatttgcatatcatgaactagccttgcattcctgggataaataaatcccacttgatcatggttttggccaataaatttgtaaaaaatgttcagcattactaatgatcaggtaaatgcaaatgaaaaccacaataagctgtcatctcacccaagttacaatgactattatcaaaaaggcaatacataacaaatgctgggaaagatgtggagaaaagggaactcttgtatgctgttggtaggaatgtaaaccagtgcagtcactatggagaacagtatggaggttccttaaagaactaaaaatagcactaccatatgattcattaatcctactactggatatttatccaaaagaagtaagtatgtcaaagagatattctcaccctacgtttattgcagcactattcacaatagccaaaatatggaatcaacccaaatgtccaagaggaaacgaataaagagaatgtggtatatatttacaatggaatactatgtggctattaaaaagaataaaaccccatcatttctggtaacatgaatgagctagaggatattatgctaagtaaaataagtcaggaagaggaaattaaacactgcatgtcccactcatatgcagaaaaagttaaattcacagaagtaaagactggaaccgagaattctagaagttgagaatggtaggaagaagcagggagggggatagggagaaatttgttaaaggatacacaactacagctagattggaggaataagttatagtattctataacactatggcataactatagtcaagaaaataccaaatattttcaataagagaagatattgaaagttcccaataaacaaaaaatgataaatatttgagaatcttgatatgctagttgtgctaattactatacattttatgtatcaaaacatcactgtatgccccataaatagaaacaattattgtgaatttaaaaataaataatattgaaaaatagtcttgctaattacaaattatttcgcatgtttatatagaagtatctcccaaattacttctattaatttaaacttagtaaaatactctggatttatttattcaaccatttagttttatcctgatcaaaatgagtcagaatcccactgaaattctgaaacaagagaaacatcaataaggtagaattgtcattaggagaaaattcagaatttattggctatcataaagatgaaaatgtcaatgttgcaactttattttccctggaataaatctcaggtattttactgacacaaatgggcacagaagtctttgaataatgagcagatactgaaagaaaatattttttggtgacctgcagaacttccaaaaccacagtatgtgttgtaaagttactttgggttgaatatgaagacctacaatatagtaagatatttattgcttaaaagataaaaaatgaagaaagcaaaattatctggagagaaatttcatttgtttaagaagggggctcactgaagaaggaaatttttagtgaaacattaagtttttttcctacagagcaaatagttttttgaagaaaacagtctggagacttgattcatttggctctgtttactcaaggttatctgaagtattgccaatactttatgttggttacttgattacaaaaattgtttgtattttcaacctttttataaatgagtctttacagcaaacctataccacttctcattcccacaggaatgattcttggaatacctatatgtatgtcaggatcctctctcacatcaataagagttgtaatctacctgaaatgtgttatttttccatgcatttggagcatgcaaaagacataaaaagagtatttttttctgaactgttgagctatatgccaatctaaaaaatgaaagctacttctgtaataaattttttggtatggaacattattactcaagttgaatcttaatattacagagtcacaagagaattgtaaaaactgtgatctcaatgaattaatttatagtgagaaatataactatcaagtaggctactcatgttcggagtcagtgttttctttcctcatcagcaaatctaatggggagtcagatattattcagaaagtgttttggtaggcatgaactctaagcaagtggagttagttcattcacctgaacagatgattataaagctatgataacataaataacgcatcagtctctattatactaatcatctctgctacatgagtaagacccaggcttttgtgggataggctactctcagccagatagcaccataagaacattactgattttttttaaaacatagatgttacataaactactttcatttttgttctttccttagacaaaaagcaaggcaacttcctgtgataaaagttttcttagttaaaaggaacaacattcagttgctcttctctaatactcatctctctttagctgaattttggaagtacactggcaatctcttgtgtgatccttctactacaaatgaaataatactcagtagtagttcaacattccaattatgactttttcattgtaattatttttaaactgatatctgaaattgtacacatttatggggtacatggtgatgctttgatacataagctaaatgccctaattattatatattgtatctgtaatctcaaatatttagcaatttgggcaattaggcccaaaacacagttcaataatgttcttatctatgtctttccacttaaggatttaaagaaaccaagtttctaccttcagaaaagatgttaaatgagaagaataagagaaattgtctcatcgtttctaatttattctcaatatatgctccaacttagaagttatttgttatttaacatgcacaatcaagatgggactctgtcctttttagaaaaggaaagttgcttagcataaaatgcaagatacaggtgaataatttgaggacatatatcacagctcatgtagcctgaaatttgaaaaagggaaacagttatgttaaaacagaaatcccacaaacaatcatcaaaaatttagtaaaattgataacatagtatcttagatcattctattaaatgtttattgcatgtggcaattggagagtgcagaaaggggaaagaagttaaaatataagcagatgagaaaaggttaaaaaaaaattctaaaggaacaatatcttccctaaaagcaattcatcctagaaaatgatagaaattctaatctgtgggtaggcaatttgatccaaagcacatttaaatgtaatatcattgaacaagctctcttcatgcccctagtaagaatcgaagtgacagatataaagtgttttagctattagactttcatgaatcatactccaaattgtaaaatattttgttttatttttatcaaatctgtgtttcatctaggagaacagactggtttaaaaaacccatctagttaaaataaaatgaagtgttatataaattaaaatcaagtcacttccctaatatgcttttatcagcacttactttttaaccctatcaacggcctcaggattatatgtaaactttctttaacatgaaaatcaactataaaattaaaaatcctcatctcaagatatccttttgttttttacttacccatatgactgagacaataactgaataagaattacagaaaatggataagatttcatataaagatttgaaaaaaaagttctgcgttagaaaggaatgaaatttactgactacattagttttctactgctgcataacacgttgccacaaacttggcagcacaaacaccacaaatgcattatctcaaagtttctgtggttcagaatctccagcgtggattaaggatctcctctgttgagcatctcacaagactaaaatcaagatgttgtctggggctgcagtcttatctctcatctgaaggtcttccaaggtgatttaggttgttggaagaattcagtttactgaggttaagactgaagtcttcattgtcttgctacctgtcagccagagtgactttcacctcctagaagctgtcctcaggccttagtcatatagccccctctcacaacatgactgcttacttcttcagtgccagcagggcaatctatcttcagttggttataatagcatcttacataacataaaataatgacaccatcatctatactatctataccatcatctttgtcatataaagtaacctaatcaagagagtgactgttctatatgattcagaggttctcccaacatttaaaaggaacgctttataagagctgtgtccaccggaaagcggtattacgaagtacatctcacgatcctgtcaaccagagtgatttatttgaatcttacaaggctgtagtcactatcccaattataaattttgaaagctctgaaaatcaaaaccttgtctaacttatttggtgaaaaattttgatcagaacttacacataatttatataacttagtccattttgtacaactatttaagtttgcagtcgaaatactaacatgcttcagaatgaagtacattatgtatacactattatataatcattattttgtgtgttattaaacaactcactgaaggtgttcagtaatatactgaatatgtgcagcaaagtagtacctttctaaagtctaaacaatctctaaccctgaaacacatctgcccccaagggtttcagataagaaattttgggccaaatttattaaagttctttaaaaaggagttcattgagaaagggtttatttcaagaatatataaaccttggggtaagctcaacatttgctgatttaaatgaccttcaaaaggataaggatgaggaaagacaaagaaaaaacaattgtttatacatcaaatctgaattcactggtttcaattttattggtgacaactttgaaaaatagggcaataatgacagggagatccatattaaatacaaggtaagggaaaatatttattttactaatttgttcaagttactaaatgagtgaactcatagacagattggatttgtactactaaactgtagtacaaagaattgtctctttcattttcccaaaatgcatggtacatttagggcaagacatttttttataagcttgtttatctcatctttttccccataagcacagtatctggctcttggggcaaaacctgtttcacttaacagccaatttatccatccagatttgagtcaactaataaaaattttacatgttcatagctcccccgtctcagatttcaaccttaaatcagtaagtagttctatttattgaagaattaccatatttaaagaaagtgtgtatcttggtgacaatagctaggaaaacggaagtcctcaatccgtgtctatcaatactaaatgtaaaatgtgaggggggaaaatgcttataggcaagaaagaaatgtaaattggtctgtcaccaaagtccctctcctttgaaatgtcttataatttacatgtaatatatgtgaatttacaagcagcactataacttgcactttgaaagcaatgcttgagttaattaaatgagctcctaggagagcatggatttctcatcagatctttgctatagtcaggtttgagaatttaattgaggatattcgcttcttcataatgaacagagtaattttatagaattttttttaatgatttctacaatggattgttaggcagcttctaaactgtaagttaaaatgatatatccctctttgtctaaatactgccaaagcagtcagtcaaggcagttcaactgctgttatttctattaaaaaaaaaatccatcaagttgtttaagtacaaaacaaaatcaaaaaagccgttaatgaatatttttacccttcagtgatgataaatattttattagaatgcaaacaagcagtgaaagcacaaaaggaaatttatcagaactgagtctttgcttgaattttgagtgattactaggtatgttttcaaacagcactgcctgaacatagcttttaagtttttcaaattaaaatagcagatgtccacagtagctgtgtgtattagaattgtttaatttatggagctaaaatatatggtaggccaaatctaaacagtgttagaattttgagattggtagcctcctcttcctatggaaggagcttgctaaggggtgtatcagcttcttaaataggccattggcattcttagaggtttagcgtggatgggattaggcaaaggtggagttcaatttggaggttctgataatgcaaaagaggcaagagaggatggctgtggaacagggggtagtatgggaccaatggatatgaaatggtccttcagaaatcacattaaaaatgatgtaggtttcaatcaaatcagattttctgatctacatctactggtgaagttactgagttgggtgagaaagaatgaagacctgagttgttgttaaattaaattgcttattatgtaagcaattgcctgcctaaaatgatgtcccttaagtgcttaaaaggtctgaacattaattgcattttctataatgctcgtttagactaaaacaaattaaatcaattaaacaaatcttagaagatgtattgtgtaaaaatcccaagtcttttttagtagaccttaaataaaagttttgtaaacataatagatttgttgcctgatgtacacagcaagtcagtgtgttgagaaactaggttgcagcagaaaaaaaggtttaatcttagtgtccctgaatgaggagatgggaggacacatcaactctatctcaacttatatgggtttagagtttataagggttttggaatgggctgcagtgtgaagatctctgattggtggaagagtgctgcgtgaagtcatgggccagggagatgaagaagctgtattctcatgcagatcccattcctctgtgggggtcttcaaactggtaggtagaatttggggtcttcaaaaaatcttaagtggtccttaagtaaaatccttgtgattctaatgtcagaggtcctgtctgaagggacaatgagtatcaaatcaattattaaacagtcttacaagcctaatgtcagaaatcctatctataggaacaatgtggatgtgaacagtatctagtgctacaagactctcggcaagaagaagtggtccaaagtacagcctgactaatactaagttatgattatatttctgtccagaacttggcaaacgattcttgtcaactgcatgaggacaattccagttctatagcttaaaagttagatatgcagactgggagacttcttcagaaaaatctcttgcatgcttccttcaggctagttgtctgtcccctcaaggtcctaggtccatagtcttttcataaaggtcagaatctctttggaagcaaacagttgcagtgtcagtaaattactcccttgaactgatcttggggactgtgggattaatttggctttgaacacggaatactgaaaatagaagcatcagtctttatttatccagtttctgtataataaattccattgctgctttatccattttatatacatacatacacctatacacacacatagatgtatatacgcacacacatatcacacacatacacacataggtaatgaggtagtagtagaataaagaggtaggatgtaaagacaggaataaatttatccatgactccaaataaatgtgtgaacttttaatattccatttagctattcagaggctccacaataatacacgcataaaatacaaatatatacacacacgtgtatatacacacatatatatacacatatatgcatgtgtgtatatatatgtgtttctgtattgtagcacctctgaatacaggtatgtgtgtatgtgtgtatataggtataagtgtgtgtacatatgtgtaagtgtgtgtgttattgtggagcctctgaagagctaaatggagtattaaaagcccacaaatttatttgcagtcatagataaattaattcctgtctttacatcctacctctttaacctcttcatttaaaaatgaattgtaaggtatgaaaaagagatagattaaaacaagtgtgtcctaataagcttttggcatattaatttgcattttattgctactctttctccctccaccttcttaatttcaaagagatagctagacctttcatattttttttccctcaggaaattttccagatcacaaagtagaaactgttggaaaacaaagctttctcctgtccaaaaacttaagttcatagaaatgatgatgcaaagcgccaggcgtaagaggaaagaaagctaaatgcctgccctttaaggcaacacttgagaagggcaaaatttctggaaaatggaagaaagatagtttagtaagtttctagactgtcctggacccatgcactagttaatggaccttaagagtgggctgataaaatcttagaggtgacagttgtgcaaggtacccaggaagctggcacatttgcccagagatgccagtctcagcaaagatgcctgcactccactagagacatggaagactggaagccaagagcaacaaggctgcaaaacaccaggaaaacaggagatcagcaaatgaccacagtggactggatagcaaaggcccttcctttcattatcaggcagcttataagcctctctgactctgttcagggcctccaaaatacccaccagaacgtatttctttagaaaattgtctgtagaaaacccctgtagaagtacaggagttcagtatctaatttaacccagacattttgaaaaaaaaaaatgtgtttcttgcatagttaagtttgtggaccaaaaagtatgttgcctggaaaaaatgtcaaagttcaaaagagaagagttccctctgtcccagtgcccaacaaaaaataagaaaaaaaaaaaagagaaaaaaaataaatctaagtacagatagcttaatgaaaaaatcgcaaacctccaacaaaatctatacagaaagcctcactgaactgttgtaaattacaaaaaacattcctaaccatctacttagcaccttactggagctcggcatgttaaagggaaagtctttccagaagtgtttgaaaaacatcaacatcacaaaaagcacataatggatatatagaatagtacaacaaatgtataaaataaatatacctgcatctattttgggaatttgggggtttgggggtttccatatccaattccatatggtctaaggaccggaagtacacattgggcagggctgcctaatactcttgaaacagtctccatggtatccttgattgctgtacacggtgacacaaattccttgtatatcactgtaacctgcaaaagggattcactcaactgattattactacccagtaatgacaatttatttaaaaaaatattttaaacatttttgtgtgtttcataggaaggtttcgcttttgtttgtttttttaaaaacctgagtcttttaaaaagagacctgagtagtttttaggtacttgacaagttgcatagtcctgctgtcaattatgacgtattataatgaatggtaacacaaatgaaacatctgtttgatcattcagtgactacatctgttatgtcacatttgacacattgagcaggagaacataaaaaattcaaggaaaatttgtaaatgtgagtgctagatcattgattttgaaggatgagatgtgttaagattactagacccattcagaatttattataaaagcactaaccctgtaaattggccttctttcaccactgaggcccactctaatggatactatgtttgtaaatgcaattatatgcttttaaaacaaagtttaaatataagttcttaaaatttatattttattaatttaaatatttatgaatctttaagttgtatcaaacacctttttaggtgctaggatgtagctgtgaacaaaacacctcttgtggagtttacattctaaaacaagagtgtgcaaacacaaaagcaaaacaaaaaaaaattactcaggttgcaacaagtaatctgaaaagcagagcaaggtaagtggataacagctagtgtgccaatttatgcagggtgtttagagtatatgattctgttcattatctactgcaaaacttttaaataattgataatacaaaatgaaatcaaatcccctctaattcagaacaagtgaatagagtcagagctaaaagtctgatttgaaaggagaaatgcttcgtgtaggctgtctggagaatataaaattagaactaaaattttatattccagttttttcttaatatctcaggcaatgtctgataatttcagcaagctctccaatctacagagtatatagtaaatatttactcttgcatcacatttaacaattaggaatttagacagttagcttatttactgcttccgaaaataaatgtaaccagtgggcctagcgcagaggctcatgcctgtaatcccagcactttgggaggctgagacaggtggatcacctgaggtcaggggtttgagaacagcctgacaaacatagtgaaattctgtctctactaaaaaaaaaatatatatatatatataaaattagccaggcgcggtggcacatgcctgtaatcccagctactagggaggctgaggcaggagaattgcttgaacccaggaggtggaggatgcagtgggccaagatggcaccattgcactccagactgggcaacaggagtgaaactctgtctcaaaaaaaaaaaaaaaaagaaaaagaaaaatataatgagtgccattgccctgtctagaaccctcttcctttaggatcaatctcctacacaacatttacagggctgcagcacaaacatcattttatattgtgcctccaacccctgccacagttgatttacttggagatgggcacctcacccaagctggtcaaagacacttactcatgggctttggagggttgggaatgaaagatacatgatcatttactctttaaaataaaagttgtaaataccaagctggcagcagccatatcctgttaggtgaggacctctgagaagcagagaaagtcagactttctgaatgagtaataaaagaaaaagggaaaaaaattatgaaaggaagagaatcataagatgtggagagatccaatggcatttgtattccaggctctagttgttcctgagagcaggttttctatctttggataccataagatatataagtaaacataacaaattttatgtttaagctagtttgttttaggttttggtaactgtaaaccgtgttttaattaatataaatacactgcgtatcaatatactagtcttagttcttcagaaaaacagaacaaattgggtgtgtatatgtatatagacagatttattataaggaattggctcagaggattctaggagctggtaagtccaaaatctgtggagtaggctggcaggctagagacctagggaaaagttgatgttgcagctcaagcccaaaggcagtctggaagtagaattctcccttcctctggaaacctcagtcttttttatcttaaggccctcatagactggaggagacccacccaatcattatggagaataatctgcttcagtcaaagtctatggatcctaatgttaatctcttctaaaagataccttcagagaaatgtaatgacatatttgaccaaatttgtgggtaccatggattagccaagttggcgtgtaaaattatcttaaccaaatctagtaattatttaactttgctgttattgattgaaacaagaaaattatgagccacacatgtgggcagctgaccttttagaaaggtgcaaaggcaactgagcagaggaaagataatcttttcaacaaattttactggaacaaattggttaccagtatgcagaaatatgaacattgatccatccttcattttatatagaaaatttcacccataatatattatatagctatatataaaacctgaatctataaagttctggatgaaaaaatacaagaaaatctaggtgaccttgtgttactcaaagaattcttggatctcaaaataatcttcataagtgaaaaaaattatttaattcattctgtttgcttatatgtatgtaaaccttagaaagtacaagctaatttatagtgacagaaagcaaaatgttggttgcctaatgattttgtgaagtggggccaaggaagattacaaattggcctgaggaaagttttagggttgatgaatatgttcatcctctatattgtggtgatggtttcacaggtgtatctatatgtcaaaactcagaaaattatgcaacttaaatatgtgcagttttattatatgccatttacacctcaataaacctgttataaaactgacaaattatttttatagcctaaatagtaggtgatgactgcctgaattagggtagtaacaggggatcatggaaagaaagaaatggattaaggatttatgtatttttggtagagccagcatgacttgtttgaaataaagaaaataatgggataaagatggttcttacgctagaggagctgtgtaaataattgttccaatgtaacatatttattctttagaatccaaattctatgcagccgcctcagtagtagttacagtggtaagagaatctcagtgaatagaaactcttagttaatagttgtttttttcttctctacatttcaatgggtagaccttagttccttggtaaagttttctatattaatatactatataagattttatttagataattaatttcactgccaaacaggagggttgaaaatcactttactagcatctgggaaaatacattgattattcttgtattcttccttggcaaaaaatgaaaataattatatgaaaatattgatattttagtcaggatagattgatgttcattatatgtccagctcaattctaaaccatttaagtgtcttagattgtattctcataatcctataatatgggtagtattaacctcagctgataaaggatcaagatcagaaaggtcaagcacacaaatggttgggatgatacttaaattaggtctgataacaacatttatatgtgctcatctacagcacagaaaattctcctagactgaataatagaaaagtttaaactatattttctgatacatatctttgctgcaaagcagtaatgaaattaaaataagaacttagcgaagtgtcttacagagggaccttgttaatttcaaacttccttgaagttatcactaattagtataaagtgcctgtgtacagagttattacaattcatatttgtcaagaataagcaatcacttaataatgggttattttaataatcttagatccatttattatatattagattttcttttaaagttactatatgtgtatatgcatatatgtgtgtacgatgtgcatgcatttgtttgcataacaaccactatcaccaaaactgtgtccccactatgccgggtatccagcagtgtgagaatggactaatgcatatgcatttgtttgcgttcacatcatacacacatatatacatatacacatatagtaactttaaaaaatctaatataaatgtatcaaagattattaaaataaccccagttattaagtgattagttgagattggaacacataggtttcagaggtatttagaaattgcttcaaaaactaggtacaggtactccacgatacaatacttaaatgttagaagacttacttgaagagcatacgtattttcaatttatgtagaagcaagagaaaactcagtaataaaatatcatacatatagacagactatcatgagagcaatagagcaaattgattgtgtttacatggtttttttctatattcaggatgacaagtaatacctacaagtctataggaattatccaagtttttcaatatctagttcaaattgtaggtgaaaaatctgaatttacataaacattttttaataattttctactaacggggtttgcccttctgaactatatacttaaaagtgtttaaacttttactaagtactgagaatatttcaaagaaataggaaacaaagttgtttttcacaacattgttaataatgacataaaattagcagcagtgcaagtgactaataaggggggattgattaggaatatttggtatatcccatatgctacaataatcgacatccattaagcactgtgtagacaatcatattgagaaatgactgtatccaacataagatttaagaaatgtaaaacagcatggataatgttatcgaaatttcattaaaacaagctagataaaagtagtatacagaaatacatttaaaacgtaacaatggttatcaatttctgaagtgatgatagattatgctcattttcttcacattttctctttgcggtgttataataaacacgtatttatcttcaaaatttttaaaggaatagattaagaatctgatgtaataatgacagtaataaacctttaacatataagctaaaatacttcagtgtgtgtatttagcatcattatattctaattttaggagctcaagtacatttgaacactgctgtgatctggaaatttacaacttgcaatgtagtcccagagcagcaacagcagcagcatcaccagggcagtactttttagaaataaagaatctcagacgccatccagagcaactgatttagtaactgcatttttaaaaagctcctcagatgcatgtacattataatttgagaagctctgctctagaggacaaaaactctcttaagtagaaatgttgtttcctgatttttgattaaatgaacactgaatatacaatagaacatttaacaaaatattttataaaacaaaacaccagctaagttgtattatgtaagaaactcattagttcacatgagtagtactttgagtcatcttctagcagtgcaaaagacagtaagtaagatggtcttacagacaatagtctgatagaaagctgcaatgttaactctatagacaaatttaaatattttaagacttgcattaagaaaagaaataggcagagtgcagtggctcatgcctgtaatcccagcactttgggaggccgagggctggcagatcctgaggtcaggagttcgagaccagcctggccaacatggtgaaaccttgtctgtactaaaaatacaaaaaatagctgagcgtgttcatgggtgcctataatcccagctacttgggaggctgaagcagaagaatcccttgaacctgggagacagaggttgtagtgggccaagatggtgccactgcactccatcctgggtaacagagcgagactccgtctcaaaaaacaatgaaacaaaacaaaaaagaaacaaaaagacacgttaaatgaatttaatggtatatggttgatatggtttgactttgtgtccccatccgaacctcatcttgaattgtaatccacacatgccaagggagagagggaggtgattggattagggtggtttcccccatgctgttctcctgatagttttcacaagatctgatggttctataacgagctcttacccctttgctctttgctctttctctcaattgccaccgtgtaagacgtgcctgcttccccttctgccatgattctaagtttcctgaggccttcctgggcatgcaaaagtgtgagtcaattaaacctcttttctttatacttacccagtctcaggtagtatctttatagcagcgtgagaagggacaatgatacatttaggccaacacaatcaaagtattgtccttttaatagcaatcaaaaattattaatggggaattttacatttattgtacttattgttcaaactctgttgtgtatatcttaaggtcagactagccacgtttcaaatgctcaatacatggctagtgtctacagtattggaacggcgcgggtagagaccatggcttaatttgtaagttataaagtctattaagactgagccttatgtctttcagtttgtactctatcactgtgttcattatattctttggatgtgggaagacatgctttgtacaaatggctccaggagttttcaaaatctttatgaagacatgatgacattccagctacacttaataattgcattattgtttacatatgattgtgctgcccgagttcccactcagtggtccagtaacaaccacactcactaaaactgcatccccactgtgccgggtatccagcttgaatttatacaagttgtaggttgtggtgattttctttccccaccagtagagtagagagatctccaggatccagaaaaggccgtgctttaggggcaagggtgcaaggaaaacctggaccagagttttcagttctcagtaacaacattttcagtaattcttgttctagaaatacaggatatcaatggcatttttcgctatagccatcgttttgctataacattttattacattagaattataattttctctaatattagattaatttgaagaataagtatggctgcttaaggaacaaatactttgttggatcactggaactattatgctgattacaagttgaggaatttatatttagtcaatgcccaaatgtattataacttaaaataactcagagatgccacattttttccatttatataatttgaagaaatatttattactactgaaatttatgaccacatggatcttccagggtaccttattaatttttaatttattctttaatagaaaaaatgtgcacatgctaatttagctaatatggtataatgtggaatgccaaatgttgtgtctaacacagaatctttttcctggtagcactaaagctgctttatcaggacagactcatattctgtcctcaattccaagatacacaataattgaataagaatatgtaattatgtttagaaaataaaccttgaagtgatacttcattgaatatatagttcgctataagaaggatttcattttcagaagtgtaaaaatgtgaataataggaagaaaacttttattttcaaatcaagaaactatgtattaattgggaagttaacacagcagcagatgctaatttgcataacttgccttactgtattctagcaaaagaaatatgtgaaattcaaaactgaacaattttgatgtgacctggagttaagaaagttagagagcatctacatatttaaggaaaatgtctgggcatttttgaagagtagtaatcgtggaggaggagaaacgtaaccagagagcaaggcaagacatgtgaaaaaaatacacattaatgatactataggaataattgaatcttcaaacacaaattttgattttattacgggagcattgaaactacaatttttttttttttttttttttttttgagacagagccttgctctgttgctcaggctggagtgcaatggcgtgatcttggctcactgcaacctccacctcctgggttcaagcaattctccctgtctcagcctcccaagtggctgggtttacaggtgcccagcaacttgcccggctaatttttgtatttttagtagagccggggttgcacaatgttggccaggctgatctccaatttgtgacctcaagtgatcagtctgccttggtctcccagagtgctgagattacaggtgtgagccaccgcgcctggcctagagtacgatgtatcttgtaacaaaacacaatataaaacaaaatgctagtggatttttctttttgttctttaaaaatgattgttttctaatcattctcctatatggtggttgggagtaaaaacctcaccttagaagaagagcacaattatcaaattgttaactgtttttttttgtttttgtttttgtttttttgagacagagtgtcctgctttgttgcccagcctggagggcagtggcgtgatcttggctcactgcaatctccacctcccaggttcaagcagttctcctgctgcctcagcctccccattagctagaattataggtatgtgtcaccacgcccggctgatttttgtatttttagtggtgacagggcttcaccatgttggccaggctagcctcgaactcctgacctcaggtgatccgcctgcctgtgcctcccgaagtgcttggattataggcatgagccactgcggccagtcaaattcttaacttttaacttaaaaagttattttcccagtctacaacagaaagtgaattggagatgcaatggggaagaaccaatgggtttggtctcttcttgactttttagctggagagtaggctggagactgttagaaatgagcaaagagactttctccgaggttggtttggatcctgagctgtacattgcttcctttgctttcctattgcttctgcaaagggaaacatactaggtcctttttatgtctgggaaaccaagagtagattaaaaggcatcatgcttcacaaaattcatgctaccacaatagcacagagagaaggatgttgacaagctccgaaacagtcttacagagtctccatgctctttggtggagttcggagacagccgcaatggcatggatgtgtcatcagaagaattacaagccttggactgctgcataaaactaaagatacagtgtgaagacaaaagcagcagaaaccagggcatgactgggaagtggacttttttttcctatcttagcctcagctccagtcagaagggagagctgaaaaaacaaattctgaatgtgattaacattaaggttctccagggtattaagattaaaatccgttacaggaatctttattttttataattagttcagttttattttttgaaaaatacatggtttttaattgatatgtttatatctctttgaatgagtgccaagtaattctaataatagaattataatgctttaataataattagaataattattagtatcataattaaattttgtgatgctattaggatgtgacacatttagagtagtagaaaaagccaaattctctagaaattatgttgtattattttatggatttaacatattttatccttgaatcatagttgtttttttaaaccaaaggtcagtggtatgataatatttttaattgtatgaactttattttaaatattttaccatgtgtacctctcttttctctgtaattgcttacaagcattttgttttgttttcattctaaagcaattaataaattttgtaaatagcttttcagctgtttactaaaactcaccttcctgagttatgtataataaaagtaaatggcatttataagacgtgattatgtggaaattgacttttaatacaaattgcttctttatttttacacctcaatggctaatgttgatagtaaagttgtatatacaagttaaataaaattttggctctgtttattgtacccctggtaaagaagcatggtgtttgacccatagtgagtactcaataaatgtaaattgaaatcgataaatttcaaagctattaaaatacgtgtaataccatgcactcataaaaaggaatgagatcatgtcttttgctatgtcatggatgaagctggaagccatcatcctcggcaaactaacacaggaacagaaaaccaaacaccacatgttctcactcataagtgggagctgaacaatgagaacacatgggcacagggagggaacaacacacaccagggcttgttagcgggtggcgagtgaggggaaggaacttagaggatgggtcaataggtgtagcaaaccaccatggcacaggtatatctgtgtaacaaaccaccatggcacccatatacctatgtaacaaacctgcacattctgcacatgtatcctgaaacttaaagcaaaagaaaaaaaaaatcctggctttggaagttgtaattataatttctctgatattgcttaatgtaaaaattatgaatatccagtatgatagcaacaacagatcctactgtataaccaacatctttctcactgaaactgaatactgccacacgcaggattcacatagtatacttgtcatttctagttgaatgttattgccacttcagataaagttgccaagcttggcataaagaaaagggggaggtaaagggactgctagtaggacacaactaggcagtgtccacaccccagagtaccaaggtagctgtgcaagaagaatacattctattctatgatgcctcacgctgaacagagggctaattgatcacttacctcttgctgtgtggtctgattcagacagcagcaaagagggactcagtggatgtcagtcctggagtggtgattctcgtatccttcttgtctatcataagggaagaagtgctgaccagcgcccatgggaacggtaatctttgtgaacagctgtgaaaggaccacagcttaagaaactcaagggtggtactaaaaccaggaaatgtggaagaagctttgtttcctgccatgcttcaggtgggatttgaaccagaaaaaaacattatactactagttatcgctaccacatttattatactctcagacggttttcatataaccattatctgtctgggagcagtggctcatgcctgtaatcctagcactttgggaggccgaggtgcgcagatcgcttgagttgagaaattcaaaactagcctgggccacatagtggaacttgaactctacaaaaactacagaaataaaattagccgggtgtgggggcatgtgcctgtggtcctagctactcgggaagttgaggaataactatttattatcttatgagttggcattgttaaggacgaaaacacagactgaagtaagttttctcacctcattttgtgttgcatggctcaatatcaactttaaaatgctccaactggggggaaaagctgattttctatcaccacaagactacaattttgaaatatgtattttctatttcttgtgaaaattgatgcacgcgtggatatttgtgctttcttttaaacatgatttatactcttactttgtctagttttgcagagcatcttcagttctgccaacctctacatttataattttattataatagtgtgccatggcttgaaaatgtcttattggtcagtgaaggtagacatatggaggtttttacttatgctataatcaacgaaaataagacttgaatgaatcttaagatgagaaaagctataaaagattgagtcctgaaatggagatcagaaaattaattttaaaccttcattgccatctaaattattgtagtctacttatgcaacttcgagtaacctggctatttctcatttcaaactaaataggaaagcctagatgagcagttcttgactaccttttccagctattaaatatggtgtgtgtgtgtgtgtgtgtgtgtgtgtgtgtatatgtgtatacatatatacacatatatttttatgctagataatattcatgagcatgagagacttccatggggcaaggaaatgtatgtaggaaagtgagtaaaagtgttaggattacactatttccctgtttgatatatttttctagagcaaacaattgtgacagcaatacattattgttagtaaagacctacaacgaatcctaccacacttttatgatttagctctactggaatatctggtctctcttatcttacccagttctagaattccgtgattctgatctacttctttaatgaaggtttgtccctaagccaagtatttaagctactcctagaaattagtgccatagggaatgacattttctcattcaacaccctgtctgtgtatttaatgcatctatcataagcaataatgaaatattcagttgccaaaatccaatgagggttttgggagtttgacaactaaagtctataaactgctttaaatatttaaggagacatttattctcttaaattcatccctgtgaggatagatgcattgttttatgtgccatgttggtgaaaattagactctttaaatagaattttattaatgtctttggttcttattattctacttgtcagtttaaaaaatcttctaagggaaataccattaaacatgttctcccatcccactccccactatttatgtattaaattaataggaagtattcttaggttatgaagtcaccctattgcaaattcaagtgtaacccaacagcataaggtagataacataactgaggttgctacaactgagtgatgactgcaggtttttaatttatattaggctatttaaagaaatccccattgaagaattatgacccttttgtctccttgaaaaactaggagtcatccatttatctgcatctccggtttaggctgtcaacatttctcaccttgattattgcaaagtcctcttaactggtgtctcaacaccagcctatcactcacctaatctgacattcacactgcagccaggggattagactgaagacacatatacttactctgcataaaatgattgagtggctgcatgggaaaaaccacctcactagtatctaacatccttcctgatttaggctttgcctaactctacagtcccagtgatgttcaccattttctctactacagccagaccgagtagaggagatcccacaaatgtatcacatactttattctgaagatctggggtgtggggggaccaaatggccctgcaaactggtaaaaagcacggtccctggacattcaccataggtttgcatcttatccatgctgccaactaactgtgctgcttggacgcattttgaactctctgtgttactgtttcctcgtctctgaagtggtaattaagcagtgcctacttgatagtttatgcatgtaaagtgggtagaatcctgcctggcatatagtaggcactatgtaattatcgatactgttgtttcccttattctggaccactgtttgacactccccaggctagttctaactttttaaatggtttctttagctctcattttaaatatcattcacgtgtgcttgcgcttgcacgtgctctctctcgctttcttgtgagttctctcgctcgctcgctcgctcttgctctctctctcttggcttcccatgtagattgagtttttttttttttatgtgttacctctacttctcatactgtatggcaaggcacatttttacttagctgcctttcctaacaaattctaaacttgtaaacacagagattgcgtttatcttggtcgttatgatattgccactgcccagtacagtgcctgaaatgtatgagatcataatatttacgacaaaaagaataattagtgattttattaatagcagatgtttaacttattgaaaaacaatgtgaacatacataagcactctaagtgtatgaatatacggttgggtaaactgctggtgaatttgtgtgcatgtgtgcgtgtgtgtgtatgagagtgaaacacatgcaaatagcaaatgttttcaaaatttccaagttcacctgatacatgaagacaggagttaataaagatttttaaagtaacgtctaaacaagtaagaaaaataactttgaagggctgaggcacattatcgaattttttggaaacataaaaaatgctgtcaggaaagtgtcttgctgaaaatatgtattacttagcttttgttctatctctgaagtgtcccacaaaattcttcagaattaatctattacattttttgaataaaaataaaaattacttctgagaaattcagatgcttattggtaatagtaatatattcgagtagaaaataaattttaagtttagaggtataatacaccctctccaagttaaagaaatactatacctgtgtgcgcacgcatacataataattcacacactcacataaacacacacacctggtttgctgaggactttcaatcgttgcaggtgtgcgtgtgaaaaatgttactttccttgtaatcattctccaaatgtgctgtgtcatcatctcctttcctgctaatcagcggtatccaaaatgacatgaccagattgtgtaatttcttgtcacttttttcttatctaacagcctctttcgtattcttatgattcagttcagtttattttaaaattgtaatttcaccctcttcgaaaaccctactctgccccatcaaaactgcccatgacagctgtctgtggtttgcacttcactcaaacttttttccttttgctctcttaatgagtgctacctcctctggtattagggaagaaaggaagcagaaggaaagtaccagtgttgccaccacgtcctatagtttttttcttagtaggcttgacttgctgatctagatgattgtcttgcatgtgggctcactgtagataggtgctggctatagtgtgatgatggagttctggtaggcttctcctatgagctttagcaatccccttagagatttggcccccagagggtggctgcaaggcttacttctctgatatgcaccccaaacagaagctgtccaagcaaattcttacttacaatgtcatactctgcacgagcaagaggatgtgtccagaatcacatttctattaggaactgagaattccagaagaatattcctggaccctggcaactagatcacctgcctctgtgtcaactctctccaattttctctctctctttccagtagtatcactgggaagtgttatcaagccctttgacttaataaccttcattttaaaaattacattctagctgctgcttttagacttgtccagtagttaccattctttctttagacctgttttcttggctatggggaggagaaacaattccaaaaacagaaagggcaggtggaaaggaaagaagatggaaaagaaaaaaagtggaagggaaatttaagagttcctcttgtagtctttcataggtacctcatagatggtagtaggagagggctcagggagttggtgtttcatggtgggacacattctcttaggttaggctactcagggagccttacagaatggccattgaccccagctgggagtggttccctgaatatagaatgtgacacacttgaaattcttgatcctcagcttataagtttagctgcagttttagaatattagaaaagacccaactcaataccatgctatgcttgtagctgtaactccagttacagatctcagagagaggatggacatttgacaagctttcgacagacagctgtgtcaaaattgaaaaacattaaagtctaattttatgggcatcatagcattttgataggaagcacagacttatagccagatggctagatgcactaccaatcttacagtcctttgtaaaataaagataataagaatgattatacagagtcatggtacggattcaatgacttctgtaaagcatcaagaacagtgtctgatatatgggcatttctccttttttaagttcagggatatgtgtgcaggatatgaaggtttgttacataggtaaagtgtgacatgggggtttgttgcacagattctttcatcacccaggtattaagccttgtatccactagttatttttgctcatcctctccctcctcccaccatccactctcctctaagccccagtgtgtgttgttcccctctatatgtccatgtgttctcatcatttatctcccacttataagtgagaacatgccatatttggttttctcttcctgtggtagtttgctaaggataaaggcttccagctccacctgtgtccctgcagaaaaaaaaaaaagatctcatcctttttcatagctgcatagcattccatgttgtatatgcatcacattttgaaaaagtcagtctatcattgatgagcatttaggttgattccctgtctttgctattgtgaatagtgctgcaatggacatatgcaatcatgtgtttttatattataatagaacaatttatattcctttgggtatatatccaataatgggcttgctgggtcaaatggtatttctgtctttaggtctttgaggaatccccacactgttttccacaatggttgaactaatttacactcacaccaacagtgtacaagcattcctttttctccacaactttgtcagcatctgttattttttgacttcttaagcatagccattctaactgatgtgagatggcatctcattgtggttttgatttgcatttctctaatcatcagtgatattgagcatttttttcctgtgattgctggctgcatatatgccttcttttgagaagcaattgtttaagcccttggcccaccttttgatggtttttttttcttgtaaacatgtttaggttccttatagatgctcgattttagacctttgtcagatgagaagtttgcaaaatttttctcccgttatgtaggttgcctgttcactctgttgatagtttcttttgctttgaagaagctctttgctttagttagatctatgtgggcatttcttctgtttgttttttattttgttggttgcttgtcactccccatgtttgccctgctcccaagatctactaactcttcacacagaacctctggttgcctttgtgaaagctgcaaataccaggatgcaatcactcttgtcagacccaaacgaattgcagctgaaaaagcacaaagtagaggaactcatgcttacatgtctgagacaaggattgtctcgaggcttttctaaaataaccccacaaaaaatcccttctttaggactgcagcaattcagataagatgctttctaaagaacacttgcctaataacaccatcttctccagtgaattgacagcaaccttagctttgaacctctgaaaccaatgaattctgtttccaagaagcttatataaacttcccctttttgcccttgctctgagctttctcttacccttccatctttgggtagatctgtggcttgccatggatgtgcatactggattatgatccttcttgattattcccaaataaattcattatattaggaggcatttttctggttttgttttgttttgttttgttttgttttgtttcaggctgacactagggatgcctcttcagtgtcctttgctcagagcaaatcactctattgttcatcctactaactaattgttggagtaaacattgcttcatgtcctaaatttctctgaataattattgactaactagtgctaaatgagtacaatctagtaggatagtcactttaatagagagtaaacccataactccaagttgaaatctcgcccatcagtactgggtgagggaatggatttttgtagatttctgagaatttttaaatcccagcactaaagaagtcatctgtgggaggggcccagtgttatcctaaggttatagatagattttggtaaaagagtaaaaaaatgcaggctgggtgcggtggctcacacctgtaatcctagcactttgggaggccgaggagggcagattgcctgagctcggcagttcgagaccagcctgggcaacatggtgaaaccctgtttctgctaaaatataaaagatattagctgggcatggtggtgggcacctgtaatcccagccacttgggaggctgaggtaggagagttgctttaacctgggaggtggaggttgcagtgagctgagattgtgccccactgccctccagcctgtcgacagagcaaaactctgtctcaaataaaaaattaaaatagaaacagataaatctaaatggaaattctttaaaattcaagtgttttatattaatgggaggaaaacgagagaaggcacatagcccctgcagttgttatatgggtactaaattgtgactctgtcaacaagtagttgtgttaccttagtatatcatttcatttccttgcaaaaaggaaacaattgtatctgacttgttactctctagagctgtgtaatattagataatatgtgagaaaatactttgaaaaatacaaaattctctatagatattatgattttcactaccatcatctcagaactctgagagtgtttgtagatgccactcttgtctcatttctgccttccagcgatgttgtaattttcgaatgggataatatgtaaaactatgaagtgtccaacatgtaataaatagttaattattacttgctattcatattgtgatttataattattgattttattacataattttcatgctagaccatgagttcttattactctgttttactcagccctgcaccactggtgctcagaatatcttaaagatttaatatatgattgttgaattaattggctagttattgttaattacatcaataccatagactacaacataaaaacgaaaacattaagtatcacagtggagcaatagagaaggtaaaaattcagaagccacctggtgataaaaagctaaaactaacacagaaataaatagactacatgctttttgtcacattatgggatttttccaagaaatacatttctttctcataggcccctcaccaggcctctgcagtcactgcatggtgttctggcacatgtgaaaagcctgctgcaataaaatttcaagggcttctgcctataaaattttatatactgcagactttgaatctgcattactttgcagaaacaatggattttcgtttcataatttggtagtcgttaagaaaaaagaacttaagaaaaacatatgtaacaaacctgcacgttgtgcccatataccctagaacttaaagtataattaaaaaaaaattagtaagttctttaacttgccactgtggaaaaataaatctatacaacaaagtatgaaacacaaatcattacaaaggaaaatttattactgaaataaaagtgtgataaattaaggaattctgcagtatataaaatcttaaggccctcggatcttcttgtatgctaatcacactgcttaaagctttcccctaacatgcaagggtgttgctaggttattaaaatatgtatatgacatgtttgactacacttttagaaactcaaactcattatcaagctaaaaatgttgttatatttctatctcctactcaataactatttttaaaataaaaacgttctaaatctcagcaaaataagatttttgtgagataaaagtatgttttctgatgttacacaacaataattgatactaatccaccagaagtactaggcaaaaatttgcttattgaattccaaaatgaattatgttttattggccgtcgctcagacaggagaaaataatgtatcttgttttctctaattatcttctctgtttaacttatctcagagacctaaaagctaccaatggtgaatgcctttacatgttcatgggagctgtttttattatagccatctgagataatgtttgtccttgtccttctgatccaaaggacaagaatgtaactaacaatggaacattttctaccacatgagcagtttgaggatgttgatttctgaaccagccggtcaagtttacagcatttatctcttagttaatacatgaccttgatattttggggcacatatggcaacatgcagtctcatgctgatctagttacttttgcaataagaataacttaactgtgtttttgtcttctcactctgaagctattattcactagttccactaaacaaaaagatttcaaagtccacattaaaaatctagattacatttcttaaaaataggttttcctcgttgttcaaaactgtttattttattctacatccttctttttccagaaatgggatgggttggtgattacagtataaatacgtgtatgtacctatgtgtaaacattttcgtactgatttttatgtgtctgttgacttttttcaaaaatccatttatcatcaacctcatgacctcgcaattaccaaaagcttactgttttctaaacataccaaacaccttttcattaccgcttttgccctttttattggtaaaacatggattctccttggtactctcgaaaaaatcagatttccaactattatgcttctactgaagcactttatttctgcttcatacactcacagccctttgtctttatgatttttgatacttatatgtttttatttctattatttgggtacatttgactctcacaaaataagtacaaattatgtaaataattgttgaataagttatatcactacacacacacattataaaagtattttaaagtggttccctcaatattcagcgaatttctgaatattgcttttctacaaaagaacttaactacctggttaagtagcaagtaagttttttataaaagaaaagagaagttaaaacataagctaaaaccactaggcaaaaaatgttacaaagaaggattatatactctaatatatatatatgattcaaatatatggctacacaaaacaatcattgcaacatatgtttaaaaaatacttattcctggatgatggacacatgaatctaaatctctccactaattattttccccagacatccaggaaggaatgcgaacgggaaacatatgtaatcaagaaagtcagcacttatacgagaaagaaaatgccatgaatttcaaattaactctaaacagaaaattacacacaaaatcacatcagtgctttgaccagagctccaatggccactgcaaaacctgtgagtgtgggagggaagggaaagagaatccatgaaaaatgggagaggatagtgaaaagtttagagtatagagaaagttatctgtaaaaggataaagtccttttagaaagaggtaaattaatgcacagagttctgtggcatggtggcacagcgccaactacagtaaagaaataaattactaggtgtccacatgagaagaatacaaataaaatgttaaagtaattaaaggcatataaacaaccaagagaaattaagatatataacctttttttgtattccattccaaccactgtctctttgaccacattttttattgtatctgctattcactctctctctctctatatatatatataaaattccataaatatacatatttatttatatatttcttttaaatatatatataaaatatatgcattttatatatacttatatatgtcttctatatataggaaatacatatacacacatatataggaaatatatatatgtatatacttataggaaatatatataagtacatataacctctatatagggaatatatataaatattttatatatagggaatatatatatatataaagagattatatgtacatagtaagaatatatgttccttaaaaagggtgaaattaaaactagagacaagcctcattttatcgcactctgctttattatactgtggagataccttgtgctttacaaattgaaggttgtgataaccctgccacaaacaagcttaccagtaccattttcaaacagcatgtgttcactctacctttatatcacattttggtaattctcacaatattccaaactttattattaatattatgtctcttaaggagatctttgatcagggatctttgatgttactattgtaatttttttgagttgccacagactgcacccatataagactgtaaaaattgctgaacactgcatgtgttctgactgctccactgcaggccactttttcctgtccctctccctgtccttggccttccttattccctaagagacaacactattgaaattaggtcagttaagaaccctaccgtggcctctaagtgttcaaattgaaagaaacagttacacttctctcacattaaatcaaaagctagaaatgattacacttaggcgggcatggcgaaagccaagataacctgaaagctaggcctcttgcatcaaaccttagccaggctgtgagtgcaaaggaaatgcttttgaggaaaattaaaagtgctactccagtgaacatacaaataataagaaagtgaaacagctgcattcctgatgtagagacagtttgagtggtctggagagaagatgaaaccagctacgacattcccttaagctaaagcttaatcctaattctcttcaattctttgaatcctgagagagatgaggaagatgaagcttagtacctagcaaaagttgattcataaggtttaaagaaaaaagccatcttcaaaacacaaaaatgaaagatgaagcagaaagtgctgatgtagaaactgtagcaagttatctgggacatctatctaagatcatggacaaaactatctgaaaaaacaaattttcaatatagatgaaacagccttttactagaagaagatgccatctgggactttaatagctagagaggagaaatcgatgcctggcttcaaagcttcaaggcccaggttgactttcaacctgtattgttaagttgtaatgcacctgatgattgtaaattgaagccagtgctcatataccattccaaaatcctggacctcttaaaagttaggctaaatctattcttcctctgctctgtaaatgaaattacaaagtgtggatgacagcacatctgtttatagcatggtttactgaatattttaagcccactgtcgagatttaatgctcagaaaaaaagactcatttcaaaacatgacggctcattgacagcatccctggttacccaaaggctctgatggagatgcacaaggtgatgaattctattttcatgcctattacacaacatccattccatgaatcttgaatgttcttaatggcatctagagtggtgaatccttatcagaaggtttttaccttactttgcccaggaatattagaagaatcaccggctgtagctgtatggcagctatagtcttatgcaacatatttcttaataaaacttcaaaatcaaaattactccttgatccatagcctgtgattctgctgatgttcttatgcaaagtaaattaaaaaccttttgataaggattcaccactctagatgccattaagaacattcaagattcatggaaggaggtcaaaatagcaacattaacaagagtttagaagttgatttcaatcattatgagtgacttcagtggaagaagtaactgaagatgtaaaaatatcaagaactagaattagaagtggagtctgaggatgtgactgaattgctacaatctcatgataaaacttgaacggatgaagagttgcttattattggtgagaaagaatgcagttccttgaaatggaatctactcctggtgaagatgctgtgaacatggatgaaaccactacaaagtctttataatattatataaatttagttaataaagcagtggtagtgtttgaaagattgattccaattctgaaagatgccttacagtgagtaaaatgctatcaaacagcatagcattctacactactaagaatttttttgtgaaaggaagagacaaacatgtcgcaaacttcactgttgtcttattctgagaaattgccgcagccactgcgttgttcagcaaccgtgaacctgatcagtcagtagctgtccacatcgaggcaaggcccaccagcagcaaaagatgaccatttgtggaaggcttagatgatagcattttttaacaatgaagtattttttaattaaggtatttacattttttagatgaatgctactgtatgcttagtggactaaagtaaagtgtaaacatgaattttataagcactggatgccaaaaaatttttgtggctgtattgcaatatacacttcattgcagttgtctagaactaaacccacaataattcccaggtacacctataattatgttcatttataatttaataaagctttctagaaatgatcccttagatctatatattgaaaaactacacttctgtagtttacctgaaacgattaactccaaaacatatcttagtgaaactattaaattttaaagataatttaaaaatatccttagaatcctctaggaaaagagattaaattataacagtgagaaaattagactggctgtagacttctcaggaataactcacaaagcaaggagttaatggagtggaatttcaggaaacacaaaaaagggtaagccaagcattttaggtctaggcaaaaaattttcttcaagaatcaagtgtacagaaaaagaatatgcaagaaccaaggaacattatatacacaaattgtttatgaataatctatcatataatgagtttcatctaaataaaatgtcctggtgaaacttcagtaagggaattgatgattagcattaatatatttatttcttgaaatatgacttaaaaggggtgaggatatgagtgggtgaacaatatgtaagttttatacattctggcaaaataaagtattcaagtgtaaaatgaaaagagaagagagataagtgaaaatagaaagatattaattgtggggtacgtcataggtgagtcaaagaatactactaaaaatgaaagccagttagtacaatgctaaaaatatgaggcaggggtgggaggaagcagctttagggaaatggggactatataaactataaatacaaaaataatccatagaacaaacttgtaaacttttctaaataccaaagtaattttttaaaaggagacaatacattgagaaacacagtaaacaaaatataattcaaacagaaagtataccaaaaaatgaaagcaccaaacccaaacacatccgttctgtgtaataggttgaactcacctattacaataaaaagattttaaaattggcacataaaaccaaaatctatgttgtatgccagacccatctaaaatacagtcattccaaaaagttaaatgaatggaaaaaacacatcagtcaaatggaaacaataagacaacaaacctaatatgagaggaagtagaatttaggccaaaagcattagatgagacaaacggtgttgtttcatgttgctcatagccacagttcataagttacataaaacattactgatatctgtgcactaaaaaatacaaccacacacatacagaacataaacttcagttggtgcagggaaatataaagacaaaataacactaacaatagtgttgccttttattctgttgaattgtcttattgatctggaagtatttgttatttattaacatataattccatggttgatttcatgtattgtaaatattatctatatgactacatgactagtatttttacttctacagtagtatattttgataataaaagtttctaattttattgaatccaatttttttattgttagtacttctctatcatgtttcagaaatctcccttcaccgcagctcataaagatattgccctgtgttattttatggaaactttcctgttccaccttgcactttttcatctagtctccacctcatatcatgtatcatttgaggtaggaattaagttttatgttttccatatggatatgcaactaatccagtactatttcttgaaaagattgtcttttcctcaccaagtttcattgccttctttgtcacattttaagtgcacatatatgcaaaaataaatttatagatttttaattttgttccattggtttatttgtatatcgttgtgccaatatcatactgccttggttattgtgcctttataataaatctttttacttggttggccactttccaaaatgttcttcttcaaaatcattttgcctgatctgggtaatttgcattttcataaaaattgtaaaagtttgccagttttcacacacaaaaagaatgaggtttgtttgggagtacattgagtctatatatgaatttggaagataactgttttaaaataatgagtctcctagtatatagtgtatttctcttttacattatttgtcttactgtagtcagtaatgctttcttaaaaatctatttctaattggaaattttaaaaattatatatttatggtgtacgtgatgttttgatacatgtttatacacacactgtggaatggctacaccaacctaattaacatatgtagtatctcacatactatttttttggtgacggaaacaatacttaaattgtactcttctagcaaatttcaaatatacagtatattaactgtagtcatcatgaggtataatacatatcttgaccttaacttctcataagtgaaattttgtttcctctactcaacatattcccatgccccaacccccgtctggtaaccacactttcactccctgtttctatgagtttgacttctttagattctgcatgtaaatgagatcatgtggtatttcacctactatgcctgtgagtcaataatgctttatagttttctatcgaaaagtctagcacatcttctgtgaaacctttttctaggtattcagtgattttcactataccatatatactttttaaaactcatttttgttttatttctggaatgtagatataaaataatatgggttattgaatacatgtattatgataatactaagtccacttaacaactgtaattatgtaattgtacaaagttaaaatccttctcttccaatcttactttgtgtgcattcattcattcattcattcatgccttattgcactggctagaactgccattataatattgcataaaaatgctgatagcagatacgcttttcctctttctgaatctttgttaatgttagttcttggtttcttttcacacaccttttataagattgataaaacttttacattcccagattcctaagttttgcatcatggataggtgctaaatatctattgtttttgttagcttagtgttttattctagaaatttgtccatttcaaataattttcgtatgtcttgtcataaaactattaatatcctttcctgttatttcatatctgagggatctatattgatgattctattttggttcttgatatgaatttatatcttctctttctctttttttccattggtgattcttcaaaaattttagtaattgttggaaaaaacaaatttttgctttattgatctcttttctatgtaattgatttcaatagtattaatgtctgctcttattttttattttttagtttattatttttgtaatttaaacatgtttttgagagttgatttttaatcttttttctaaggtatgtatttaaacataaattttctttgaagtatagtttagctgcatctaacaaatttttctcacatttttgtcataatttcaatttttttccattttcattataattttttctttaacatgtgggtacttagaaatacattgtcaaatttcaagtgattactttctatgttttttctattgctttaaggctttgatttactctgtttagagagatacattgttttaatctattgttatcgagaatatggaaaattttagtaaataatgtgtttactattacaattagaaaataatgtgtaccatagttgctgagtacagtctttcatatatgtcacttaggtcatattgttgaaatatgctgtttaaatcttcccttctgattttctttctatttgcttcttccattaagagagaaagtaaaaaatattccactgttgttgtcaatttatctattatttttgtcaatttcagctttatatattctgagattacataatttgataaacactaatttaaaattattttatcttcttgtttaacagttgtctaataaaaggtctctctatttctggtaatcttgcttacttgaagtcttgtctgatagcatagataagcaagctttctttggtcagtgttcacatggtgaataatttcatctttgattttcaagctgtgttatattttgatgcctctcttgtgtgttgttttcattttcaaggctgacggtccttgcattttaatatattttctgtttaatttcctactgaaatacttggattcaaatcatctacattttatgttttactatttgtatcttgtatactccttttttccttcttcatgtaaattattttggattgaagttctttttaaataataattacctctattcccacttcatagtttattagtcatatatgcctttactattcttttacagataaccctgaagagcttaaaatatacatccttgactctttgaaagaacaaaaagaatttgtacagtgaccatatttcaaacaaatgttggaacacttttccattcattccacctgtgtatatatatatatgtgccattgtttccatgtattttattatgtatatatcttttaatctgcaaatggctttgttaacatggttttatacagtcattacttgaatagattgacccaccaatttatccactgctctctattccttcctgcgtctctaatgcttatttagagtcatttttattctgttgacagaaatttctttaggatttttaatggaactgctgttgatgaatcttcttttttttgtctaaaataagtttatttttattttgaatttttttctgtggttaggtagagaatttcggtttctttttgcttccttttattttctatattagttctttgatacagttcttgaatttgctcttttaagttagtagcaaacaaacatcatttttaaaacaaccatataactttttaattagaatatttaattatgttttcctaacccacaaatgcttttgcaatgccgttatttaaagttttttttccggaacttttatctctcacatatgctttcactgtaatgcatataagcttagagagattattgtgattttcttggctttttgggtttcgggtgtatattttcggggactttaggtgtcaacagacctaaaagcaaagagaaagtgtgggctgtcttcccactgtggccagtaatggagagcttgtggactgctggtctccttctagaatcatacagtttcccatttccaaaaactagaggacacagctcattggttcagagccttcttggtatcctgagatgtgaacctttattttgccagccaaattcttcccaggatcctcactccacagctcaaatgctggcctgctttttctctgcccaaaggtgaacaactttctcaccaattatttctgctcagactctcacagaaactgagttctcagaaaccacttaactcaggagatgtagatatactgacactgtcagtctacgtgaagagctctattcaggctctagaatcctcatagttatttatacaagaagaacttgaaggttaatgtacttacgtatctaccattcaaattcttcaattgttgttttgtacactgttatttagttgggtattataacagaaacgaaagaaaagaatgtactgacctgcccagttggcaaattgcacccaagaacccctcaacccacagagacgcttaatattatattaacaaggtcaatataatacctctcagtgtactggaactgtaatttactaagtaattagatgtctgacaatacaatattctgggtaaacataaagtagtttagtagccactgaatttgcctcattgtatgtaaaatcttcttaaaaatgttttgaagtaattttctagatagttaatttgctacttacccaactttaactgtcccagttcttatcttacagtgcctctcaaaggtcaaggccagaaggcacacattgaattttcaaaatgctcacttagccatactttatgggctgtagctcattctaattgctcaagttacatagtagttacttcatggtattcttccttaggctttatgaaaatgaatactacatttaggtggctcagtgataattgataccactagagacacagattatagggaacataagattctgctgcctttatgtacctgtacatttctcctaaaatatattcagttacttgcaaaagtcttggtaatatgtcttgatgtagcatattgtatttcaacaaaagtgaaagtagattcaggtgctggttctgtcctgtgacatgataggaatcaaattatattcccagtctttttttgcatcaattctcatgcctatatttaatatttagaagcatatgcttggtcagcagcattctgaactacagctttgaataatcctctgattagttattttccagatttccaggagctgtaagatggatttaagtaatatgttgattggttagtaaactacttgttttataaatcagcagtggattccctttgcgatatattcaccctggttatttatttcttacttgaagaatctacaaataacgcagatgagttaaaggaaacagagtagtcatatagtaaatcagcaaaacaaaaaatctgaaataaatgtatttagttttaataaatgcagacagcatcttgctatgttgcccaggccggtcttgaactcttagccttaagtgagtttcccatctcggtctcccaaagtgctgggattacaggtgtgaagccatcatgcccagccaagaaatttatttagaagacaaacaaacaaaaaaacacacttcagggactacttgaagtcagccaaagaacacaaagttattttgaacatgaattatttacaaagtcttacaacaggtgaggttgggataagtaaattggtgtaatcctcctttcaaggagtttaatgctaagtaaggagtcaatcgtgtaaactactctatgtgacaggtagaaagatggaaatttttttttccacagtgttttttaactttttattattattttgtcttcatcttttaagtccagaaatacatttccaggatgtgcggttttgttacataggtaaacatgtgtcatggtgctacacagtcatcccatcaccgaggtattaatcccagcattcattagctattcttcttgatgctctcccttctccccgccaccctctgacaggccccagtgtgtgttttccctctctacacgttaatgtattctcatgatttagcattcacttataggtgagaacatgcagtatttggtttactgttcctgggttagtttgctaaggataattgcctacatttcaatccatgtccccgcaaacaacatgatctcattcctttttatggctgtagagtattccatggtatatatgtaccatattttctttatcctgtctgtcattgatgggcatttaggttatttcacgtcttttctattgtgaatagtgctctaatgaatacacacatgcatgcatctttataatagtactatttgtattacttttggaatatacccagtagtgggattgctggatcaaatggtatttctgcttctaggtttctgagaaatcgccacactgtcttccacaatgggttgaactaatttacactcctgccaacaaggtaaaagcattcctgagggccgggcgtggtggctcacgcctgtaatcccagcatttagggaggccaaggcgggcagatcacaaggtcaggagatcgagaccatcctggctaacacagtgaaaccccgtctctactaaaaatacaaaaaattagctgggcgtggtggtgggcgcctgtagtcccagctgcttgggaggctgaggcaggagaatagcgtgaacccgggaggtggagcttgcagtgagccgaggtcgcgccactgcactctaccctgggcgacagagtgagactcctcaaaaaagaaaaaaaaaaaaaaaaaaaaaaggcattcctttctctccacaacctcagcagcatctgttacttttttttgacattttaataatcaccattctaactggtgtgagatggtatctcattgtggttttgatttgcatttctgtaattatcagtgttgttgggctttttttcatatatttcctggccacatgtatgtcttgttttgagaggtgtctcttcatgtcctttggccacttttcaatggggttctttgctttttcttgtagattttttaagttccttgtaaagtctggatattactcctttgtcagatgaacagattgcaaaatttttctcccattctgtaggttgtttgatcactgtgtttgatagtttattttgctgtccagaagatctttagtttaattagatcccatttgtcaatttttgcttttgttgagattgcttttggcatctttgtcatgaaatctttgcccatgcctatgtcctgaatgatactgcctagttttcatctagggtttttatagttttgggttttacatctaagtctttaattcatcttgagttaatttttgtatatggtgtaaggaaggggtccaatttcaattttctgcatatggctagccagttctcccagcactacttattaagtagggaatcctttccccattgcttgtttttgcctggttcatcaaagatcagatggttattggtatgtggctttagttttgggttctctattctgttccattggtctatgtgcctgttctttcaccagtaccatgctattttggttactgtagtcttatagtatagtttgaagttgggtaacatgatgcctccagctttgttttgttgttgttgttcttgttttgtttctttgtttgcttaggattgccatggctatctggctattcgggctctttcttggttccttataatttttaagatagttttctctttttctaattctgtgaagaatgtccatggcagtttaatgagaatagcatttaatctctaaattgctttagtcagttcggccattttaaaaaaactgattcttcctatctatgatcatggaatgtttttctacttgtttgtgtcatctctaatttctctgagcaagcagtcatttgtagttctccttgaagaggtccttcacatccctcgttagctgtattcataggtattttattcttttatgtctctgccaggtttggatattaggatgatgatggcctcatagaacgagttagggaggattccttccttctcaatttttttggaatagtttcagtagaaatgataacaactcttttttgtacatctggtacaattcagctctcagcctgtctggtcttgggatttttttggttggtaggcaatttattaccaccttaatttcagaactcattttggtctactcagggatttagtttctttcttgtccagtcttgggagggtgtatgtatctagtaatttattcttttcttctagattttcttgttacttacataaaagtgtttataatagtctctgatgacttttggtatttctgtgaggtcagtagtaatatggccattattgtttctgattgtgtttatatgaatcttctcttcttctttattagtctagcttgcagtctatcttaattttttcaaaaaaaaaaccagcacctggatttgttggtttttttgaagagtgtttatgtctctgtcttctttaactcagctctgatctttatttcttgtcttctgctagctttggggtttctttgctcttggttctctagtttgtttagttgtgatgttaggttgttaacttgagatctttctagctttttaatgtgggcttttattgcagtaaatttccctcttaacactgtggtagctgtgtcccagagtttctgatgcattgtatctttgttttttattattttcaaataacttcctgatttgtgccttaatattgttatttacccaaaagtcattcaggagcaggttgtttgattttcatgtagttgtataattttgagtgaatttcttaatcttgagttctaatttgattgcactgtggtctaagcaactgtttgttatgatttcagttcttttgcattttctgaggagtcttttacttctgaatatgtgaacagtttttttagtaagtgccatgtggtgatgagaagaatgtatattctgttcttgggtgcagagtttgtagatatctgtcggatccacttgatccagagctgagttcaggtcctgaatagttttgtaaattttctgtctcgatgatctgtctgatattggcagtggtgtgttagtctcccactattattgtgtgggagtctaagtctctttgaaggtctctaataatttgctttatgaatctgggtgctcctgtattgggtgcatatatatttaggatagttagttcttgttgaattgaaccctttaccatttgtaatgcccttctttgtcttttctgatctttcttggtttagtgtctgtattgtcagaaactagaattgcaacccctgcttttttaggttttccatttgcttggtaaattttcctctttctctttattttcggcctatgtgtgtctttgcatgtgagataggtctcttgaagacagcatatgaatggttcgtggttctttatccaacgtgccactctgtgtcttttaattggggcatttagcccatttacattcaaggttattgttatgtgtggatttgattctgtcatcatgatgctagctggctagtttacagacttgtttatgtagttgcttcatagtgtcactgttctatgtatttcagtgtgtttttgtagtggctggtaatggtttttcttttccgtgtttagtgcttccttaggagcacttgtaacaccggtctggtggtgacagtttcccgcagcatttgtgaaaaaggactttatttctccttcacttacaaagcttggttttgcaagatatgatattcagggttgaaatttcttttctttaataatattgaatatttgccctcaatctcttctggtttgtaaggtttccactgagaggtccactgttaatctgttgggcttcccttttttcatgacctgacctctttctctctggcatccctcaatattttttcttttattccatcagtgaaatgtttttatagtcaaataattttgcaaaacatttttttcataattcacaaaacaaatgcgtattttaagtgttcctatagtaaaggagaatcctttaatctgatatgacaccaattttgattgactatagtataccctaaactcatttttattccaaaaaatttattgatatcattagaatagtacacatttgtgggacacttaagtttgtaattataatagctgggagaaagggttacagccaataaatcctgattgtggaatcaagacagcttcacagagttggtgattgggcgtggaagaatgaaagcaatatttaaataggttaatctaaaacaggaagtacatataaaaatttgaagaaaaaattttcaagctgtaaaaattacataagcaagcagttgaaacatttctgcaataagatgtaaatatgtacttctagctatttttgaaagtaatgtagtcttcaaagaaaaacattaaaaactgagtacatgtgtgttttcagtacctgtgtgcacagcacagaaaatacaaatatatttaaggctcatttttggcatcagagaggaaataatagtctttaaataatattactacaatggaattatagctaaattattccaattaaaaaattcctttctgtatggagcttagagtttgtttttaaaacaaacaattatagaaataaatgtgaaattatgatacatagtacaaaagaagttacaacctgtgatgattgtaagggttttaaaggaggaggtatttgaattgaggggttgaaggatgagaagctgatgaggtaaaggttatgaaatgaggcatgacaagcagagggcacacaggcccagtggaccgtgaaacatggggtcttcaagggtggatagagtaatggacagtagagctgggacaatagaggatagtgagagacatggagtctctgcaaacataatacccaaattgagtagttgacaagaaaaacaaattttatttctgaaatagaaataccaatatgtcagtgggattttgacagacgagattgtttctttgatttataataatgtgacgtgtatgtttttagaatggataaaaattgacaacatgaaagttcagcttaactcaacaagtattcattgaatcaggttccaaaggtaggtaaatgaatatgatacattccctattgatgaaggagatagaaacataaatatgtgcatgtatctaagatgcctaaaaggccttttgagtgagaggaagtctgagctgatacataatgtataaacattcagatcttgaatctgagatcagacgggtgattcagatagaaggaattgcataaacagacacgtgaggcttaagcaaataatgttgccgagaaccataagtactttgatgttgttggaatgtaaaatgtgagaaaggaagaaaaggcagagaaagctagaaaaaaaaaacatgaaatatatcacaatacggctctgaagccaatacggctcatgaagccaaagacttagagttcgtgctatacttcagggctgtgcaaacttcagacagtgagccaaatctggcttattgccattatttggtgagtaggcattggaactcagccaaaattatttatttaatgttatctatggctgttcccacatttcattgtcagagctgagtagttgcaacagagtgtgtgtagtacacaaaggcaaaaataagtatcatgtagcctttacagaaaaaaagtgctgaccctgctatacataatatgccaagcacagtcttcaagtaagtgagtaacagttttagactttttcaaactaaaatacgtagtcaccacttttttattattatttcactttaagttctgggacacatgtgcagaatatgcaggtttgttacttaggtatacacgtgccatggtggtttgctgcacctatcaacctgtcatctacattaggtatttctcctaatgctatccctccccgagccccccaccccctggcagtcagcagtgtgtgatgttcctctccctgtgcccatatgttctcgttgttcaacttctacttatataagagtgagaacatgcggtgtttggttttctgttcctgaggtaccactttgtaagtatctaatatatgttaaacaccagactagatgatttactcacatgaactgcgtctcaaaaccattcttcctggtagatatcaaaattccccattttactgataaatatagagattaaggaaggttaggtgcctttccaaggccccataattttgacatttttgaatcaaatttaaactcagttctgtcgaacacaaaatacattacttttttacagtctggtagcatattacaaaaatgaatactagaatcaaatgaagtctaattgtgaggaatttgttgcagaaatcccaccaattcatgatctgtatctaaattaggtagaagggtaatagagagaaattccagagtttagtatggaaaataagtagatcatctagaatgacttctttattcttgacagattgggtgactaagtcagggaagcaacttcccactttctgttttgggtggttagaagaaagatatattcatttctagatacagggaatctaggacagcaagcaggcccacaagcagggtagcattgatgagtgatgttttgtacagtgtgtatattttcaaatgtctgaattagatccatgtgaagatagacaccagggtgttgcctgcaaaaggctaaaactcagagacatgggatacaagttggagattattcagctttagcatagagttaagaagtagcagaagctgacttttatacaattttaggaatgagtataaaatattttatatatcttatagaaatccattagatttagaaagaggcactggattatggtgcttaagaacactaagggccaggcacggtggctgacacctgtaatcccagcgctttgggaggcctaggtgagaggaggtttgagaccaacctgggcaacgtaggaacatagactccatctctacaaaataaataaacaaataaataaatagaaagaaagcgaaaaaataaaactctgtaaaagctgacaacctgagttcaaatcttacttctactaattttctataaccttatgcaaattactagatttacttgtgctttggaaacctcttctataaaatgtctattactaacactaaaagcacttaccttgtagggttgttaggaggattaaatgagttaatacatacaaaagttttaaaataatacttgtatatggtaagcaccatatagatgtttacctgtatttattaatttaaaaatattttttacatttcatatatttaattaggatttttcaacatagttttctcactacctcatataccaatgtttattctaaactgaaaagggatgtataagggtctataaaagagggctgacctgaatccaatattttctttatacctgtatatcagccataagcctggagcattgtgtgaggttaaaatgaatgaagtgctttaaagatatgtttgccacaatagagcttccttacatgtctatgaggaatattataaccaagcatactctcacagagtttaaactcaaatcatgaacatttaaattaagtttttccttattttgcctatacccatttttatctttcattgtcatttttgtttgacagagtatgatgagatagagtatttttatttggaaagtcctcagcaagacaaattagccaaaagcaataatggttcagattaaacagagtggaattgatctaatccccaggctcaactaaggaacagtcactatctgggtgtttgattttagactatagataagttgagatgttgtaatatttatggaggaattggctatgtcagttatgggatgaagactagtagtacaagtaccatcagtagtcattcttttttttttttaactttttactaaactaatacagttagatatttccactctatcatgattatattttttatgacagaaagaaaacagttccatgtttttataaatagtctctgcagagatttcagatgatgttattggtatcttggtttggcagtgtccgaaaaattgtgattgcctttaaagtgtttgtgctacttttagttaagtaaacccacactgtgtaagacccaggctggttccaagtaatatcaaggtttctatgcacataatagtttacaaagaacttaagtttaaagactatggattaaaaacaaacaacaacaacaacaaaagtgctttacagaaccaaacaaaccctctcttgatgggaatgtcaaaaaggacacatgagtcaactggaaactcttaaaggccaaagctgggacaatttgagcaatccaaaaaaatagtatgaattaatatccaaagtataaaataaatgtccttgagtccctactgatacaaataaataattgaataagtaaatgagggagaagggaaaatctcctatgcagaatttcaaataaattatgtagctgttcaacgcttaaagaaatacaacataactcttctgtgtgttgtacatagtgactttcttcccaagaatagagtgtggagaaggatggggttggggagagagaaaaagagggggagagagagagagagaaactttacagcctatgttcagtgatcaaggtcatcatcaacagtgataaatcatgctgatactatgtacgcctaatatgatgctttgagaatggcaccttaactcccaaaaacccaaaattcataaaattaattattaaaacatcagaaaatttcaagatactctacagaaaatgtgattagtgctccaagaagctttcaaaatcatcaaaaacaatgagtggctgagaaactgtcacagacaagaggatcctaaggagatgtgttgaataatgtaaaatgggatcttgaaaaaaaagtaacattagagaaaattagggaaatctgaataaagtatgaactttaatgaatattaatctatcaatatagattcactaagttttacaaatataccttaatataaggtatcgataatactagaaaccaagtgtggggtgtatgggaattgtatgtactatcttttaaatttttctgaaatctaaacctattgttaaaaagcttataaaacaaactaaacagccagtcatatgatttaaaagcaatcatggggaccctgattacaatttaacattctccttccttactagcttagtattcatattagtctcttcagctatgcaactaatttgtttttcctaaatagcaaaaaggaaaattgaacattaaccgtttcgacgactgttttactgaacgtttttcattatttgcacagtttagtttatatgttagtgtttttttttttaacttctgaaataagatttttttttactacgtatttcctatccccttaattcattgttgtagtagccaccaaaatctcggagttttccaaagtattttacattattcagtgtattttctgtttaacagaaatacattattcaagtattacattacattattcaatattatattattcaaatattttctgtttaacagaaaaataaagataagaatattacttgtaatttgattatttaaaatgtctagagaagagaagaaagctataaaggggaaatactcactaaaaaccgtattctaaaaatattcccagagatttaaaaccctggaatccctttgtaataaattatatttattttgagtccctaactgtgttttcatgaatattcacaatgttattagcttatttatctcctttttgggtcaaatgcatttactgactgtagttgcatgcttatggtgacagaggcaatactttaacactacctgcagagtcgcacattatatgttaacacttctaaaatatatttcctataccaactgttccaacttttgaacacattgtttcagtaattgcatggtagtattgcctgacaaaccaatactcccattttgttttaatttatacagaagtgtctttacaattaactaaatacttgttacattttcccacatcataaaattagggggaaaatagaaaaatgaaattactgattcttgtaatactataatcacaatcatgaaagtattctaaagagcaaagctgtgaatcttgatttctattaggtactgattaaataagtagtatagacagtgtgggaagcataaaaacacaaaaacataaaaaaaaaaaaaaacttgattctgaggagagtttccaaagagggagctactcttgtgagcataaaaattaaaacttttttttcctgaataaatgcaaagagaagttcatagggacataacatggttaataaaggtagatcatggtatatctttcatgaagagaaggaagataacgttcaattttcttctcaccaagatttgaaaatatgtagtaaagccatttcttgttcatgtcgtgatgattttcctgaacaatttcttacaaaagcaaatccttttagtatttcctaagcaatgacactttaaaattaactaagaaaattaaatttgaggtaaaattcaagatacaacatttgctacttatatttaatgtttaatttgtgtttctaatgcttttaaaattaacatctaaaaaactttttaaaaaatctaaaagtatatgtcctaatttgagtttttatcactctttaatatctacagtaaaataactttctttataacacacatatctcaaatttctcttcaaatattatgcattgaggtatcatgtaagacttccagattttattatggatgaaaatgggatctacttgtacttgaaaaagtaatgaataaacaatactctgattttttatctataaaactgaatcactacaaaggctagggataagccagtgatgtgcctagcgaagtattaagtgtatataaatcatctattgttaaaattactcactttctaagtgtttccactttaagttcaagaaaactaaccattgttagatcatgggatgcatttgaagagctttaaacacctcactaccacctttagtgtacactctaaccccataaagagctcattattgtcttccttttctcttattcctgtggcctttatttataaatctagctactttatttctgctaactttacataataggtccctattgctaagacctcacagcatttcacaattacttgattacacttaaaagttgtgcttcattccactgagagcactttgcaaaccctaacacagcagcctggcacatattgggtaaatgaatgaatatatgaatacatgaatacatgattattccatttaataccaatttgatattggcctccatggttccacaggtatcatcatgaaaatgtatagcaccactatatcttgccaaaaagaataaagttaatccaaaagagttgccaaatttacccagagaaaaacactttttaatttcttctctttaaaacgttataacatcataatgttctaatggagcaagttttctttgggactgaatgttaaatattatgttttgggaagcagaattagtaatctcttaaagtagagtactcggtcatttccatccatgattctatgatcacacaacttgatagtgaaaataactttgccaatcctgagtgtgaaatgctacgtttatgaaatataaaacgcatttagggcaattaaatatatcagcattttctttactgaaaactgatcaatgcagaatatttaggaaattacatttagacaaggcaaggctatgcagacatacattacatgattttgttcaatgtctccatttttatctcacctagctctaaaaggtggttaggcagatattagcaggttgactgaaaaatcaagtacttagtgaccttgtttaatttttgttcttatgcttcacatttcaaaaataataaaagccttaattttgtcatgaaatgcagcaatggtggccgagtaacggtaaaagaaatacaatgagaaagaagaaatgagcaggtgagatttattctgtattaaatggctactgtcctggtcctatctacacaaggaatagcaatttcatgctattgttcatacaatgcatggaagcagactttgtcaaaaggcagagagtgggggtgcatggaggataaggcttcaataagatttgctgtaattctcccctttgattacctcccccaaaatgagtatcaaaatgttctaccttccatcttggcagaaagggaagaagacatagggcaggtggtttttgtaactactagcagcaatgatgacaggaaaataaaagttttcattactgagaatgaagtgaaatatctatttaaggaccatcttattttcttaaaatatgtccattaatttatacattcatttattgtacaagcatttttaaacacaatacctatgtgctgattcactgaagggcatatggaaatcaaaagcaaagtcttgttcttcttcttcagtagatacaaatagaaatcagccaaacaacagataaagaatgcaaatgagcttcataaggaaatagggactagagtaaagtgtaaagtggaagagatggaacctgagaaatcatctcagaaagctgagtttggagaaaagtcctaggaaaaaagtagttatttttgaatactatgagtaagagattattgatataaccatctattttttcaataggtaatagaatacaagctggtcttgtagaatatgaagagaagagttcattagttttgggattctgacttattcccaaatatccagatgtttttcaaagtgatataaatattagatatatttaatggaacaaaataaaaataattttatgtatgaaagtgaagcattctgaatttgaattcagatgatcaaattgtatatgtgttatcctattctgtttaaaaaatgaagtcatagttcctatatatttttaaaatattatctccaatagaaataaatagaaaatgtttaattttcatttttattttgatctttcctataataaacctgtactgctttcaactaagaaaataattttttaaaactctacatttagaattgttctctgactatcacaaagtctgttagagtaactatgaagatgattcatagattctgctgcctttggctcttctttctctttgacttggcctttaacattgctttattcatattgagctattttactcctaatttcttcatacagttatgtctgattctactgtgaaaaagcattccaaattgcttaataccaattaatttgtgacattaacaagaggccaaggaacccagtcacagtccttatttatttactgcatttttgtgagtttttgttaatcagtgagtatatttaagttatatagttattaatagagataactctccttattagacaaaagctcacaaaaactaccttatcaagaagaagatattatgcaaatgcaggtggaataaatctaattttccatttttatgcacaagttatttgcagccccagtttattgtaaatgttgcagcacctacctaaccatatttttaaggtacatatttcatatgggtagcaaggggctaataataatgaaaaatttggacatatgaagtattcttttctgttactagccttgtcaccaaccgaacacacagccttgtttgtagctcactttcccattttcaacctattggcaataaaatatcaggtgttaaaaaatgaataaaatgttgtaaagtacttcagtggataatgtttcatatatttaataatggcaggcttattagtatcactagacataggattaaaatgtaattattatcataatcagttttgttataatatttagattctttttctaattgaaaactagatgcatactaactcattctcctgacattttgctgtcttcaacaataaatatttcaaaattggatcatattcactccagcagcatttaagcactacttatcaatatttttcaggatacttacatatatgaaagcccattcttgtgtctttatatccaagatgtttgatgttagcatttgagttaattcaggaatcctccagaagatccatctgtttcctattcagtgttgaaatattggtttgaaaagctgtttactaaggataaaagtaggaatcatctctccaggaaagaagaaatactctcatttatttttgtttgtgagatagcctctagaaaggatctaattaatgaagtatataaggatgaagtgtgttgaaactttctttcccttttaaaataaagatacttcgatacactgagggaatgtataaacgtcgcatgaagatgtataggatgttttaataggacacaggaagaatttttcttctatataataaatgaaaatgtcaacttcaagcactagctctataactcttactttaaaatcctttaaaaatgttaatgattgcgtatttataatctttgagttttgatttttaagttttaatttcctgagtgttttttataaaaccaaatacatatcaaaggtatttggggtttttttttttttttttgcttgttttatgacagtgtgcttgctttctaatcaagattaaaacaagccatactgatgcagattaaattatctagaggttgagttttgttaagtttctttcacttcttacatggactgaagtgatatatatcttcctgtcaaatgatctttatatcttgataatgttttcattgcataaatgtttctatgaatagtagtaatatataataaaaatacttgtcatttcttcagtgcttagtatctcctaagcactgaataaaattatttatatgtaatcttcacaatagtcttacgaggtaagtgttactgtttctgttttgaagatgaggaaatttgtaaatccgaaagtttaagaagtgcacctaaatttacactgctaccaagtggtcaaatcacaattaaaatttagttctgtttgattacaaaagccacagacatatctaatgacatgttctattagttcaatatgatgcttatattgataagatttcaacatatgaagttattggccattggttaatttgatcatttaacacagatatatagcatttgagtaactctactggatctcattcaactatcattagatccaaacaacgttgaaatttcgttgctagaaattatagtgcatgagctatataaaatgtatgatatataagaaatgattaatgcataggattgtaggtagagtaagaatgagaataaataatctgaaacaagttgtgatggatttataggacattgtagtgaactgcttaagcaccataataaatgaaggcaataaataattatatgtgtgtatatatatatatgtgtgtgtgtgtatgtgtgtgtgtgtatacatacacccatatgcatgtatattaataaactcatatggttttctggcccccagtgactgaccccattcataactctgagttctatactgttttgtgcaacatttccagaagagtcaatattccatcccagactgggaatccaccaggtattcacataggaacttactaagtgccaagttaaatcacacaggaacttattaaatgccacgttaaatgattacaaaattgatatgaattggaggtaaaaattaaaagccatgttgacttttaatttttttcttttaatttaaaaagtgagttttgtgaatagacttaagttgtgcactctacaactcagattagtgtggttcctagatgaaggttacaaaaaccaaacaaattgagctatgttttggtctgcaagataaaaatatatatgaaatactagaaatgttttgtccttttactatcaaatgttaataaagattctaaatgtgtgtaataagtttattataatacaaaaaagagaacccgattttatctcaaatacatattaatcatgaaatgtttactacgtacctactacatttaaaatattaaatactatcactatcttttatctatatatgcattctatatatccctgtaggtatacactactctctagaattcattatacttttgaagatgaaatacatctgttttcacagaggaaaaatgaggagtaaaaaaataaaaaatgcgaaagttatccccaagtgaagaatttcctctttgtcatcagtgactgagtctttcccagaagatagcatgtttattttctttaaaatgtttttatgttgcccgggaattcttcgttatagagcatctggcattccaataattatttccaaataacacagtcatttggactccgttagatttagcctgtgaatctgcttttggcattacctgtggtttattttggaaaaagctaataagtcaacaacaaaaaattagctgtatcttccaatatcttctggcttcattaactgcccactttacagctgtcacccagaagtgtatacgaatctctgttgaacacatacatattcttattctgtcctcttttctagaagattgtgctttattattgtattatttatataaaacagtactccctttataagtccttctgatttacagagatttcttcaaggcctagtgttcctagaatgtggtcactgaatccagatatgctctaagaagagttactgaaatttctcaaattttactcatagtgttacctttctccattaccagctgaagactcctgaatttttcattcccttttcctacagaaaagactccatgcctacatgcccctgataaattcactgatacaactacagaggtgattgtgtgtatactcaaattcttacagtattgaatatatttattctgtacttggttggttattagaatcctgattcacttaagcaagtattaggcctaatttttttacttttgtcaggtttgcttgttctagagcaactcatttttgttgataaacagcttaccaaaaagaaatgcagttgtttataaaaccatgagacagcatatttagaggttagaaaggggaaggactctttaggacctgggaagtgtactttagcaggaaaacagaatgcagaaagaggagcaggggcgatgggtttgaaaaacagtttttaattatttttgaacagagactgtggagctggtactgtgctagatgatgagattacatagtcctgatcctcaagtgtcaggatcctcacaatctaataaggaatacagaccagtgttatacactagaataacagaaaactacccaactagagcagagtgttgggatagctcagacaagctgaaccatcaccagggtggagagagacgccatcaaacttttccaaagagaagactcttaaaaatatatattaatcatttgttaaatatttaataactgagctctgttggcttatggggattaacataaagagtaatgataatagcaaagtttattttattactgtgtggctagtgctgctatcaataaaagagggactagatacagaagggggaacaaatctgatgagagcagttggttgggtttcacaagtgtgcataggtggaaatgcatcctacatattgggagatgttgataatgaggctgcctgtattatacagaactttataaaaggcacacttttagaacttaatctcacatgtaagcaattaattttattaaaatatgttccctactctattatatgtataacagtcttcataggtgggtttaagtcatttaaaatattatctaataagaattaaaaattcatagatggtagcttaatagctttcttattcttttacttggcagatatatcagcatttggaaacaccataggaaactgcccatttaagacattaactaagtcactctcactatctcttttacaaaataagaccaattccctctcattaattaaatctcttgatttaaaattcccattttctaaatttgtatgtggtgtcgtcagaaactatttttctctcttgggtagaagtcacttttaaacaatatacctactaatgatgtatcaacattcttacgagtgaattctatctatcttttaatttttttcttgcctgtggaagacttctacactctacttaactgacctttttaatgaccaaaagacagaggtgttcttcctatcataatcaaatgttgatttatttgtgtctggtcttttttttttttttaagctataaggatatggattaagtatgcagactctagtgtaatcagagtagtttgaagttcacaaagtgtaatcctgtgctatatatctcaattaatcttgcagactatggctaatcacattcccaccaggcaggatcacacaactcacagagccaggattattaaaatccatatttcacgttaatagccatgtgggtgagattagtttctaagtggtaatgcacctgccataaattcctcctctctgttatcttctgaaatactgctctgtcagaagatgaaaagtacatgatgtgcattcagaatcagtttatggtctttttttttctattggtcaagtaaaatatatcttcatccctcactgatttcaaatgcactggagaagataaacactatttaatattcctctgtgacatgtcataaaggccaaagtgttcaagtttcattacaaatcttagtaagtcttttcattttaacatattgtcctaaactaacctaaaaaaataataattaacaaatacaccttcaaagaactattccccatttgattatctaaattaattttccttccaacattattgcaaattaaaagctcctgaatagcctacacatttacttgtgcattaattcgtaaaaaaatgaattacactggagtgaagataataacaaactaaaaatcaaaatatctaggtcttagcccaggctctgttgttaattgaataatttagagatagccacatagtctcattgtttttcacaggacttgagtcaaatttacatttggctttgttgtcttcaatttgaaagctaattctctagaagaaaatgaagaatgaaacttaatctttattaacctgagtaagaaatatgcttatatgagagataccagaaaacatttattctccttgttaaaatgtttagccttcccatataatctctcagcaatcatacctgaaatatgctctattataatatctaatataaaataatatttttaaatgtccccctttttgtccaaaatgggaaacctattttatcattattaatagaataataacacacataaatactttaaaaggtataaagcacttccatgagtgcttttaagagaggttttgaaatgtgtcctggataggtctgcagatattattaatatacttacttgatcactaaattgctctgtatctttgttttaaaaagttgaaatatggacatgagcgaccttcagaggtcaaaccttaaaagccagagaacaacttgtgacctagaccactattcttgatgatgatcttcccctggcttggtataaaattcacatttttcctcctatgggaaatacagggaaaatattacagctatgaaaaataaatcctgctgcagaatttaaattttcagaccttttaagaaaatagatgttaatgctttctgttgagttgctatagtttcacattcatatattagagatgcattaaataagtttacctgtttaataatttaaatgctttaaatacatgcatttgacgtttgcatgacaaagacaaatacattcataccactttgtaatgtcacagtcaatcagtcaacatgaaactggaagattcaaagaccaaagtaaataaaaatataaaagtcgacagatgcattaactttcccttctgtacatattgtttataataagatactttcaaaactcaaattagatatatgaaaaaggcaccattctgatctactagtgcctaagcattgccaagcagtcaaatctaactaaacgttctatcctcctccatttttcttcgatgcctactgatgcctactttcttttctcactgtggggtgaatgcatctactacttgcagctaaaggacaaagagtcccagcctcccttctgccagagacaccaacattcttacactcaatggggctgaaaatcctagagtcatttttgatcatccttctcattttctttattcagagttacgaatcctgtccaacttggcttatatcctaagtttgtccatcctctctttcccttatactagtcctgtcccctctacacagtttagaatttactgtcagatttgataagaatctcctcactaatacctatgtatccattcacattcatcttccttgctaatccattggttttgttttccaaacgcaaagctgtttttgccatctcttcctcttcacatttttactgttgtctaaaattttctaaatgacatgcaaatttcttatgtagctaagctcattagcacatcatctttctggcacaagattactacaacattctgagctactttatttgtttaaaatgttccctgtgaattcctttcatgcaactatgatggcaactttgttcttaacaaaatgtctttgtttaaatgaacgtaagattcagatcacacacttttttttctaaaatattaatcaacatctactgtatgattgccactaagttaaaagaattgaacaatattactaaaattaggttaaataatgtcaagattttgcactgaattgttcagtggaactttacattgaaagtctcagtctgtttaagtcatgtgtctgaactctagagagtgaaattgtttaagaattacataaataccccatgtgtgcacatgcacgtaattacatttgtaaaaataaagacacatatgcatatatacatatgtgcataattgtatatataaacctcaccagaacaacagatatatttctggaaaatagtttataaatttcacatttctaaattgggtagtaattccatcaaactagaacaattgcaaattaacaggtttttaataagtaaataatgccatctagtttatgttttgggtaaattttaatagaagtttgaaaaggattcattaaggtatataataagttatttgagtttgcattcattggtgttttattaaggcaaagatattgaggtaattcaagccattgagggttttccctgagaaaaggaattagaggagagcccttaggtttagagttttaaattaaaaaaagatctaatgaaagttcattgctgaaaagttgatttttatttggtgtttgagtttatatcagtgattaaagtacatttgtgatttctgcataagctgtgtctttacacagttcattctgcctgccttcctcttccagaaatgtttcctgccatattctgcttttattgtgctattagtatttttttgttctaaaagcaaagaacgcacctgctaggcagagttgctaattttatccctgaactcactcatagatgccacaagcacttcccagtcgatacggttccatgtatcaggcaccttctatagtcccattctagggtcaccgctgttgttgtatttatcatcactgcccagcatctttaccctgcgtcaagaatcctatgcactgcacgttcctccatagaaccttgccccattcattcctcttgtcataacactccaggatataagtgaattcagactttctacaaacccttttgttctaaataatctcataaaactactacagccatactgttgtagcattaagtgagttaagggtgtgtgtctgttgttgttgtcgttcctgttgttgcatctgaatctgttggaaacaaagggaggatggtaagactgaatagttcatgcaaggggcatggcccctactgcagagttcctgctctagattgtgtgtgtgtgtgtgtgcatgtgtgtgtgtgtgtgtgtgtgtgtgtgtgtgtgtatgtatgtatgtatgtttgagtaataaaggtccacatcccaaatctgacatttttttttagatacgcaatctcacatgttggggagtaaaaaaatgactacacagttcaatattaaaggactattaatgcctccaaattggtgagatattctgcacatttgaaagggaatagggatgttcatcaaaggatgagagaaaaggcagagattaataattttgaatagttataaaatcctttagaagtaaattttatgtatcaacttagttactaaaacatatttagaacataactaaaagataagcaggaatttggagttgctacgcaaaatgcagaatgcccaattaaatttgattttcaaatatgcaaaggaaaattttttagtattaatgtgtcccacatattgcatactgcatacttattcaaaggagtactttattcatcagttctggagattctaattgtacataacctatataataacttctaaatttcccgacagaatcgtttcaaaacatttttgattgttccttcaccttacaaaaaaatccctgattttaaaaaagtcaccctttaataaacttttgtgtagaaaggtaatgttggtcaaagcaactctatagagatagatgatatttataaatttcctgtcttaccttttagaatttctgtagtatattcttttagagaaaagtaacacataactgttaagtggtgatgtttttggtgattgtattgttattcatggtttaatcacagctatattacctaacttacttttacttagaatttagcaaaagtataataaaataatattagttttataaagtatttttcttccagactgaatattttttactctcttatacatcgtttgaagacacagttttttttattatactttaagttctggggtacatatgcataatgtgcaggttcgttacataggtatacacgtgtcatggtggtttgctgcactcatcagcccatcattcacgttaggtatttctcctaatgctctccctcccctagccccccaccccttgacaggtgctggtgtgtgatgtccccttccctgtgtccatgtattctcactgttaaactcccacttatgagtgagaccatgcggtgtttggtttactgttcttgtgttagtttgctgagaatcatggtttccagctttttccatgtccctgcaaaggacatgaactcatccttttttaaggctgcgtagtatcccatgttgtgtctgtgccacattttctgtatccagtctatcattgatgggtatttgggctggttccaagtctttgctattgtgaatcgtgctgcagtaaacatatgtgtgcatgtgtctttatggtaaaatgatttataatcctttgggtatatacccagtaatataatggctaggtcaaatggtacttctagttccacattcttaaggaatcaccacactgtcttccacaatggttgaactaatttacactcccaccaacagtgtaaagcgttcgtatttctccacgtcctctccagcatctgttgtttcttgactttaatgatcgccattctaactggtgtaagatggtatctcattgtggttttcatttgcatttctctaatgaccagtgatgatgagcattctttcatatgtttttttggccacaaaatgtattctttagagaagtgtctgttcacatcctttgcccactttttgatggggttgtttttgttttcttgtaaatttgattaagttctttgtagattctggatattagccctttgtcagacggatagactgcaaaaattttctcccattctgtaggttgcctgttcactttgctgatagtttcttttgctgtgcagtagctctttagtttaattatatcccatttgtctattttggcttttgttgtcattgtttttggtgttttagtcatgaagtctttgcccatgcctacatcctgaatggtattgcctaggttttcttctagggtttttatggttttaggttttaggtttaagtctttaatccattttgagttaatttttgtataaggtgtaaggaagggatctagtttcagctttctgcatatggctagccagtttccccaatactatttattaaatagagaatcctttccctattgcttgtttttgtcacgttttttaaagatcagatggttcttgatgtgtggtattatttctgaggtctctgttctgctccatcggtctatatatctgttgtggtactagtaccgtgctgttttggttactgtagccttgtagtatagtttgaagtaaggtagagtgatgtctccagctttttctttttgcttaggattgtcttggctaggtgggctcttttttttgtttccaaatgaaattaaagtagttttgtttttgccaattctgtgaagaaagtcagccgtagtttgatggggatagcattgaatctataaattacttcgggcaatgttgccattttcacggtattacttttatcctatccatgagcatggaatggctttccatttgtttgtgtcctctttgatttccttgagcagtggtttgtagttctccttgaagaggtccttcacatcccttgtaagtcggattcctaggcattttattatctttgtagcaattgtgaatgggagttcattcatgatttggctctctgttttttgttgttgttgttgttattggtgtataggaaggcttgtgatttttgcacattgactttgtatcctgagactttgctgaagttgcttatcagcttaaggagattttgggttcagatgatggggttttctaaatacacaatcacgtcatctgcaaacagagagaatttgacttcctcttttcctaattgaataccctttatttctttgtcttatctgattgccctagccagaatttccttaagcccatcctctatgcaagatgctggggtaaattgcagaaaaaattgttggagtggaaattgctttcagtatcataaatatgtatgtatgtttacaaatagaaatatggaacccaatgtgctgttaactattaagacttcgtctcttttttaccaggcatatacattttcggaactaggaaaacaatagaaatacttgcacttttaagtttgaatgtggtcaaacctggggcattttattgtagaaagtaaattgattttttcccttcatttaaagaatgcattagtgaagaaagaatccttgctgtttgtgtatgttataaaggaacaaaagctggagaattaaattatctgcatagctgagcaaaaaatagtttttctgtgtttgataagagtcagatattcttaatagaattcttagatttcgtgagcagaatggggaccatgcatggcattgaaattttccgcagacacaaaataacttgtattacagctgaactatagctctttggggacttgtttctttttattcatagaggttaagaatggtgcattatattatccatttaaagatgctacttgcatttctgaacttcaaatacaatcatgattttaatattatcaagtaaatatattttaatatggctacacagaaatgatttcattaacatttatagaacccttggtatcagtagctctgtagtattttaccaagtggaagcgttatatttcattgtatatttcttgtgttcctctataaatcacctgtgcatatacatcccagaaaaaatgagtatagcaagctacatagcattgaattaagctttaattttcactggctgcttacagaagaaaataacttgtatagcatttagaattttgagtaggaccatcctcatcatctcatgctgtgtattacaaaaggagtctacctaatgaagcatagggtctggatggtttaacttattttttggataagagaaagaagaaagaaaataatacttagttgctgccttccaaggattctgtgccatgctggttttttaacatgcattatcttaagaatatttctcatttaaatatagattttattatacatttttaaagacaaagaaatgaaggttcacagttacagcgaatagcctaaggtcacaccaaggaataacgaggttcaagccaaaagccaagtaccttttaatttacaaatcccatgttcaccatattctgcctaattgaaaagggattatcatttgtttgatggaaatataattatacatactattaatatatcaaaccacttagcctgtttgaacttcagctcatgtggaaaaaaaaaaaaccttgaagctgtctaacttctagagactatttttggtaatgtaaagcactattgagagtgcttaaacgtaagggttgtggtgttggaaagctagcatttgaatatgcgctctagtattaattactctttttatgccttcgttttctcattggtaaactagagctaataatagtacctaacttaggagtgtgttaggaatgaacaagatgatgtaaaacactttttgtgacgtgtaataaatgttcaataaatatttgctagctgatttgtataggaaattttatttgtaatagcagaggaaaggaaagagcattagagaagaagctgaataaaagagagtgaaatagaataactcttggagtttcgcaattacatagtgaaagtctgtagtgggagaacttatttttttaagacattttacataaaatctgagtaacagcagcagaactcctctaaatctagctcacagaggcaatggtgaggccatccttcccacctcttcatggaatctagagccttccagtactctgaagataggcaacttgagaccaccaagagagcagaatagttgacatctttctttagtggtggcattgatgaggctccttcaacattcgagcaggccatgaatgtttgccaggggaatgagaggaagaacaggaaacagagtgaaccccaaagtctgttttatggcctgtatagtttcaagagcctcacatactccccaaaatgtctaggatgatgttgcaaggagtaataaacaaaaagaaagatcaggaattttttatttatcatttataacatggtatatcatcatctctttatcctgggaagatctaaaagcatttgatagattttaatatttatgttatgtttatacacaaatttacataaatagatatacttgactcatgatctctttattcttcatattcatgaattattcctttccctgccaaaaaaatgtctaatatattgggaaaggaaattgtattaagcaaaggtttatctaaatgacagaaccattgatttccatatattatttttatgttgttagaaataaagaggagagtatatccttagaacaagaatataaatttatttcccaaaataatcaaaaaattattacttttcagctttcgactttagtcatctaatttaaaaaaaagtttggaagattttcttagagaaatgttttcgagatgtgtttgctttcatacttggtatcttacaatttgatagtctattgtaatcactaatatgtctcatattttcttttgttctttctttagttgtgaactcttaggtcagcaataatatcgtgtatccctttgaaccccttaacaattcctgttggagtactgtgcccaaggaaacctctttaaatattaaaaattgataaagatactttccaatttttcttttctcttcttcctagacttcggcatgttaaatcgatgactacttctaacaattctctccttctttattgaagcaacctctcttggcttcaataatattctagcttcttctttgtctcctactcctctgctactcctcagtatcctgaatgagctcgtcttcctctctccacctctggtcagacccttgtctggatgttgacattaatcaccttcttttcatgctgctcccatgcagtcccataagacaactaaccttaacacatcctgcctagtctcatcagcttcaacctctgcctcatccttcatcagtgtattctctatctcaaactacatgcagctcttagaaattgtaataaatctcttaccctcagcatccacagaattaatattgcaaccagcttttgtatgggggtaaggatagagctctcaatatttttaagtaatttgttttaaatagtttaagttctctaactctaaggacataatatattccaagaatatgttagtagaatgcctaaaattgtgttttggatagtcattcattcaacagtgttttaaaacgaaagtattttatgttcaagcattatgctaagtgcagtgtgtgctggagaaaatagaaaatgtttaagatatagtttcatactcaaggagtataccaggggagcaactaagtgaatcaactatgctttcattttctttctttcttttttatttagtagcgttggtgaaattacaattgggcattcagtattccaattgtttttccttttgctttttactctatagaatcggaacccacaaattgtatattgtatatacagtatattttatttgctattttcagatgttttgccaattatttttctgtccttttgtaataatgcttgcaaacctgtagtatttgtagtttcattttttaaccttgctatatctgttgatttgaactttcaagagaatatgttaatccaagattgttactattcttttaaacaaattaaggaaagtcttatatacagtatagattaataatgatcacagacacattgtttctatttaaaatgtcataataaattttcaaaagagttgtacctgcttatagaaagaaaagcgtagggaagttattgctaggagttacgagtgtgcactaccaataaaattctatcagtaatataaaaaaagataaaaaataagagtatagtatttccattgtgtcttttggatggggaagagatgtgtttgcatgtgtgtgtgtttgttcagttttgattgtttaaattttttaattaaacaggtgttccgaatcaagcattttttaatcaacactttttaagccacatttgtgtaattaaatggaggtaaatcagaggtaacatatggatgtctccataatctgtttcaaaaaatgaattatagcaagatgatagaaaaatgtaataccaaaatccaggtcaggtgttcttcaaatgcatatagagggaaaaagtaccataacttacatggcacataaatactttaaatattattctgaacagaatgcttatcaaaaatattcagaatgatacacaattaaaaccttattattcaaagaagattatagttagagaaagtgatttaagttgcatagatccaactcagccatgacaatacttagcacccccctaaaaccttaccacttcgtcctgcaggcgtttcattgcgaatttcaactcaggtttacttcctacattttaattataaattgcctcattctgaaatgccaaactttgctgaagaatatcatataactctccttaatagaattctacttggtcatgccaatacgctctaattggaaccttacacatcttcaggaattatttatttctttttaataacctcactctttatgattgttattctaagccttttgcattgccttctattatgtgttcactaatacatttgttaaaccaaaaatatttgttaatcactcactgtgtcagacactgttctttgcacagtggcaagaaaagcattaaaaatgcactttttgactaacttgttcataatatatattgttatcctacaaatttgtcttagcagcagcataacagatcctgttttcagagattttaattcagtccatctggaagagggtctaggaaaagttcctgagtgattctgatatatggccaatttgggaaccaaatatagacaagtaaaacatgtttgaaacttgaaaaagacacttgggaaacatcagcttggagatgcttcttgtggctctgtgaaagggaaggaaaaactgaaagacagtttaaaggaaaaataaactatgttaggagcacacatctaaattggtcagaaacttgagaagaacagaatatgaggatggtaatctatagcatcaaatgctatagttagcaagatgagagaaaaaaattttagtctctatttactgacatcttactatgtaccaaacactttgctaagtgtcacaaacaccatatttaactctaaaataccacagctaaataggaaaataaagttcatagactttaagtaacttttagaacttaaaggtcctgtagtagtaaggccaggtttcaattctatctactgtactttcaatgtatttattatttgagcattattctcctcaaggattttcaccggtaatagaaagggcttttatattcaagataaagaaaaaatgatagagtgatgttccaagaaaaagtaaggaataatattaagaccataacagagagcgggtgtggtgtctcacgcctgtaattccagcactttgggaggccgaagcaggtggatcacttgaggccaggagttcgagaccacctggacaacattaatgaaaccccatctctagtaagaatacaaaaattagctgggtgtggtggcacacacttctagtcccagctactcaggaggctgatgcatgaaaatcatctgaaccccagagataaaaggttgcagtgagctgagatcacgccactgtactcctgcttgggcgagagaatgagactttgtcgggaaaaagaaaatggaacatagtaacataatagaggatcttatttaagaaggccactctttccttaggagcttatgtgaggatatatgtgtaaaaatgttttcataggagtaaaatgtatgcaaatttaatatatgctttctataaaataatacagtgaagaggaaacaaaggatgaagatgaagcaagattttgaggcaatgaattagaaattcaactaaggtaggattaaggggaaatttatagcactaaatgcttacatcaaaaagttacaaagatctcaaattaacaacctaacttcacaactgaaagaattagagatgcaagaacaaatcaacctcaaagctaccagaacacaagaaataacaaaaatccgagctgaactgaaggaaatcgagacacaaaacttcaagagatcaacaaattcgtgagttgttttttgaaaaaaataataggccactagctaaactaattgaaaagaaaagagagactatctaaataaacacatttagaaatgacaaaggaaatgttattactgaccctacagaaataaaagcacccatcagaaactactatgaacacctctacacacacaaactagaaaacctagaagatattgataaattactggacacatacactctcctaagactgagctaggtagaaatcaattccctgaatagacccaataacaagttgcaaaattagtaataaatagcctaccgacaacaacaaaaaaaaccctgggacctgatgagttcatagctgaattctaccagatgtacaaagaagatctggtactatagaaactatttcaaaaaattgaggaggagggactcctccactctatctatgaggccagcatcatcttgctaccaaaacctggcagagccatagcaacaacaacaaagaaagacttcaggccaatatccttggtaaacttcaatgcaaaaatcctcaacaaaatacttgcaaaccaaatctagcagcaccataatcaagtaggcttccccctaggatgcaaagttggctcaacatatttaaatcagtaaatatgattcattacataaacagaactaaagacaaaaaacacatgattatttcaatagatgtagaaaatgcttttgataaaattcatcatcacttcatgttaaaaactctcaataaactaggtattgaaagaacgtaactcaaaaagccttctatgacaaacccctggccaacattatactgaatgggcaaaagttggaagcattccccttgaaaatctgtacaagacaaggatgccctctcttaccactcctattcaacatagtattggacatcctagacagatcaatcaggcaagacaaataaaggaatcgaaatgggaagagaggaagccaaactatttcattttgcaggtgacatgattctatagcaggaaaacccagtagtcttggacaaaagctccttcagtggataaacttcagcaaagttgcaagataaaaaatgaatgtgctgaagttattaacattcctatataccaacaaaaccaaaaggcaaaccaaagggcatatcagagaagcaatcccattcacaattgccacaaaaagaatgaaatacttaggtatacatctaaccagggtgaaagatctctacaacgagaattaaaatagactcctcaaagaagacaaaaacaaatggaaaaacatcctattttcatggaaaggaataatcagtatcattaaaatggccgtactgcccaaagcaatttacagattcaatgctactcctgtcaaattaccatcagaattcttcacagaactagagaaaattattttaaaattcatatggaaccaaaaagagcccgagtagccaacgccttcctaagcaaaagggacaaagcttttggcatcatgctattctacttcaaaatagactacaaggctacagtaatcaaaacaacatggtagtggtggaaaaacaggcacatagagcaacagaataaatagaccagaaataaggccacacatatatgtccatctgatcttttacaaaactgacaaaaacaagcaatggggaaaagaccccctattgaataaatggtgcttggatgactggctagccatatgcagaagatggaagctggaccccttccttacaccatatacagaagtcaactctagttggattaaagacttaaatgtaaaaccccaagctataaaaaccctggaagacaacctaggcagtaccatcctgggcataggaaccaacaaagatttcatgatgaagacaccaaaagcaatcgtaacaaaagtaaaaattgacaagcgggatctacttaaacttaagagtttctgcaaaacaaaagaaactatcaacagagtaaatagacaacctacagaatgggaggaaatatttctaaactatgcctctgacaaaggtccaatatccagcattgataaggaacttgaacacatttacaaaagaaaaacatacaaccccatttaaaaagtgggcaaacaacatgaacaaacacttctcaaaggaagacatacatgtagccaacaaacatatggaaaaaagctcaatgtcactgatagttagataaatgcaaatcaaaaccacaatgagatagcatctcgcacctgtcagaatggctattcttaaaaagctaataacagatgctggtggggttgctgagaaaaggggacacttgtacactgttggtgggaatgtaaattagttcacccattgtgggaaagcagtatagcaattcctgaaagagctaaaagtggaactatcattcaatccagcaatcccattactgatatataccatgacaaatataaatcattaatccataaagatatatgcatgtgaatgttcactgcagtattattgaaagtagcaaagatgtggaatcaacctaaatttccatcagtgacagattacataaagaaaatgtggtacatatacactgtggaatgctatgcagccataacaaggaatgagatcatgtcttttgcaggaatgggaatggagctggaggcaattattcttagaaaatgaatgcaggacagaaaaccaaataccacttgttctcacttgtgagtgggagctaaatgatgagaacttatgaacacaaagacgaaaatagacactggggtctacttcttggggagggtgaaaggagggagaggagcagaaaacataactactgggtactgtgcttaatacctgggtaattaaataatatctacaacaaatccctgtgacacaagttttcctatataaccttcacatgtaccccccaaacctaaaataaaagttaaacaaaaataatttaaggaagttctagtcaaccctaatcttctaaaaaatacaaggtacagtcaaattgctaagatttgtcagagaattttgctagagtattctgggtgttcctggtaagaccctgtcttttactgagcccacaactctccccatatggggagatatagcccatatgggttatatattatgtatatggggcctccactcccaaccccatatacataatgtatacctcaactctccgggaatcccagtcgtgtcatcaatcatccttgcactctcatttcctcagacacttatttccattgtcacttcatagatgttgtcattaccaataagttaaaccagtttccaacaacactatttttttttcagctcatgcactctagtgtttcaacaccagctatatttagactccatggggatctacaatctactgttcctaacatgttttctctttacctattgttatttctatgctcatacttactcccttaattaggaattctatgacctggtatataattgattctgtgcatattcctcaactcccttcctcccttcctccctttattatcgattccactttgggaaaaaaaaatccacattagccaaacttgtatttcttccatggttcctctcggacaaatgtacatggctggagaaaaaaattagaccatgctgcctggtctcattaaatgtaagatccctactgcaagtggccctttagtgtttctaggcaagcacactatattcccctagtacttttcatctcccattctcctatatgatcatttaatgcctttgcatctctactccaacctccagatgactctgcttcctatttccctgataaaatagaaaccaacgtagacaattttaataaacttctaccaccacacctatcttgcatttatactctgttttatttttctccaaagcatttactgccatctaatatgttacatattttccttaagaatttggtttattgtgcattcttccccctcctctgccactgtaagtttgaaaataacaatgttattttctattttgttatttttgtctttgcagtacctgcagcaatgcctgataagtaaaggatgcagtaaattgtgtgtgtgtatgtgtgtgtgcatgcgtgtgcatgcgcacgcgtgtgtgttttgtttaaataatgttatgggatagatcttataatcttccttttacaaatgatgaaactgaggctcagataattttagtcacattctaagggccagttagcaatcaaatagtggagccagaattccagcccaagtcagtctaatctaaagcttaagcatgtaccaaattaagtttaaactattcattctactagtctgaattcttgggtttgtgtctcagaatatcttcccaggcttatcttgttctaccttattacacacacgtactcttcaatcaaactagaaacttcctgtctttcagcatgtccctagctggtcctgcacagtcattcatgtgaacaggctcctcttcagtgcctggagcatgttccgtcttatgcctattgaaatcctgcttgttcttcaggatctatatactctctctttgtttttttctaagacatttcaagtgggattttctgttctctgcttttaactcttaccaatgtcacacatctatcttagagcacttatttaaattacaaagtggagagagacgttgtatccatgtctcaagttcttccagactccctggcagatcatcagctcctttgagtatgtgttcatttttatatattccatatagcaacaccactacacgattttcacttgacaattataacagtcttggagtgctcaatgccaaacattgttctaagccattacatatgttaattaattcaatcctcaaaatcctgtgaggacaggtactattattatccccaaatttagaatgagaaagcgaagaacagaaaacttgtcaaagtcacacagttagtgattatttgaactgagacttgaatccagacagcctggttccagaggacttgactaagagatactaccttttagttatcggtaaatgcaccataaatattggttgaattcaggaagctgaataacagtatctgacaaaaaaaaattacaaaaacacagcaggaagactaaaggagtgaatgtccccttgtgttatctggctgtttgatgacaaaagtaggttactatactacaagctgttatatatgttgcctattaagaaaaaaatgtaaaggactcagtaaggctaattgtatgatatcaaaacagaatttacatttcacatcacaagataaaagattttttgcgccaatgctaagttttctaaactttgcttttgagattaagtagaagacttgattgtttagaaataaactgtaagtctattgtgaagtctcaaaatggcccagcaaaagggaaaatacatctgaattttctagttgtgtaattatctgtgtaattagatgtgaaacttctctttcacagtcttccctcatcatctgggatggcctcaggaaacagttatcatcctcccttcagacttacatgagatgcactgggatttttataagacactgtttaaacttcaagaataaaaagcaacaatgagataaagtgaaattatgcgtaggtatggattttttgtttttgaaaggagaaggtagatataatttgaaaactatgatagagagcgattttcaaagtatctctatgaagatactatttttaacttttcacaaagagaaattttcttccattaattatattaaatttttattttaataatttttatatatatgcattgtaggcaaagttttgatccaatacagaagtgttttataaaaatcatcatgagttaagtaaatattcagcattttaatctttgccttgcctttgtaacgttttcttctcttaattccttggaagaatgaagaaaggaatatgtgtgttaaaaactaaatatgtttagtaaatctaaattcattacttcaaaaaagatattatttttatatttcgtaaacatatgtattcttagaacagattcctgtagtgtatctgcatgtccttcaggctctgctgttgaacattttcctttcaggtcattagttgtgccctgctcttctgccattttgaatggtccagtggtaaatttgtaccagctttattaaacacaagcaatacactgcagattttgatgaccaggctttctgtaatgtggccttttaaatctgagggctcagaggcattctccaaatcctctccattagtctttttaaagatacaagctacttcagaatagccaaataagaatattattattagaatattgtcatgcaagtcttacttatttggctattctgaagtagccaactctaaggcacactccatgagcctcaaggaaatgagaagttctctttaagtataattccctcttggatatgatgtcagtggtatctcctctccctctatctctggggccacatccaccatcacttatgactacacttaggagaactgaagaggaaacctacatcctccccaaagagtcctaagacagtagcgagcagtggaaacagaacaggaagttacttgtctgggagatctgatgtgtagtctgtgctttttgtatgtgtgccagagtaaaaagcaattaatagcaaagtattttataaaagctttttctgtaatctatggctctgttatgtttaccccattgttgctttatctttttttgtttagagtgtacatttagtgtctgaagcaaggagagtttgatagctcaccgaaattactacatgttttctactagcaaaacgaaatagaacaatttgcttgagaattactgtggattatttactgtaagctaaactctatgtaataataatcgctgacacttatttcttacttcaggcaatattctaagtatttttatatattatctaatttaatctaacaacaaatcctaaaaaataggaaactatcgtctccattttacatatgacaattctacaatacagcagattaagttaatttttcaagatgatacgagcagcaagtagtgaagttaagatttggacacaggctattattttagacatttaggagaatgtcagattcttccggcaggtcatataaccactgcacaataccactctccgccccatctttaagtatagtgcttttccacctcatcaaaaaatttgtgatgatatcctgtaaattctatccttaaaagaaccataaaaatatgtattagacaccgacttgaaaaaaatttacataaaagataatagaaactatcttagtctagtttttgttctacaatcaacatttgtttttataaatctctataaaattccagggcatggccgggcgcggtggctcacgcctgtaatcccagcactttgggaggccgaggctggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaattccagggcattgtgctgctattgtgtgttattagaatattgttatgaaataaacaatgataagcccgatctgtctcctaaaatctcttttgtttctgatatgacaagatagagcatgtcacaaacccaaaccttatcactaaatataattttcatagttattatattatcccatccttaattgtttcatagttgtaagcatcaaattttcctggaactctatatttcccatttccaagtagaacttaaattactattgtcctttaatgaaaaaaatcaattaagggaaggaaattacacatttttcaaacctcccaccagaaaaacaaaaacagctgtggaaaaaaatgaagagatatatgggttcactgatattgactgaaaatactcacacttagtgccatccacatacataagttaatataaaatagaacaccataaagtcattttaaaactgtcatatttattgtgtttttgcccattttaaatattagctcgtgcttatctagtactaagggcttcatatttattaacttatttaatctgcacaattatccatcactgtctctattttacataaaaaaaattgagtcacagagagtttaaatcatttgtctgaggtttcgaatgcattcagattgattacttaaccactatggtaattcgtctctgacaatcaactaaatcaatcattttattcattcaagatcaatggaatcagaagtgaaaacatttaaggactcacctgtatattagaatcagtagggaaaagtgatggatttttaaaaagaaatatgttaagagtacgttgcaaaaaatgtagatttcaatatatgtttagaaaaatatagaggagtctgatcatacatgagagagagagagggaaagacagagaaggcatagatattgagcaggaagaaaaataatgtgtacaatatttgtgagtgacttgaggtattttaaaggataaatcttaaggccttgatattagaactcaaaccatgcaaatattgcaactctggtaaattccagcttaaattaaccaaatatactatattctgagagaatcattaaacggtaacaaagacaagagtagctctttgttgttgttgttttagcagttactgatgataatatttaaatatactcaatgtttctaaatttttcagggtctatctaactgaatgaaggtgctttttagaaataaatagataacgatctgctgtcaaaggtattgctttcctttattagcagcctcatagtgatgtagaacaaagttgtcgggatagaaacctgcttaggttgcttgttctcctcagatggtaaccccaggaagggtagatgagacagttcaccctaaaagacggtgagtagtgaccatgagtcaccaaaattggagttggccttggatgtcagctttgctgaaggggagcaaaaagtctgaggtctgaggagttaaaaaaaacagtcagcagtcactggtcacttccagcaggtgagaaaggaaagaagcattttgagcatacagtagagccagagctaacctcataacttaggaacacaggttaaggagcatccaggtatgttgtacacctcaaggtacaacataacttttcatcttaatgagcataggttcttgagccataccatctggatcttcagtagagtgatttcaacattaataggagcatgtcctctggggtgctaagtaagggaggttcaacggtgaacaagacctcttcctgctcctcaaagaatctctattgcagtagaaagataggcatctttatgtctttacataaaatgaagatgaaagagttataaataaggtataacattcacgtgggtatttagaaggatgagataaattccatttgggggaaaagtgggtgatgggggtgccttcagagaaggcatagatattgggcaggaaggaaaattcaatgctcactattaaactgacataacatttttttacctttaggtttgtgggcacatgttaaggtttgttatataggtaaactcatgtcacgggggttcgttgtacggattatttcatcacccatgcattaagcctagtacccaatagttatttttttctgctcctctcctcccatcctgcaccctcaagtaggccccagtgtctgttgttcccttctttgtaacacattattttgaattagtatagctatctgtatgcttcttcactcaagctattagaaactagagggctggttctagatctttaaggaatcatcacatggtcttccacaatggtagaagtaattcacagtggcggagacaaggaaccaacccaatgtctatcagtgatagactggataaagaaaatatggtacatacacaccatggaatactatgcagccataaaaaggagtgagatcatgtcctgtgcagggacatggatggagctggaagccattatcctcagcaaactaacacaggaacaaaaaacaaacactgcatgttctcacttataagtgggagctgaacaatgagaacacatggacacggggaggggaacaacacacattggggcctgtgggggtggtggtggtacagagagggagagcattaggaaaaataggtaattcatgctgggcttaatacctaggtgatgggttgagaggttaacgtgtgccatagtggtttgctgcacctgtgtaacaaagctgtacaccctgcacatgtatcccagaagtaaaagttgaatttaattaaatgagagggctaagatccctccttgttcccatgcactccccacacctagcacatacctgccatccagtacttacttatattgtgaataactattaattaaacagaattaaatatgacctagctgctgtgttctattccctagaaggaggcagaattctgctggaactggcttctgattctagcagagcagggctggattctctagaagaaagggtgtgataatgcagaagcatctaagtagtaacagtaaacctaaaatgcaaacatcacttttacctgattggttttactttacaaagagaagacggagagaatactatattaacttcgtaaataaagatctgttcaagactatattggatgaaaaccatcaaagataaacacctcaatattttatgccatcttagggctgccggttatctactattagacatttacaaaatcattcaatgagtattggtaatacttgtagaagcaagtttatggttatgtttggggcattgagatttttaatgttacttcttttgaattgataaatggttatattattgtttaattataatctgttcttcaataacaaatgagtattttaaaaaattattttactaatacataacatttctacatatttacggaaacgtgatgatgcatgcatacaatgtataatggtcaaatcagggtatttaggatatctatcacctcaaacatttataatttatttgtgttgggaacattttaagttttctattttgagatacacaatatattgtttttaactgtagtcactctgctgtgctagagaacactagatcctattccttctacctaagtgtatgcatgtacccattaaccaaccacacttcatcctccttttccccaccatttcccagcctctggtaactatagttgtactctctacctccatgagatagcttaggtagctcccatatatgagtagaaacacatcctcaaaacttagaaagattacaaaactagaaggggacaagcagctatataacctggaaatcagcattttttttttcttttttttttgagacggagtcttgctctgtcgcccaggctggagtgcagtggcgcgatctcggctcactgcaagctccgcttccgggttcacgccattctcctgcctcagcctcccgagtagctgggactacaggcgcccgccaccatgcctggctaattttttttttgtatttttagtagagacggggtttcactgtgttagccaggatggtcttgatctcctgacctcgtgatccacctaagagtttatcttttcttacaacttcttttatactgaaaagaagctctttagttaactctctttgtcatggagttagaagtcaagtgctattccttgttttaaagatgattgcagtcttggcatgttatcaaaatgcaaatactttacccttaaattaagcccttatttagagactcaaaattccctggagagaggaggatagcagtgctatatcagaaatatatttttttaacatacagagttgactgaagttgtttttattaaaaatgggcatttctaatcctgtccacaccaccatcctcagtatctcacctccaatttaatgacaatttcattctgaccttaggtgaagtccttctttctaagaaatatgttctgtaatcccccagactagagtagatgccttagaactttctatactcccttagttacttaaatatatcttaagggctagactgcaaattggcaccacatcacttctcccacattctgttgttaagtatagcacaaggctagcccagattcaaaggagaaaaactccttctcttgaggggaagggacatatgcatgctagaacaataggaggaattattggtgtccatatttagatataatgtatataaatgcccatttgagattagaatcataattttaatgtcagcatagtctttgtaattttcccactttttttatttactaggatgtagatacaaagaagacaaatagttgaattcatccagcatttgagtttcatcaggcaaggtaaacaagtcctgataggcaaaggatttaaaaggtttatgcaaagaagttgttagacgcagagccaaggaaagaaaggagatagtgaataatgaaaaactgcatttgaggttgttttaaagaattaatggaatggaagtaatagagttagtgagctggaatgatatcaggggtgatgagaggtcagattatagaactgtgtagttattactgataataagtttagaagggagaacatggaagcagaaatacattttaaaaacaaggctcagtataataactgagtacttgtataataactcagtataataactgagtactcagtataataactgagtacattgtacagttctaaaaataagccttaaatttagaacaaagacagtgatcatcgtaagctgaaatggaatggaaatattccatgagagaggtgagaattgagtggaatattggagacaggtaaagcatcagctaaagaaggatgctggagaaggcctggcggacttggcagcaccatttgcatagagtgcttcagcttagcgcttaagcccatgttgagcttccacactgtccaataaggagtttagggtttgatttatgtaaagtgggaatcactgaaaacattttagtaagaaagggatgttattaaaataatagaggaagattaactgacatgaggaatagtatgaaagattagtgggactgaaagcgaccagttaagatgctggtggaataacccattgtgatgaagcatttttaaaaacatgcatgtattagatgtatagaaataaaagatatgccttttattgacatctttgattggtgtgtcaggcataaaaaaagcagagggctcttaggaattttttcagcgtatgatgaaaagcatgtgatctgctggtgaccctggaacagtgaaagtccttggccgggcgcggtggctcacgcctgtcatccctgcattttgggaggccgaggtgcatggatcacaaggtcaggagttcgagacaagcccggtcaagatggtgaaacctcgtctctactaagaatacaaaaaaagccgagcatggtgaggggtgcctgtaatcccatctacttgggaggctgaggcagagaactgcttgaacctgggaggcggaggttgcagtgagccgagatcgtgccactgcactccagcctgagcgacagagagagattctgtctcaaaaaaaaaaaaaaaaagccttaatgtggccattttctggggcgcctcctgctggtttcactatgtctcattgctcatgatgttttctccacaaagttcttgaaggctgtttagaacatggtttggaagctagttgagcaaaaatgaaaagataactgggagggtctatggaaactgaataaaggtggtagctatggcagtaactttgccctcttcaaccaagtgttgtttgtctccacaattgcttttctaatatgggtattatccccaaaatacttaatggtgggcattgtctccaaaatacttgtttttaaagatgcaaggtgctgtagttgtattgaacctgtgagaatcaaatcagcctgctggtgctaactctgatggagggcggtgaggggacagaggtcataataacacagtcgccaattaagtgcttacaaattctggtttattatgaggctttcacacaccaacaatcatgcaaatatgtttaacacacaagcagtgataaaaaggagcgagtagctccagagaccagcctactgacttatgaactggcaggtccagttttcctaagagagccagttcacccaggagaagggcctcactgctttttttccccagcagagctctggcacctgcagctgaaggaaggaggccccagagttctcaccagcagaaatgctataggcttcttactgtggtcagcttctttgtggtgtttggagtcttccaaagaagtatacatggccactatcttcagctgccttttaggagagaattttatgagtacatagtagatgtatacatttatggggtacgtgagaaattttgatatgggcatacactgcgtaataatcatatcagagtcaatggagtatccatcaccttaaacatttatccttccattgtgttataaacaatccaattatattcttactgtaacatgtgcaataaattattgttgactgtagtcaccctgttgggctgtcaaatactagatcttattcattctatctaactgtattttgtaagcattagcaatcctatcacttcactttcttgtcaggcctcagaggtacctggccatgttaggtgtcatcgtatcatctcaggccaccataagtgtttttatcactcagaggggtcagcaatttcactgaagctgagtcatttgtcataagtgactccattttgagacattcaggattacaaaacattattatatatcatactgattttacaactcacattactagattcttaatttgcctcaaaaacagacttctaaaaggcattgattttgttttccatacgtagtcgtttttgatgatccccagccaaagagggtgtgtccctatttacattgttgattattacactgattttttttttttttgcctgcttcctactggaagggaataatccctaattcctacatccagttgctgggtccggggaaaagctacctatacaatagtctctttaaaagttgggtaaccccgtgaaaccccgtctctactaaaaatacaaaaaattagcccggtgcagtggcaggcgcctgtagtcccagctactagggaggctgaggcaagagaatggcgtgaagccgggaggcggagcttgcagtgagccgagatagcaccactgcagtccgccctgggggaaagagcgagactccgtctcaaaacaaaaacaaaaacaaaagttctgtaacccactgtgttataatagaaagtgaattaagaagtcaacatcttaggttcatttatttttttctacatgtattattcgtacctactatgtactaggcattgttgtaagatcctgtccttatggagcttaccttttagaagagattacgttctaaggtgtgttagttaaacaaattatctcctgaaaatcccaatgaaggatttttatcagaattcaccttcctgtaaaacataaagtaaattatgtcccagttcctccagttgtcttgagtttaactcctctactttgatattttcttacatattttctcaatagtaaaacttgaggtacaaaattttaaaaagtagaaggtatatgtttattttgtacagcaacacatagactatttcaccaattttggttaaaatttcctatgaatgctgtggaccataagaagattgaacaatgaagattgaatttattgactcactattttttgatcaggagatcaaaattgtttgatacctactatgtgttagaattgatactgaataaaaacaattaaatattattttagtagaataagccaaatttctggataaacgggaagcctactgaaatagcttcttccttcctctcatctttactgaggtataattgacaaacagacgttatatacgtttaagttgtacaacttgatgtattgatatataccttgtgtatcaccagaaactaacatattcatcacctcatacggttaccatcgtttgtgtgtgtagagaacataaaatccacctgctgagtggatttcaggtatacaatacggtattgttaactacagtcacgttgctgtactttagatttccagatcttgcaaaactgaaactttgtacaccttgaccaccgtctcctcattcatcctcccccagcccctgacaaccaccgttctgctctgcttctacgaactgaatagctcctcttgatttctttttctttctcttttttttctctctttctttttctttctctttctctgtccctctctctctttctttttcatatttaagtgctgaaattacgagattggtagatttaagatttcttttgagcgtgggacaaaacacagacacttgaatagatggaaagcagaactctattacttgcagctttcaacaaagttgcagggctagacagaggttgcacctatgaacagtgtaacagcaagcttatctgtggtaagcagggtggggttagctaggtttctcagacttactgtggattggctaatttgaataattttgacaggatctggagcctaggagctgttccttttagtgtggaacctaggcctggggcaatgagggctggtgtagaggagcccagaatgtaagggtctgatgaagaaggggttggagtgtgaacttcatcagctgcccaagaaggggaacagattggcctccagtcaaggcctcaaaatggggtcaaaacagcatttttaaacagctgtgttagacgattgtatctaatgtgtttaatctatctctgtaacatatagttttcttacatccaagatctagcaggggtaaatgtattacttgtttcaagctcaggaaacaataccagttaaccatgtatgtgagatcataattatcgaagtgtgaaattaatagtagaaggatacattgacggtgatatttataccaaaaattttaaatatactgcagtaggcctatctatatgtatctatatctataaaatagagacaatacctactcaaagtaattatgtattaaataagatacagtcttatttatatataaaatatagccttgtatacagttctttctatcacctttcacaataaacagatggatcagctgtggggaattacaaagtttgtgatcacttacaccaaaatacataagaaaatcataaaagcctgggaaattaaggaattaaacagcagtgttcccaagcacagtgaacttagcaagtctcatattttgactaataatgccttctgtcgtcaagtttcagaatagtctccacgttttgccctctttttttacttttgtcaaagggaaaaaactctttaaccaccctgtaacacacatgcacacacacacaaacacacacacacacacacgcacacgcacacacagtctttcaataaacctttcaaagtccaactcaagttgtgctcttaccatgaatttctttaccaccttctcaatcaacttactctaaataacttatcatattcttcgtatttattgttctcctgaagctcctgtaattatcttccagtttaaacgttcttatagtccaaggtggaatacaagtgttacattactgttgataaaaaatatataaccatgaagcaatacaacatcttctttctgaccagtgaattaagaagattagaactacattccaggtagtttgaaaaagtggatagatatctagactcagaatcagaatttatttcttggtgtctgctttttcaatttctttatttctggtctctgttttgcagtttattagttctgaaacatagggaaagcactgaaaaaataatccaagcatatgggttctaatctttggattctttccaaataactgtaatttgaatatatattttctatgaggcataatttattctatttaaaattggtgtaattccaaacttcccatttcacacaagagttatgaagataaattaatccttgaattcaaaaactatttcctgagtccctaatgtagatttgttactcgactaagccttcaggatagaacgagtacagtgttttaccaatcagaagatgcatctttttcactttttaacgtcactaaaataaaatatcataccatcggtgatgtccagtgattaccatgaactatattttcatagcataaaatctttgaaattgtgatgcatccttagtgaaatatatttatacttcttcaagtttagttgaggaaacaaagttcatagaactaaacagaaaacgtctatgcagtatcgttagagaaatactatgagatcacagaaaaggaggcacacaaattagtttagatggtcttaaggactgaattatgcctcccgacttcaaatcatatgttgacatcttaaccccaagtacctcagaatgtgactgagtttggagatagagcctttaaagtgatgattaagatgaggtcattaggatgggccctaatccagtctgactggtatcttataagagagggaagtttggatactcagacacagtgaggaggtggccacccacaagctaagcagagaggtttcagaagaaaccaaacctgtcaacatcttgatcttaaatttctagtctccagaacgatgagaaaataaacttttattgtttaagccacccagtctgtggtatttggctatagtagctctaggaaattgaaataggtggtccaagagagcttttagacaaattgatgtccagttcatttcaggataagttggaatttaccagctgaagaaataatagaaggaaagtgctgaaagcagaaaaaataacccagaaaaggcaggctataaaaatgatacattcataagacagtaacgtgtgtgtgtgtgtgtgtgtgtgtgtatgtgtgtgtagaacctggagtgtagaaagtgagcttactaaaggaagaaatgttgagtgagaaatgaagctgaagaggtattcaaatgccacaggacctggggcttgaaattcaggcaaaggaactcgtactctatcccataggcagtagagggggttttaggcatgtagaaggaatgtaaataataaggtggctttttaaaaaatgtatgtcaaaagtttttttctattgtcatgaagcaaaatattagaatcacctctagcttacgcttgttatacttatgagaataaattgtatgtgtatgtgtatgtatttgtggataagggaccagataccttacaaggcccagatgtaataaatatagacgatagattaagagttcaaacatctgagtcttctggggcctagtacccttctgtcttttattttgaccaccttgttctgtgttgctcactttgatttagactttgctgtctttatagctgttctccaaacattcctcttactgcacttaccacatagagcataattgttattcccttatgaactttaaaagtttatttataataatataaatttggaaactaaaataacctaaagctcaagttgcccgtcttaaaatatgggtagttcctttatcaagatggttcatatgaggaagtggtgaaaatgatagggttgacactcaattattaaatatataaaatctagcttttactttaaagaagtacatagtagggaaagtgtgaaatttaacttcaagacagattgtattttttcggaatcttttacacctccgatttgcctttacgttatctgaaacaaagatcaggcttaaaaaacataaatattaaaatattcatccattttgaaggaataagtaaataaaacacatctctctgaaaaattctgggattccatttgacctgaacatgtatcttattactagagaagatggaaaggtggaggggcttggagatgggagaaaaaactaaagtgctatgaatgattatacaacagtgccccctgatgggaagaatggggtctgaaattcagatgagatttcttaccaagtcaattacatgacttattcttcgtttttgcttccatttaaagagatttttgtagcgatgcatcagttttactatagaatctgacatacagtatgcactgaaaatatatgagtaaatcgaactgaagcattaagtctaggcaaggagcttttaaaaactttagctggcacaagggactaggtgtgttaaatatgaccataaccttgagttgtctgtagggtaaaatacattgatctttatatgttaagcttttggcaagtgctatttcccctactaatttacccacacttggtgataaatctatcttcgatctcaaaacattatcaaatactataatattatttcaaaattttaacagtataattagttcagatttaaataatcttgaggaagaatgatttcaattttaaagcaaaagtgtttttcaaataaccaaaagaaaatagttttgctttattttttgttattaactaggcatattaatgtggtcaataagaactgtagcttttccttctctaaaggggtgtaggaatggaaagcaatgagtactgaaaaggtaagaaaaatttgtacaatctagggtttgaattcaaaccccagagtagttgcatggaacaaatttactcatcttaataattgtcatgggtgcatggtaaataaaaggagaacttgtttgttaagaatgaggcattatcatagtattggtaatgcattctataaataagatttatgttttgagaaactcaagtaagaaagcaggaatggaattatccgtttttgaagtgaaagagaagaaatgtggagagactgtgtgtgttaggtctgcatctggctcctagggagatttgaatgaattagaaggaggcttcctttcctcttgatgtttgtagtcctgacttggtaagtagacacaggctggattgcaggccctagccacaccctcagcaggcatcaggtataattatcaacctgcaccatcagaggttgcagcaactcattcagtgatacatatttgctggatatgcatgaaacactctagtgaatttgaacatttttaactgaagaaatatggatatctagcattcattatagataatctcccttgacacccttctaaaaaattcatgaacccgtaggaagtagcatctcactgccttactgaacatggtaagtatgctgttaaatctaactatctgcttatgttttctgctcagcttaaatgctctttattttatattactactatttatttttgccaattcaaactttacctattttattgtttgcatcttgaatcccacattttctagaaacactttagctcagaatattatctttgtctttggaattctgatttcaaagtaatgtgttgtctggaacatttatgttttcttactatctaagtctgaatcagcaaggcaggtattcagtgagataaaagaataataatatcatataacattgtttaaattattgggattctaattagaacgactaacagtttgcaccaatcaaaacttacataaaccattaatttcaatattttggaatttaacattgaatggtaatgtttctttaagtagctacggaactatatttgtccaattcagttgcacctttttattctttttgtatttccaaattctgagattcagtatgttactaacacctcctgtctcataatctatttagtgtgccttaaggtaagataggctgcttaaggatgctttgaatttacaggaaagggatatctctgtggtaccagaatttatttgagaaaaaacaacttcaaatgtagttttcaaactgtgcagactgtcaccttactgacatcagtaagcaaatgttcttaaacttgtatcaagtatctgaatagtcacttacttaactgttcaatgaagttaaccactaggagacaagtttgccctaagcttaacccagacaggagatttcaccttctagagttaatttacagcttaagaacaagcccttcaaaatctttctactaattgttttactcaatttagaaagttcatttaaatgagaattcttttttatctaccttaaggcaggttaagtatttttttccattacatttacatatcatgtcttgccgctatgtttggtgttatacattattatatagacatgtgaacagttttgcataaatatgcccagtaaggttgtaagtactaatttccccctgatttcctccattaagggtgcaacattttactaacaagaagaaaagtatcttaatttcatgattcacaagtgaggaaaatcagatttttcaacactgaaaattagaatctataaaagagaaataggggaaatgtaactactaaatgttatgtgcaagcaacaacataaagattagtccatgtaattataacacaaccaatggaattcagcaagtactttactacttaaagtaggaggaagtgtaaagacggatggacagtccaagtcccagctcagtctcttgtgaatgtggataagtcagtttaaattctaagttcactgattctgtgttctctcctgcaaaaagtcagaatggcaatgcttatcatgtagaaagattggcatttaaacaattgttttgtaaattctagagtatattctaaatatgagttacatcagattgtacttaacacgtaagattttctaataagactggaatggaaagaaggaaaccttggttcagtaaccaatcatttgtgctcctttgtcaaatcatttaatatttttgaatgacagctttaagtgggattgtgtgagctttaaatagagttgtggtaagaaggaggaaaaaacaatctcttgggctttttctagctctaaaacactttaattctgtcatttatagctttgtttttaaaagcaagtcagatggtttaatatttatagattcatacactatattcaagaaagtattagagacttgtgcaagattccatgacaagtcagcagctgtgttgagataagaaatttacgctggatcctaaaatctgtcatcctgcctagcgttccttctactgaaactctctgccttgatagtaatacttctagttactataatctaattgaatctcttcatgtagatcattctagaaaatattgatatgttgggcatacttccagtcaatgttttagagcctgtgctaatgcatcagaataattagaaacacaaggcaaagcttctgccttcagaaagctcacagtctcacagaggactttacctactgacatgtttatcttagcttgtgtggctaaactcagcaacatgcaacatgctttgaatagttaaaattggacagctactctcaacattagccatgaagcacttcaaatgaagggataagaaaaattcattgctttgctcatttaacagtatgataaggaaggaggaggagagagatatatcatgttgaaagaacaatgaagaatctcaattatatcaggaatttgtacattagatgtgtcgttttaaaatcctatgcctgattatgcatacacaaataacaagtataaatcatcctcttcatacacattttttgtttaatctttaatacaaacccatgggaaagatttatcctactatcacaaatgatgaatctaatgttcagatattaggaagcataattttgctatttgtcttcctcattaaattgtgaattcctgggaggaagtgtgtaatagtagaaccaacttacttatgctgaattcactgtcccataaaaactgtgtgtcgcctgaacaagttattaaccctcctgaatctcagtttctttacctataaattgcaattacatgaagtacatataaagtcgttaagggcctgatatgtattagctaagtaatgagtgtttcttacaccatcatacatagcagagtccatgaatagactctctgtaactgtggaggagggatgtcatccagtcatactttacagggagacttctaatacaggtggcctcttagtacgtgtaaaaagtcaaacctatttagaagcccattgtaaaatcataaatgtaaataactccctaatgataaaggcaagtcatttcaatagctcagtgaaatcttaagagattcttgactaaatatagataagtattaaggtcgtccacttccacagattttctctaataatttaattcttctcatcttattacttaaacccatataacatagttattcagaagcagtaaatgttgaatagaacttaaactaaagcacaaaaatgagaaatgttttttaccctgacttttgtacccccatcaaaaccagtatgcaatgtgaaaaatttcaacccttaaaaagaaaaatttacatgttgccatattggaaatgggggagggggaagacatatacttccaaagaaggacctctgagttgattaaggccatatcaccagaatagtgcttccagaccagagcattcaggttcatttaatttctctttgtaaacaaagcaaccaattttcagttctattgcaaatatctaactgtcctctttttcacagaggagagacaagtattaactgctcttcaaaagaaagttactctgatttacagagattgtaaacctctggcccccacaaacaaacaaacaaacaaacagaaagaaaacacagagcaacaagtctcttaaggacgtaagacacctaggagatagtgttcccactaaacaatgttgggactgggccctgtggctcatgcctgtaatctcagcactttggagggtgaggcaactggatcacttgagcccaggagttagcgaccgattgggcaacatagcaaaaccccgtctctacaaaaagttaaaaaaaaaaaaaaaaaaaaaaaaaaaaaagctgggtgtagtggtagctgcctgcagttccagctactcaggggactgtgatgggaggattggttgagcccaggaggtctagactgcagtgagcagtgattgtgccactgcactacagcctgggcaacagggtaagaccctgtctcagaaaaaaaaaaaaaaaaaagttggaggtgcttataacagctataattgtgatgtggagatgctaaccctgtactcagaaagactgcgactctttaagcacagaagaagtaaagcacatactatgtagggaaagagaagaatagttggcttatctgccaatgccatagctgcatattaagacctaaattccaaaactgtaaggcaggcgttatttttagcgttctattccttcatttcccctactattcgatatcacaattacaaagatcagtccttccaagtagttgattgattgtcatcattgatcttgtacacagaaggtgggaaaaaagcacacgtaagtcttgcttggcatttcagcaaatttcctccattaagcgtttttattggcagacctaaaatatatgttcttggtttggaaacgattccctgatgggcatggattgctgcttttacctccctgctcacccttataaatttctgaattagaacaatggtaaaacagaattgaagaaaagaaggtacaactttttaaatgctggaagaaaaaaataaagcttcactaaggtcaatgtaaactgactctacacttctgtaaccctcccagaaatatcagtaaacatttttatcccaaatttattttgtcttcttttccaaaggctcggtgttcatttatctacagatactcttactagggtatattggttttataagttaaaactggggctaaggatggaaaatagtagtactaccatgctcagctaatgagttttttgctctgccagcttatatggcagccttgtaaatagctttcattttatgtaagcttcttttgatagcacctttctctgttaaaaggattttatttaggcttagatgcaaaaaatgatgattgatactttatttttactactgtggatcccaaaggggccagcaacataaatttcaaatatttgcttttcttattcctgccaaccttagttaagccttgtatatgacctgaagacatttttttttttcaattcaatagttaattcattgaaaatttttattgctttgttaggcacatgtgacacaaacatttaaaaagatgggcactgattctaaggcacttataaatagtaaggaagacagtcaaataaacaaatacaatatagtgtgatgattgaaagaatagggctatactcaggttgtagaactagccaagaagaccagtgatgaaattggacttccattggtggaggtgacaaatatgttcagggaagtattaccaaaaaagtaacactaaaaggattttgaaaggttaagaagtcttggctcttttaagatcagatgtgaccactaccacatcaaggttgcctgcaagtattttagtttctatttaaaagaacaactgtgcatttggggtcatactaaaaaaatccttgcccaaaccaatggcaagaatatttttttccctacattttcttctagtgcttttacaatttcaggacttccatttgtctttagcaaattttgatttgatttttgtatatagtgtgagacacagttctgatttcatttttctgcttgtggatatctagttttcccaacaaaaattgaagagactctgtttctcagtgtgtgttcttggcaatttatcaaatttcaactgacagtaaatgcttagatttatttccagactctctattgtgatccactagtctacatgaagggtcctccacccccagtcacagaccactactggtccatggactgttaggaactgggcagcacagcaggaggtgagcagcagacaagcaagcattactgcctgatctccacctcctgccagatgtgtggctgcatgcattagattctcacaggagcagagccctattgtgaactgagcatgtgagggatctaggttgtgcactccttatgagaatctaatgcctgatggtctagggtggaatagtttcatcctgaaaccatctccactgccctacgccctcttcttgctgtctgtggaaaaattgtcttcgacgaaaccagccctgtgtggctggggactgctggtctacatgactgtttctgtgtcggtaccatgatgttttgttaattatagtgtcatagtaatcttgaaatcaagtagtgtgatggcttagctttgttcttttacttaagattactttggctattcaggttcttttgtggttctatataaattttaagattatttttctatagctgtggaaaatagcattggaattttgatagggattgcattgaatctgtagatagttttggatagtacagacattgcaacaatattcattcttcaatccataaatatgagatatcctttcatttatttgtgcctttttcaatttctttcatcaatgtattgtagtttcagtgtacagatattttgcccccttagttaaatttattcctgtgattcttttgatgatgtgattataaaaaatattgccttctttatttcattttctataacttgttgttagtgtatagaagtactactgatttttgtatgttgattttgtatcctgcaactttactaatttttaatcagttataacagtttttggtggagtctttgcagttttctaaaaataagataaagtaatctgtaaacagatacaattttacttcttttccaattcgaatatatttatttcttttccttgcctagcctggctgagatttcccatactatattgaatagaagtcagcatcctttttttttttttttttttttttgagacagagtcttgctctgtagcccaggctggagtgcagtggcacgatccctgctcactgcaagctctgcctcccgggtttaccccattctcctgactcagcctccctctcgagtaggtgggactacaggcgcctgctaccatgcctggctaacttttttttgtattttttagtagagacgaggtttcactgtgttagccaggatggttcgatctcctgaccttgtgatccacccgcctcggcctcccaaagtgctgggattacaggcatgagccacggcacccggccggccagcattcttgtcttgttcctgatcatagatgaaaatagtttttcatcattgagtgtgatattagatttgggctggtcatatatggctttattatgttaaggtgcatttcttctctatatctaattgtttgagagttgttaatcataaaagaatgttgaattttgtcaaatgctttttatctattgatactatcacatgatttttattcttcattttattaatgtggtgtatcacatttattgatttgtgtttgttgagtcatccttgcatcccaggtctaaatcccatccaatcatagtgaattatccttttaatgtgctgctgaattgagtttgctagtttttttgttgaggatttttgcatctgaatttttcagggatatattgccctatgcttctcttgtattcttatctggctttggtatgagggtaatgttagtcttgtacaatgagtttgtaagcattccctcctctttaattttagggagagtttgagaaatattgggattaattattcattaattcaaatgttgggttgaattcaactcgaagccatcaaatcctgggcttatctttgttgggaagtttaagactactgattcaatctttgtattagtcagtctccagcagaacaatccatagagagagagagagtgagagagacagcgtgttaaaaaggggatttataataagaattaactcatggaattctggagtccagaaagttctacaatatgctctgtgcaagctggagaactagaaaagccaatgtataattaaatgagagtccaaaggcctgagaaccaggggacccaatactgtaccttttagcccagttcaaaaggcctgagaacttgagtggggtggagtgctcactttggagtcccagagtctgaaggtctgagaacctggaacaattatattcgaggacagaaaaagatgaatgtcctagctccagaagaaagactgagtttgccctttctctacttttttgttctatccaggtcctcaatggcctgcatgatgcccatttacactggtaaaggcaaatcttctttactcactctactgattcaaatggtaatctcttctggaaacttccttacagacatgcctagagataatattttaccagccatctgagtatctcttaggccagtcaagttgacacattaaatttaccatcacagtctccttactcattattggtttcttcagattttccatttcttcataattcagtctttccagaggtggaattcaccttgcttatcattagcatgtgtattcagtcaacattcaggcatgatggtgatgtcagaaaactacagattatccacatgggtggctgagatagtgatactttggcttactgatggttcagtgtatacaaactttgtttcaaactttgcattccaaaatctaaaataaaaaatactctggtcccaagcattttgggaacagggattctcaacctatattcagagagagggggattaaaaaaaagaaaaaagaatggggaaaaaagatgtaaaaaacacagtaagaaacatttcatctctctgattctcaatcttctaacctttaatatgatagtacctacttcaaaggatccttgtaaagattaagttagttactatatgaaaaacccttagaacaatgcttggcacattatatagtctcagtaaatattatctggcattgaaatattttaaaatcaaatattagatattctttttaaatactttaaattaaaaagagcacctgacacctcagtggcccagtcttaggatttcagataaatttcccctggaatactttcagtttgagtctagttgttttcaaaatccagtaaaagactttaatgaatgtaaaatgctatctgaatctggacattactgttttaattccaatagaattttctcatgtgggttaaaaggacaatcagcttatatttcctactatattttcatctagcacaactcttaaagcaagtctattttagttatatattattttatcatggttcctggaaggtaagattggtggccaccacattcagtctccttcacagctaagtgtagccacataactatgctttggccacggggatatgaatgctactactaattttttcccttgaaacaatgggatgttgactttcttgctcccttcctccttactgcttattgggagatggcagaaactgtcccatctaccattcatgtataagttaaaaccaaaagtgaactacagcatagccacttagcctaaaaatgttggctcgtctgtggattgatatatgagagaaaaataaactctgattcttgtgtctgttataatagctagcctgtatgtgaataaataccttctttttaaatttttgaggaattaaatctccatattatgtgtaaatctacattaaattaatataccttgagatgtttttctctctatatttcatgtcttttcatcacaaaagatttgaagcttttaacataagatttaatatctatcttacctctaaataagaaatgtttctttgacagtttggaaagagaatttcagtgattatagtcttatacctcaactactaattcattttacttgtagagcaccaaactataagcatccattatagcaatattgtaactacatcagattgatatatctctaacaagttttatgaattccaggaataatgtgtttaaagtttaagaaatttgaatatgttcctttctatctgagagctaagatagaagagtggtagctaaaaaaaaaagctaccactcttacctcctctgtaaggggaaaaaaaaaagataataaattttgttttcccaggaagacagagtaaatgttgccagaatctaactaaatatactgtggagctcttccttaagagacagaagaattagaaataccacatgcaataagtgaaattaagtttgagcatttatacttatcacacgaacaatatctttctaaacataatctttgagaatattccctcttaaagcatcagagataaggtgcaatttatattgatacttttccatctcattagaatcttttgtgagcaatctatagcctggagcatctgtttctgcttctagtggtgtggttagaaagcagatttaactattttggctttggagtttgctttaaagctaatataggcaaaagtcacgtggtctttcaattaattaaccaactgaagtgttaacctcatctccttcagtgtgaaggaagtgagatgttcatccctcacgattataacttaagggtgcagtggctcacgcctatgatcccagcactttgggaggctgaggcaggtcgattgtctaaggtcaggagttcgagaacagcctgaccaacatagtgaaatctcgtctctactaaaaattcaaaaacttcctgggtgtggcggtgggtgcctgcaatcctagctactcaggaggctaaggcaagagaattgcttgaacttgtgaggcgaaggttgcagtgagctaagactgtgccattgcactccagcctgggcaacaggagtgaaactccatctcaaaaaataaattaattaattcaaaaataaaaaataaggcttacatgggacaagattacagtttgactgaacaacttagttcccagtccccaaaagagagagaagtatttaaatgggaaatacagaaagtaccaaatttaaaattatattatttgacaatttattcaataatttatattttcacccaaaggagaatttacccacctctctctatataaattcaatgataaaacattccgtgcatagtacagtttaaagtcccagcactcctaatttttcacagtaatatgtcagattattatcatctggacatgttatttgctctgtaataatataggctgccttttaattactggtgtaaatatttttgaattttttctataagccaagttcagttgtcataggctatagtttgaatgttcacgttgccttcaaacttcatgttgaaacataatccccaaggaaacagcattcaaatgtggggtctttacaagctgattaggtcaggaagactcctcccttatgaatgggattataaaagaggcttcacatagcatttggctttttgccctgctgtccctgctgccatgtgaggacacaacattcatcctctccttaggatgtagtcttcaaagtgccatcttgtaagcagagagaactatccctcaccagacaccaaatccactggtaccttgattttggacttccagccttcagaactgtaagaaaaaaaaaaatctgatctttgtaaattactcagactaagttatttcattatagcagcacagaattagaaaccgtatgtaattgctccctctctgcctacaggaatacattaaaattttctgttttgtgtatttaaaggtgatccaatgacagcctttattgaggaagcgctttgtttttcagaaagttggaagaggcgaattcatttaaaatatcttacccatttctctatgatgtacctaggacattgctgaacttttctcttgctatcctctagaggagatttaaattgctagctaaaatgtcattagcaaactactctggtgattgggatgaataactgaataaatgaaaagataaattggtcagtagattaacagacaatccagtgtgacttaaaaaatgccatcaaacattcttggaatgttaggtaattatttaaagaggaaaataagtgataaaataagaaaccataaatgaagtaaatgttataatttgtgttttgtatataggttcttgacttactaactatattcactgttttccattcatgttattactaaaaacgatgttttaaggtttgagtttattatttatagttttctacataaataaagggcttcattaaaattctgatttcataattaacctctacaaacacaggccccatggtattataaaacaattgccactttagaatttttgaaaagcattatccggtagaaaaaagtaactgctttatttgagttaaattaaggctcttaaaatcaaatcttagctatgccgtagccacacagtttcagtaagagtgcagcatgaggtcacaggaagaatagaatatacaagtgattatccaagaaatgaagagagtctgtagttgtctgtcctggggaaagtcacctttacattcatttgctttttgactataacctataggaaggcacaaactataaaaaataagtcttgtttatcgtagggactcaacaatatgtaacaattgaagaatgtgtgggtctgagatcctttaaggatttataacattttaagccatatttgctttttttttttttttttttttgagatggagtctcgctttgtcgcccaggctggagtacggtggcgagatctcgactcactgcaagcgctgccttccgtgttcatgccattctcctgcctcagcctcccgagtagctgggactacaggtgcccgccaccatgcccggctaattttttgtatttttagtagagatggggtttcaccgtgttagccaggatggtctcgatctcctgacctcgtgattcacccgcctcagcctcccaaagtgctgggattacagacgtgagccaccgcgcccggcctgctttttgtcattatagttttcaccctaaacactgcgaaaggaagggctaaaatatcctgcatatgggcataaaataagatctaaatgtcccatatttctccctgtctcacattatcaggatctcctttggcttctgcttgcactagtttatcagcttgtggccccactaaactatctcagcagctcacagttttaagcagatgtgagtctctgtccaaatttttactgaaaaaaaaaaaaaaaaaacaggtaaaaagaaatcacttcctttttttttttttttgagacagagtctcagtccatcacccaggcttgggtgcagtgtcatgatctcggctcactgcaacctccacctctgggttcatgcaattctcatgcctcagcctcccaagtggctgggattacaggtgtgtgccaccacacccaactaatttttgtatttttagtagaaatggggttttgctatgttggctaggctggtcttgaactcctaagctcaagtgatctgcccgcctcagccccccaaagttctgggattacaggcctgagccacggcaccctgccaaaaaaaaaaaataaataacaacaacaaaaaaacaaaaaaacaccttctgatacaacacatttatgtgtgacagtctgagggtaaattcagggctatcgtttaggtcataggtagtggtgtaaggccaaactggctttatggctgttgtccatttgattgcttagcgtgtgtatcttcattgatgattgtccatgctatatgacttgttaaatgttttaaatattagtgctggttgtggtaagatgagagtaaagatggagatccttaacagttcatgaatacaaacaccttctaaaaggaatatacacatttctgtcttaaaagctccttagctactcctccaccatttagctcacatactgcagtcttttccctctcaaactattttttattcttctctccttcacccttacattctgaacatttataatgttgaaaagttttagccatctctcttatttgctgatttttctcaactcatgccttaagggttcaacttgtactcctaaaagtttacacatttattttcttaaacagagacaattacctcctaagagaagttgtggtataagttataaggatcatattttgtttattttttaatttaaatagactgtttcttaaagcagttctatgttcacagcaaaattaagtggaaggtagaagagtactcatttacttcctgccttctctgccacacagagcctccctatcattgacatccctgaaccagagtggtacacttgttacagtctgtgagccacatttgacacatacttattaccccagatcagtagtttacattagggttcactcttggtgatgcacattctatgggttttgacaaatgtaaaataacatctacccaccattatagtatcatgcagagtagttttaatgccttaaaaatattctatactggaactgttcattcccctctgcccccaagccctggcaatcattgatcatgttattatttccacagttttgccttttccagaatgtattatagttggaatcatacagtaggtagtattttctggttaacttctttgacttagtaatactcatttaaggcttgatagctcatttcttgttagcaatgaaaaatactccattatctggatatgcctcacttgcggaatgacatcttggtggtttccaaacggtgttaattatgaatgaaactgttataaacagctgtgtacagattttcgcatggataagtctttagctcatttaggtaaataccaaggagtgcaattgttgaattgtatggtaagagtatgttaactttgtaacaattgacagactgtcttccaaagtgactgtaccattttgcactcctgtcagcaacgaatgaaataattcctgttgcttcacattctcaacagcatttagtgttgtcagtgttctagattttgggcattgtaaaaggtatgtagttgcgtcccattgttgttttactttgtaattccctaatgaagtattattttgaacatttttatatgcttatttgccatctgtatatcttttttagtgaattcttttgagatttttttctgttttttaattgggattttttttattaacatttaaatgttctttgtacattttggatgacagttcctttgtaagatatgtttttgcaaatattttcttccagtctgtggtttatattctcactttcctgcaagtgtctttcatagctttttcattctgttatggttgtgttatagtatctgtaatgggaattagagaccctgaaagaagtttaatagattacttctaagctgccttcctactcttaactccttaagaagtatatttttatactgaagaagtatatttttcaagtgacattttaatattaaaacctatcacaaggtatgattatgaataaaagctggcaaactcatttagaaatattcaatagcttttgcttttaaaaagattttgttttaactaatgttaataaaatcaaaggaaatatccctcccccatatattaattattactatatccttgcatacatttaactggaaggtagaaaagttgactaacaagagtctgggctaaataaagcctatgatttgacagatcattattttttcaggttgtctattaaagtatgagaaacaagaatactatgaataaaatcagattctcctgtttagtttcttaaatgtttcctttatggtgaggaagtattgcctatgtctaagaacagcagaatagaccttgtaaagatagcctgggaaataaagattggaagaaaagttacgatcaattatgggtttctttagtaagatctctacctatgtttttttataggtcccttctaagtatatgattgcagtccagaggtatagtcacatcaattgtgtattatttgcatagattagcattgccttttcacagacaattttctgttattttcctgccaatataaataccaaagactattaaagtaagaagaagtttcaggaaaggtagattgcatcttgtcacaaatcgaagcacaatgagtaagctgatgtgacttttccctgctaagatcactagaaatcagagttgtctcattaaatacacactcaaagaatggaatgattgccagacttgctgtggtaagatctttgaacatttacaaagatgcttaggtaaattttagccttgtcacccattctcaagttatttaaactttacaattttgcagatcttatagatgtactttcactaactctttcttgcatattcttgttatataagaaagaaatgaggcttaaaataccaattataaaagaatgagttattttaaataagagatttggaattatttaagccatgtattatataaaaagaaataacttttaaaaaattctaaaacttaatatagccagaagtaatatagaaaacaatagagggttttttttttttttcctgagaaacatttgactaaaacaacatgtgctaatgccaaactttctggcaataacgtctttttatacatgtgtcatatatatcacaatatgtgtagtttccaaggattgtcataacaaattagcacaaaccagatgagttaaaaagtctcagatcaaggagtcagcagggtcgtgttgtctctgaaggcactagggcaaaatgtgatccattcgtttctcttagcttctggtattgtcaacaatccatggtgtgttttcacttgaagatgcatcactccaatatcttccttcattttcacatggggctctttctgtgtggctctgtttctatattttctctccttataaggacctatactataagtgccccaccctaattaattataagttcattttaacttgattctatttataaagacctcttccttcatcttcacatggagctctttctgtgtagctctgtttctatattttctgtccttataaggacccatactataagtgccccactctaattataacttcattttaacttgattatatctacaaatacctcttccttcatcttcacatggagctgtgtggctcagtctgtttctgttttctctccttataaggacccatactataagtgccccaccctaagtaagtatgatctcgttttaacttgattatatctacagagaccctatttccaaataaggtcgtactctaaggttccaggaagaacatgaattttggggagggtattactctcaacccaatacacaatatcttatgtaaactttggatacagaacaatctgagcttgaattccgactctgctacttagtagctatgtaagctaagacaagttagttaatctttctggttatatattagttcctttatatataaaagtatgataaatcccactttgttttaaagtttagaaatgatatttgtgaattaaccagaaagtatctgccgcacagaaggttctaaaaatagtaactgttattattttatgattattatacagaattacagcagcttctttcttttataaacattttgcttaattgtagaagcagtattttagaaacaaaatactaatctttaccaaacgtttggacaatttagtgaaagtgttgtcatactgttgctttgatgttaaggtataataactttgctttagctttgctagcagtatatttctccaagtccagccatctttctgagtattatgcagaaaaacactgtcctcaaggttgaccttaatgacaacattgtggttcataccacttcaaaccctccctttttttgctccttgtaagtttctttttttatttaattgttcaaccaatcaacagctatttataacctatatggaaagtattatattaggaattatgaaaaacagaagtattatatgatcctgcttacaaagaacttatactttatttgtcagaccagactaacgtataacatataaagcattattaggaaaatgaattgaaatttaataagaaatctgcctttttagcaaatattattccagtctttaaaatgggccaggcagtacacagaatatgcaaagatgattgaaatgatttgttcttcaagatggtctcagatgaatgagagatgaatgaaaagataattttcatagaatgtgataaatttaattataatcttatgagagtgttgtgtaacacagaaaagaatacttagattaaaagagaagggcttcagggcttctaggagaaggtgacatgaattgattactaaatgactagcagtagaaagtatattggggaaagaacagaagacaggataaggaattttgaggaagaggaaatagtatttgtgagaaaatgcacaggagcaaaaattatgcaagcattttgaggttattcataattcatagtataagattaaaaggcagtattgagaaaaacatgtaataaatctggagtaaaaagcagaagcagatcttaaaatggtttcaatatatggtattttgttccgtattacctgtgtggacaaagagaattgcaatagtattccaaaagaatatgatgaaggctggagaactgaggaaattaacacttatactagctttctattttaagtcggtacaagttgcttttatatgcattgtcccatgcaatccacatagcaactctataaggtgggtgttctccccattatgcagaagaaagaagtagatcaaaggtgttaagaaatttgccctaggttacacaacagataaatggccatgtctgtatttgttcaaaatgatgacatcatgaggggaaggtgtgtgttatggccgagcataagtcctgtgaggaaacacttagaaatttttacaatgaaattcaggtgatagatttacagattagccttttctcacagtacttattttcagccatgacacctaccttcccctcatgagttcatcatttaaaacaaattcagacattgccatttatctgctgaaacaaatctatattatatagggggcaatgaaattatgaaggcacgtaaactgaagcctacagcacagtttcaaagagggtgaaaattgttaggaagctagtgaaattaacatcaattttaggtttgtttcagctacttgagatatgaccccaagaatttaccaaggaaatggttatattaattcaggtgtgaagtcataaccccagatctagggtcagatgacgaatgctagggagggtgtttgccggtagtcagactaagaaagatagcataagaaaaagggagggagggagggaaagagagaaggagagggaaagagagaaggagagggagggaggcagagagagagcaagagaaagcatttaaaagaaagaaagcatttaaaagaaagaaaacttaatgtaaaaaagtatttaagttcaaaattggttggctattggaacatgaagaacacgtgaaatatttagggtaagcaaggcaatagtcatgtaactgacagagaaactgtgctggaggagtctaatttagtgaggcctatgggggtggagtgaaatgatacttcagtttcagacacacagagtttgagatgacagtgaaatatccaaacagcacatccattaatctctagatattgcacacgaaccagaatatgtagtagtgagatgaaacatgcatgtgagattgtgtctccttttttctccaatccttttttgatagttggaaatcctaacagacagaatctgtgctaaataagcaggtggtgtgaagtgtcagaggagtctgatttatttttcttaacagttagttaaaaatagaaagtgtatttgaaaaacatagatttttgttcagtgacctgtgtcacagaactgtcacaattacgctaattctgtagtcctttttggaggagcgtctgagaggatctgggggccatgggctacaagctaggttactttacctctctatatggtgacttcagagaatgatttcaaaataggatatatgttctaaaactggactgtgctgattgcacaactctgtacatttactaaaaataatggaatcatacactttgggtgaattttttgttacgttatacattcatgaagctgttaaagaataaaataaaataatgctatgtttttatttcttgctaaaaatggttatggattagttctgagtgaataccattgtaaatgacttgatttttaaaactgctgcctaataaaattccaatttatatgcaaaatatagtattaaatacacatgaatactgactctcttaaagtaatataattaataacagctttgtttactttatgttatactgtttttcttgtcatattcctaactatgtctggttcatataaaaatccaaattataagttaagaataaatagtgaaatattactatttattacacacacacacagaggtttgttttgtatcatgttgactacaacttggcaacagacacctgagaacatcactgtatataattttttctgtgttgcaaattttcaaaagaaaaaaacgttttctaatgatgtgggttatttgttttattgtaaattgtttaatcattgtctcatagttcttgaattcattaatagggaactgtactgggggctgtgatgaaagataagttaaaaatggttcatattctcagtgaacgttcctgtatgacaaggatgatatatgtgtagaaggtaattataatttgggtaaaacgtgataagaacagtagtaattattattttaaggctgttcagagttgaaggaggttgcctttaggtatatggatcaaagtaaatcttcaggtaaagtttctgtattagtttttttttaagtgtttttttcttttattattatactttaagttttagggtacgtgtgcacattgtgcaggtttgttacgtatgtatacatgtgccatgctggtgcgctgcacccactaacttgtcatctagcattaggtatatctcccaatgctatccatccccctcccaccaccccacaacagtccccagagtgtgatgttccccttcgtgtgtccatgtggtctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatcagtctatcattgttggacatttggcttgtttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttcttaatgattgccattctaactggtgtgagatggtatctcattgtggttttgatttgcatttctctgatggccagtgatgatgggcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctgtgtcctgaatggtaatgcctagattttcttttagggtttttatggttttaggtctaacgtttaagtctttaatccatcttgaattgatttttgtataaggtgtaaggaagggatccagtttcagctttctccatatggctagccaattttcccagcaccatttattaaatagggaatcctttccccattgcttgtttttctcaggtttgtcaaagatcagatagttgtagatatgcggcgttatttctgagggctctgttctgttccattgatcaatatctctgttttggtaccagtaccatgctgttttggttactgtagccttgtagtacagtttgaaggattctgtataagttaaatggaaataacaacaaatgtgttctcatttgtttattcaatgagacaggaaggaaaccattctaggaatatgttcttcaaatttaatgtctgtatccctatagtacacaaatactttcaaagtggtaggcagacagaaagttttaaagattaattttccacatccttaagattcttatgaattcttttcttgtgaattcatgggaacacttctgatgtaaaagcttcatgcattccccattgagtctccctatcacagtctcccaataaacacatgtgactttgacatccttatttgatagcccaaatctatgccagtgtttcctaaattttattgatccatgtatcactgctacgattttccatctctctgtatcaaaacataacacattttctgatttctgtcatattcatatactttactgtatcaacaatgttttctctgaatttttcatatttacttaaatgtatttgtaattatttgaaatgtgtatcagtttttcacttgtcagatatagaatataatgatacacataaatacatttccctttatcaaagaaaacacactgtagtccatcctttaccatacagagatgcaacacccaagaggggaaaacagtcaaaacaccaaacaaaaggataatcataaatattaatgtggatggtggaaagtaaaaattctaactcatgtaagctgtaactgacttgattttagcaatttatctttttaatattaaaagagaatcttttttgctgataaattaataattttattgtggataatgtagttttggaatataactcagaagaagtttaaagtattaagtaacattgttacaacaaagccttttctattcccatctactcagtatctgaacatgtttttaaatgcgtgtagtcaaaaactagaaaataggtacacccacctcattaagagacagagttctaatacaattttacattcgatttaagcatattgtatattaatttaagcagctgcttacaaaaaagattatattgataacttaatcctaaagaaaaagaagatttttagtcttgtgatctgcattttaaaaattggtttatatgaattgtgtgtgtagagaaatagaacaaccgtaaaaaatctcaagcataaccatatattaaattgaaaaaaattctatgggcaaaatagaatgagaatgttagttcagtaagataaagggacaatatgaaatttctgactcctaaaaagagcttgttcacatatttttaaaatgaattattgtggatttcaaataaccatgatatttatattattttttttccaaaagaatgatacagtagtatactggaaatgatatcattagcaattatttacatttctgttgtaaaaatttagatatcaatctacaaatatgtgatagtatatatgattttaaaaattatagactatatgagcagaaaattttgaagaccactgttgtagaataaaggcctagatgtacaaaaccttaaaaactttgatatatctagtagttcaattatttgatgagtaggacaaggcttggaacacaaatttgaaaagactgaggtgctcctggaaggctaatgctaccaaataggaaaacaagttgggtgactcatggaatttcacattttctcctagtcagccacattaaaaaaaaataaagaagaaacactggaaatcaattttttgttggtttgtttttgttttttgtttttgagatggagtttcactcctgttgtccaggctggagtacaatggcgtgatcttggctcactgcaacctccacctcccagattcaagggattctcctgcctccgccttcccaagtagctgggattataggcatgcaccaccatacctggctaattttgcatttttagtagagttggggtttcttcatgttggtcaggctagtcttgaactcccgatctcaggtgatccgcctgcctcagcctcccaaagtgatgaaatcaatttttaaaaaccatttatttaatgcaatacattcaacatctcatttaacgtataatcaatataaaaaatagaatttggaatctggtgtgtattttacacctatagatcatctcaacttggactatccagatttcacgtgcctagtaaacgcatatggctgtagcatccttatttgatagctcaagtctgggccagtgtttcctaaattttattcattaatgtactgctcctataattttccgtatctctgtatcacatcataaataaattttctttctgtcatagtcacatatatctactgtatcaacaattttctctgaatttttcatcctttttacttaagtttacctatattaatttggaaagtgtagcagttttttacttgttagatatggaagataatggtgtgaataaatagaatataaaatattattacatgtcaaatactttttgacccaagaaactgagcctgagtccagtttctctattagaaagactaagaaacagttgtttaagtgggatataaagtatattcaattttttctaaaaataattgggattaaagaaaaatagtaaatatcactatgttacttactctaaagtccacctgaaaccatatatatatatacatatatacaccatcagcatcatgtgtttcactcactggggactaaatctcagtatgaaacacatactgagtatgagatttagtcactggggaacatttgcaggtctttagtagggatcataagacacaactatatttcataagttaatcaggctaatctatagtactagaatttgatttgatatagaagattaaaaactcagaacattattttaatttctgtacccttcttacattttatatatttctttgtagtaaggaacttcatcatattttattggggtcattgagacatatctaactttttagcctttcagatgatctagaatgctgttacaaaaaaagaagctaaggaatgctggaatttttaatgtcaaagacaactatagaagagtctacaccttttttgttgtttctgttgttaatggtgagatatgagtcctagagaagccctctagaagggtacacaaaaggaagttatgaaaatgactgatctctacttgtttatagtcaattagatatgaagaacatggatctgtattctggtgacattaaataagagtagcctagagtcaaataatacaatcacataatataaagataaaattgttaaagcacatttatatctgtcaaagagcaacctctaggcttctaagtttttattactctaaataattttactagcatcttgaatatcatctgtgattagagaacatgaatattttctctggtaatcaaatgttattgcaaataatatcgtacttcctactgacacaatattattttattatgatttagctattagataaacatgtttttggaaattttaacttcatagctatacatcgtatgataaacgtttatttaaactagaagcaatttcaaaaggtatttctggaagttgccttgattggaatgcaaacatatttatctgtagaataaaacaggccttcactgtcccaagcacagagaagacattcagaaatatattttgaatgaatgaacaattccatttccattagtagccctttctactaatggagcaagatagaaagttttatgtgctgtgtgatttcctaagtaaaataaatggaggaatgaattccactagatggtaacaacagtgctataggcttgggaagattatggataactctattttatgttcctctttcttagaatgaaatactattattttatactgaaaactaatataaagttctaaaagactaccccttatcaaaagagaatataggttgagttacttcaagagtttgagaccacactgtttgccaaacgtcattccatattttcttaacacttttattaatacccccatcgctgctgttaacttattttttcatcatttccctgtcaaatttatctgtggaactggatttaatatgctttaaagcagattttttatgctcaagttatgcctattttaacaagcattttaaaaacttgcatttgttaattattttcaaatataaatgacatagtcaagagcatttcacttgactgggaaaaaaaagaactgactatgagctcttctagattatctcagattacaacgatatcagctttaaaaaagacaggttgtgttttggcatccttcttaatcttcagatatttgcttatcactccatgtcatatggcctgacatcctttctgtggcttgctatcctctgaatcattcctcgccttctcttgactattctgccaaatgcagctgttttctaagagatttcacaaaggttttatctgtgccgtgggacaaaatatgtctgcatctctctctctctttctctacttctatctctatatctatcatgtatctgtttatttatttattctgcatgtataacatatatgcaccactataacatacattcactttacaaaattgtgttaaaaaatattgataaaaaagaaatcacttgtaaaactaatgccaagtggtaattattaaatcagagagagagagagagacagactatgtagaactgtgatagaggaagcattttctttatgtttgagtcttatctgttaaggtaacttaatttcaaacaactactcaaaaagaaagctggtgtcaacacagcatatattttaatgtgttaaatatcacaagattagtgaattcataaacagtctaagtaatggtattcaatttcctatagcatatgtgttttgtaagagatagtggataaaatagtacatgcccacatttgatatgcaaataagatttttttggaaaagcttcttattttcccattgattactattaattttaagtttttaaaccaaaaaaaaaaaaacccatcagatcaaggaatgtgaagtttaatattctctggctgatcatgctttttgtttgcttctaaagacctggacctaagtactctctaaccttctctttatcttgctgagaaaggcagtgacgttacagcaaataaagactacatgaattcttattaaatactgttatttccacttctataataaaatgaataatttctgtttcagtacagaattgtcatttctcctatgttttttattttaaatattttcaaaacaaaaaagtaaaatgaacacccatataaatactcacgtagctcagggatcttcaaactagagtttcatggacaatttcagcttgtcatctgcttctatcagtagttttattggaacaaatctatgcccatttatttatgtattgtctatggctgcttttgcactgcaagactgagttgagtagttgtgacagagaccatatggaccaaaacctaaaatatctaccatctgtccttgtagaaaaagtttgtcaaaccttgatttagattcaccagttattaaaattttgctacatctgttttttctatctttgtaattatagataggtagattatattaatagttatatacatccacagattttatggatgtatatgtacacaaatatgcttttttctgaactatttaaaaataagtgtctgatattataatacttcagcatgtatctcctaagaagaacatcgtcctatatctcctacatgatcacaacattataatacgcgaagtatttaacaatggtacagtaatattgtctcatagacagtccatattcagatgtcttcagttgcctgactcagcatccagtcaaggagtatgcattgccattgatactttatctcttgacccttctttagtctataattctcctttgatttaactttcatgacatttccattttcacaaaatccaagacaatggtcttgagtcatacaatttggatttacgtgatgatttcctcttgaatttattaactattttgataaaaaatgttatgcagacaatgatacacacttcccattttatcatacagaaggactcacaatgccagtttgtcctataattggtgacactaagtttgagtcacttggataagataggatctgccagacttatttattctagtgatatatttaaattccatgttattgataagtagtaatgtccagtgatatcttgaaactatgtaaatattatgctactccacagttttatataatggatttaacatctattgatgatccttgcctgagtcaattattatactatagaacacaaaataaaaactttctaattacatcattccttctatgtttatgacctggcattcctctgtttaaaagttcttttctcttttctatcttttcatttcttaaaaaattattttaatattatggactcatggatttttatgtattcaatgtgaaattatacattacttgcaatattctttttgatacttaaattatataaactggctgttgaaaaccacttcaaactggcaactttgacctgttgtcttctttattccttcatgactgccttaaattctgaagcaacaaaatactcagggcccactttctgattcctctgccctaaaccttgtatgtactattctttaaggattcctagtttagtaagaaagataccaagatctgagtatgagatatgctcattgctagtggtgatttaacacaaaaactagggaatacataatcttagttacttttttcttattcataaattcttacctctaattcaaattcagtgatatatggtttttcctcacctctctcactctataacttgatctcccatttcctgtaatgagaatcatgactccccaaaattcagtatatgtacttatttgatttgccttacatatagatgaagtaaattaagaatcatgatactcactttgggaggctgaagagggcgaatagcttgagctgaagagttggagagcagcctgggaaacatagcgaaacccccagccaggtgtggtggtgcttgcctgtaatcccagctacttcggaggctgaggtgggagaattgctttaacccaggaggcagaagttgcgctgagcttcaacatctcgccactgcactccagactgggcaatagagtgagaccccgtctcaaaaaaaaaaaaaacaatctgatttaagattgttgactgtaatcagctcaagtctaatatggtatagacaaacagccttatcaactcttgtcaactattgcaatgcagtgtgatacaggttaagtctggaatgtatgtaagttggtgttatttgttttacatttttttgttttattttctaaaggaaatcacaatatcagtatcactacctaaaatctatttagaaaagttcaaggattttttgttttctctttctgttcctggaacaggagtgtttgctgtcagctaaatctttttaaaatttacttgaatttgttctttattttctgtgtgataatgctaaaaaagtcacattgagttagtttaatttgcttatattagcatataatattaaggtttgctttatcttttctcttaaatttagtttttaaaaaatataaaaacatttacatggttcacaagtcaaaactatacaaaggtacattcaaagaagtctcattcttatatctgttcctttcaacttgttaacacatcctcataagagatcattttcattagcatataatttatgattctgtgatcctttaaaaaaagaaaagcgtatacatgtgtgcatttaataaagttagtatgttattaatatacttcattttgctttaacatgttctggaataacttagtgtctgtatatagtgaacaggtttttctgtttttctcaattgcttaacactcaattatgtcaatatctcatagttttttcaagtttcctatgtattatgtctttatttgtgtctttttgaatttctttcatcaatgtcttagtttgtaatgcacagatctttcataaccttagtcaaatttttctctaaatattttattttttgatgctattgtaaatgggatttgttttcttactatccaaagtgatctacaagtttaatgcaaaccctataaaaatttcaatggattttttacagttattagaaaaaatcataaaatttgtatggaaacataaaatattctaaatagccaaagcaattttgagaaaaaagagcaaagctggaggcatcacagctttatgatttgaaggtgtatcacaaagctataataatcaaaagagtatggtactggcataaaaactgaacacacaacagagatcccagaggtaaactcatacatttatggtcaaactaatctttgagaagggcatgaagaatatagaatggagaaaggataaactctttagtaaatggtgtagaggaacctggactttcacatacagaatatcatatcatttcatacctgaattaatataaccattttcttgttaaattcttggggtcacatctcaagtagctgaaacaaactggactttcacatacagaagaatccagcaatcttctgtgtatatacccaaaagagaaaaagtcagtatgctgaagacatagctatactactgtgttcattgcagcatcattcaccatagcaaagacaccgaaataacctaaatgcccatcaactgatgaatgaataaagtaaacgtgaaataaatacatatatgtacatacatacatatacacacatatatgtatataccagacacatttacatatatgtatatgtatttacacacaatgaaatattatttggccataacaagcaagaaattctggcatttgtgatgagattaatgaaactggaggatattatgttaggcaaaattagcaagacaaggaaagacaaatgctgcataatctcactatatgtagaatctaaaaaagtgaacttggaaaagcagagaatagaatggtggttaccattagctggcggtgggggaaatgaggagacgttggtcagaagttacatataatcaattagaagatgaccacattctggggatttaatatacagcatgtcaagtaaggttaataatgccgtattgtaaacttgaaatttgctaagatggtagatcttaagtgttgtcaccataaaatgatggcaactgcgtgaggtgatagatatacattgagtagcttcctttatgtgttgggaaaattcctaaagaaagggaaatggtgtgaactttactgtatattatatacacaaattttatacaagtatgctttacccatgagtgtctgggagaaaaaaaaacctgaaaaaaatgtctctaataaaaaatatgggcactgagggagtctataaaagaaagtacaaatgctttgtgacaactgaaccttagaaacttctgaggtatttttttttttttatcaacaatggagtgctctttctgaagaatcacattggacattgtgagaaaaatttttctactacatcaattacttcatttttttttttgccatgtgctaagacactgttttagtcattgagggtacaaagataggtgatttaagattgttgactgtaatcagctcaagattaatatagtgtagtcaaacatccacaccagctattgcaatgtagtgtgatacaggttaagtccggaatgtatgtaaggtggcgttatttgttttacatttttcttgttttattttctagaggaaatgacacttaactgccatgaattacttctgtgaacatttgttactcatgttacaacaaggtgtcttggatttgctcctgacatattcctgtaaaaatccccattgatttttagggttgattcacttgatgtggctgttatgtaatgtgtacccttcctgtttcactgatactgcagctcacttggtcaaagaaaacagccttgtctaataaaggacaactttgattctaaccaaatctcaagatacttttgaaggtgaacttgttttgctaaataaatatttttctttttcatttcaacatgtcataatacattttaaataatagattacctctgaagttgaacagggagttgtattccctgatatgcaacctataaaagtttaataatggttttataagagagaatggggaagaaaagggcagtacttccagtctttatctgtggcacacatacacacacccacagaggcagaaagctggatgggattgtagatcatgtagtttgaaaataattcagtctttgtcctattggttttgtattgtctaagtcagaattttagattttttttcagtatttgtaaataagcagccacatagaggtataatatacacataatgtataacttacttattatgcacaggtggtaaattgccataagtgaacataactgtggaaccaacaaccagattaggaaatggaacattatcagtattcaaaaagaccctcttgtgcttctgcaagccactgcccccaactccctcagggaaaccactacataagtcaacctgaattttaatttgcgttcaagtagagcatagattgcaatatttatcaaagataacaaggttaaaagatgttggcctgaggaaaattctaggtatccatgtctaaacaccagtgcaaatccccaaagaaattatctgtttttatatagttctaaaaattattggtgataacattttcaattagagtttagttgcattacttaaatgtataagcttaaagatcttgttcatatttttgtggttttttctgctttataaaaactattagaaatcccttcttggacattatcacagtctttggtttttaaggtcatttgtactgtgtatgtatttaaatactaacctagggtatgttagactgcaaattaatttttgaagaatttttattgaaataatacccatgaccacttagccttacacataggaaaaaaaatggtcattttaatgtataattttattgtcttcatacaatgtaaaaattagcaataattttttaaagtgataatagtaatattatatttctcatcaatattaatgccaattaaatgcgaacgtttaaagttgctatctgagtatgattttccttgtaaaactccttaactgatgaccctgagtcgaccattggctggaattcaagttcatgagcgtgacacacaaggcccttcgtgagatgatccctgtcttcctttggaccttacaccactgctcttgtttatattacaaaaaataacaaactactagtggtttcctagcaactattgcagcttttcatgcctatgtaagtgcttatcctgctgaatacaattttcaccttttgtatgatataaagttccattcatctctcaaaaccccactctgattcttccttctcttagtctttatggactgtgatcaccaattttaatctcctttttaagtttgttgcttcttccttgacattttttccaagttctagaatggtttaagttttcgaaccacccctataacattatgagtttctaaggaaggagcaggaactatttcttaattaactctgtctagtacattgcagatgctcatcaaatacttgtttgtgggtaaatcttcccaacacttatcagagtgataaaaaaaaaaaaccaagtaatttagtgattgttaaatgattagctttagaaaacttcaggttttttttttgggggggtgggtgttaaatttattttgccctgtaaaaggagttaatctgattcctccccttttgtttataaagtttgtgtgtctcatgagatcttaaagatagaaacaactttaatcgagcccaatttttttaagaaattcataggagaagtaaaaaaaaaaaaatgctctgttacagaaacaagttaaaaacagactaccttgtatcccttaatgagagctaggaggcctacattgtctctccaactgtcttccaagggcctgaggtccttcatggggtctacagacttgaaggcagttctcgggctcatcgtttttatcccgttgttgcctccagttacttatttgctttattctgtcctgttacttcaaatgttttgaaacagcttcttctcttagaatgtatgaatgagcaatgtttcagttccgttagaaacatgactcttttctggctacccataataaatccgctctccagttttgttcttttctactacattaaagccattataacaaaatattaaaaaaaaattttctttcaaaaaaccagtaacccaagtatctatttcttagtgatttggctgcatttataggatattttatttggatctattttataatcacttgaaagcgtcactttggtttggttcaggtctgtggacctgaataaattgaccatgctttggcagagccatcagaagagtattgtggccaatcctttaaatctctgcagatgctctatagctaagtcaatccaaactgatcatcattgtggccatactgagtggtttttactctgccatgggcgtgatgcttagccataaaaagatttacctttgagtgataatatttttgtattttctgctagcgtagtttcccatttccaatgacattgggaagtaaaatatcttgcttttttaatacggtcattttcatttatgcttttttattgttccttaacaatgaaaaataatgtaaaatgatataaaacctctgagatgcagatttcctggggataaatggttggactgattaaatatctgttcatgacactgttcagaatgagtcttcatgtcattttggaaatgaaggttaatatctaatccagttaaatataaaaatatattgtgattaatgtctcatctactgaagagctttggtcaaacaaaaacctcataactttaaaaaacaaatgagagaaagaaagaaacaggtagataattactggaaaaataatctaaaactattcttaaaattatttaaggcactcatattttaagttttcttcgggcatatgcaaaactattggatgtattagataatctctgtatcacatgctctctctctatgtatatttacctctgtgtgctataagtagaattttgtactcacgttatgataataatgctaagcattaatatattttaagtgaagtttccactttatatacgatcttgattgattatcaagtatttttacgttagcgttcccatttaaaaaaattatcaagaaagaaggaaaagaaaaactccttaataacgttaaatataggttaataaataaagacattagaatatgtgttggttgtaaataatttacatcctctatgcttagagtaatttggagaaaattcaatagttctttatagtcatatcttttcatagaatttatatttgtattgctaatttggtattctaggtaaaatttatttctgcccttgaaatgattttcattttcattagtcacttggtcatttattgaatacatgtttattgagtaaacactctgtgctaggcattgctagcataatgaatgagaagaggaccgtgactttatggggttaaattcagtagagccctagagcatgtgactaactatattatgctgcagaagccacacacacagcatcctgtaggagtacagagaaggcagaaactaactcttaaggagaggtagaaatgtcaggagagcttttcagtaggtggggatgtttaatttacattttaaagaaatcgatttcaaaattaatacccaatttcaacacaccatttatagaaaaaatttctctaaaagcattgctttcctatcattatcaatttttttttaattttcctaggccatttttgggaaaagaaagtggctattaatgacttacataactcatactgagcttaaaatatatatattgaaatcttcatttaaaagtagaatgttattctcagtgttctttccataactttctccgtctctgtggccccatctttgttttgatgagactcaaaaacattgatcctgttaacttttattttcaactttcaatggcctagtggtgcttgcataaatatacagcagtgctctctacgggacagaagctaatcaactcatgtggaacacgctttattactgggtatgaaggatggatatcttataggaaactcaatgacaattaaaaaaaaaactattcaaaagcgactgcaaagaataataccacattttaacttgaaatatttacaagactacttaaacctctttctagcaactggtaaagttcaggaccagccccagctccaatgtgaacatgagatgcaagcaaactttctgctttctctaagaaattatgttattttaaaaatgtcattttttcatttctaaccaaaatgttatattgagttttttcatttgatttacttttacaatgttcttcttcagtggaacagcaaatattctacttcccaagtagccatatttgattattattataactttaaagaaattaagttgaacagatgtttattatggtgaatattacattcactgaaatatattcatgattttgacaatttactattcaaaaaaagtagtgtttacagtaagacaaaaataccttttgaagttcacatgtatcttttaaaatagcgcaatgacatgctgcccatggatattgaaatttttgaccatgattacaaatgttgtgcatctcatcaaagaaataaaagcactgttcttctgttcaggttgttttttgcatttagttataaaagttaattctaggcaaattggtctggcaaaataaatcacgaatgtataaatgcaaaattaagagagtaaacgatgctaacacaatgtctcaatttcaaaaataacatgtttggaatttagtcttccactgaacttttccactataaaaactaatttttaattacttgaaagcaattttatataaggtcaatcaaaaagtgttaattctcaagataaaaaaaattgttcttgacagtttttttctgttagactagtaaatgtgtggttgccaagggtatatttctaaattgaaagcttcaaattcctattttttgagtgctccgcaaacctcaggtgtaacagagttgatttttaatgccaaaacatttcaaattgagtaacaataatagtgctaattatacaattccacttttacatgatattttatagtttatggattactttcacatacatatgtacgattttacctaatcactccatccacagttgttatacagattatatataatactacatgtgaaagcagtttaactgacaaccccattaaacacaggaagaagaaatggtaattgggtattctgtgatattgtttaacagccataataggcgtacccttacactagctttatctctgaatattttaggttatataaccatatatgactccattttttaattcagattgagttgaattttttttcaacttatcttaccagatgcactgttcacatcctctgtagtgtttaagccttgttctctattaaaacaatctctttcataaaactactgaagtcaaaggcaaaaactttgtgatggattcccaaaaacattctttaggtatgtcctgcttggatacacaactcaggttttcagacttgttcagctgactctattaaagactgagaagtgttgtcatcttgatcaatattgagcaatgattaggtgtaggtctatgacatcaccttactctaaaaccacagttaaactgttttgtgtttagactgtatgctttaaaaatccttatttctgagtatctaacaggattttcttaactattatatgctttttaaaaattaatgtatattagaatagatggataaaagctcttattcctctattctgtggggaattggttcttattccccatcaaattgtggaaacaagtacgtgccctgttgaatcctgtctaaataaattaatctcatagtcattgtgattatgtgtcaggaagagatggccaaatgaaagttcatcataggttaaagccctaattgagaaagcaaccagatactttattatgcatcctaagatcttctccaaggacaagtaataaactaaaaaaaaatcaatgtattaatattatcatcactatgattattttggtaagaaataaaaagtgagttcaaaaactatatcaataaaatattcaccatttctgaatttaattgaaattaatatcaacaatttttctctatttgtgttaaatttataaaagaatatggtaaattaatttcatagcattttattacatcattctcaaataattctatataagtaggtgtgttgtttttctcaatgtccaggtgaactggagagattatatagtgttttattttaaacacaacaatactaccattttatacctcatcagaaaatttttaaaaagacacccattattttctaattaatacaatttcttgaaacatttccttaatctatagacattttaatatcatattatgaatactttataaacatttgcatatttaggaggaaaaacagttttcataaatgatttctgtatttctaaatttgtagaaatttttctctacaagtttgtagaattttaggcaagaaaaaattcagaagaaataaaataattaaatgtataactctcatcaaggcatttattcattttctgtaatcaggctgaattcagatatggaaatagaatttttaatgtatttcaagcaaagtagttataaaatttgactctcttgtgaatacaacactaagactttcaaagtcttctacttgtagagccaaatagactgacaatcattctttgattacatttacttagaatatgtgatacaaaatcttgttaactttccagaagactggtaaatttccagcttcccttagaataattgtaatgatagctgaggtttcttacttgttttctgtgtgccaagtattagtccttgtacaagggctttacatgaagaatttcttcaaattctaacagtaacactatgaggaatagggttatgattcttactatattgacaaggaaattgaggcattgaaagaataagtaacttaaaaaagtatcttgtagcaatgtttaaactctgtttactgctcaaaggaagttcttattacatcagtttgtggccaacaacaaatcccttgcatataactaagaaatcataatatgcagaactataagttctcagtggctgtgcaatccacctagaccccatgatctgctcccttcaattgcaccaggcaattcagatgccacccttgtagtcaggactcctactacatcttagagtggaatgttccatggcgcaatgatcctttccacactcaaattgtccatagtttcttgatacgtatacgtgaagagggagcatgttgttgttcagcatagaaggagtctggacatggatattatatagagactgtcatgatccttaaaaatgttttggcaacgttgcctcttctcttgcctagcagataaactactggtagtttctgttactgttatcaagtcctccttcttagtttttttcccccccttcagattaattaagccttttgcatgcagtcctctgcagaaataagtattactatttcatacgttagtatatttacaagcaagtgtgtgaataatatagattatcaatgctgaagaagatcagggtaagaggagaatatggctaatacaagattattactacttaattatcagtatagaagattagaaatttgcttagaaaataattttgaatttagctgggaggaaagaaaagacattataacgacactttaaatgagaaatgaatgaataaaggtcgggttgagaataaataagtgaattggattttaagagtgagattctcaacttagcaaagcactcaaaagggcaagtaagcttgaaccaacacaacagatgggagatcagagtgtagtccaagagagtttattacaaggattagctctaaaatctaatggacaatattaaaattttaagaacagtttgcatttccatttcacagtatgtttacttttgttataaaaatacttcaaagtgtttaatccttaccttcaaatctagagtaaaattacgctttataaaattgtgtggttttttgtttgtttgatgttatgacatagaggaacacactgtgccacactgtcaataaatgagttttaaaagtgcaacttcaaggaaaatgtgttaagatcacagtgggagaaaatgagagagaatccttggtaaatcaggtgggcttaatttatagataactttgtagatcaggaagggaaagggaagctgctggaaacacacgtggcatcttaggaaatttgaacacacaatgtttcatgttcccataaaaatattggtagatgctaattgatcatgttgtctttgtatttactcctgcaaattccaaatttagtcttagttctggcagaattgtgtctgcttgataggatattttagtttataccacatttaagaatcaaatagcacacacacattcagaaaatgtgaaatattcaagagtaaaataaattgttaactgcctgaaacatgagctgtgtcctttcattgttgcagtccccacacaaggttttagatatatgtattgctcaactcaacaggtattgctcaactcaacagtggagtaacagatggcacttatattttgtgaaatgacttattttcatgtttcttggcatatgtgactcaatgcattatttaaggtggaattgtaatatttgtaccttaataataacttcttaagaatgagaagtggccaagctcctctcatactaagtgatatattgaagttagcatcttcatgaatgtcttcttaaccccttatcttgtagctactataccatttatttttgcattgccttgtattttagtgaatatatgcacatgcttaccctctcctgaccctatttgcaagttcttgtaatcttactgagttggaacgctgaccatagctcctacacccagcaggtactcaatgaacaattatgggtttcaattcgatcaacatactttaagcattcaagaacgttccatgtctgtaagcaagtgtttgaaaaatctcaatagatgcagaaaaggcctttgacaaaattcaacaacccttcatgctaaaaactctcaataaattagggattgatgggacgtatctcaaaataataagagctatctatgacaaacgcacagccaatatcatactgaatgggcaaaaactggaagcattctctttgaaaactggcagaagacagggatgccctctctcaccactcctattcaacatagtgttggaagttctggccagggcaattaggcaggagaaggaaataaaaggtattcaattaggaaaagaggaagtcaaattgtccctgtttgcagacgacatgattgtatatctagaaaaccccatcgtctcagcccaaaatctccttaagctgataagcaacttcagcaaagtctcaggatagaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttcaagttcatatggaaccaaaaaagagcccgcattgccaagtcaatcctaagccaaaagaacaaagctggaggcatcacactacctgacttcaaactatactgcaaggctacagtaaccaaaacagcatggtactggtaccaaaacagagatatagatcaatggaacagaacagagccctcagaaataacgccgcatatccacaactatctgatctttgacaaacctgagaaaaacaagcaatggggaaaggattccctatttaataaatggacatgggaaaactggctagccatatgtagaaagctgaaactggatcccttccttacaccttatacaaaaatcaattcaagatggattaaagacttaaacgttagacctaaaaccacaaaaaccctagaagaaaacctaggcattaccattcaggacataggcatgggcaaggactccatgtctaaaacaccaaaagcaatggcaacaaaagacaaaattgacaaatgggatctaattaaagagcttctgcacagcaaaagaaactaccatcagagtgaacaggcaacctacaaaatgggagaaaattttcgcaacctactcatctgacaaagggctaatatctagaatctacaatgaactcaaacaaatttacaagaaaaaaacaaccccatcaaaaagtgggcgaaggacatgaacagacacttctcaaaagaagacatttatgcagccaaaaaacacatgaaaaaatgcccatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactaccgcaagaacaaaaacccaaacaccgcatattctcactcataggtgggaattgaacagtgagatcacatggacacaggaaggggaatatcacactctggggactgttgtggggtgggtggagtggggagggattgcattgggagatatacctaatgctagatgacgagttagtgggtgcagtgcaccagcatggcacatgtatacatatgtaactaacctgcacaatgtgcacatgtaccctaaaatgtaaagtataataaaaaaaaaagtatgaaatacctagctgtttttgtgtggtcctgactactttaaaagctgtgtgccttgatactctagtcactactcaaatgtatgtacacatagtattttgcagatgatttcagaagatgaacaaaatccctgaaagtcatcagtcaacccaggttcagaactttttactattattattatactttaagttctgggatacatgtgcagaatgcgcaggtttgttacttaggtatacatgtgccatggtggtttgctccacccatcaacccgtcatctacattacattaggtatttctcctaatgctatccctcccttagccccccacccccacataggcccaggtgtgtgatgttcccctccctgtgtccatgtgttctcatttttcacctcccatttatgagtgagaacatgcggtgtttggtgtatgttcctgtgttaatttgctgagaatgatggtttccatcttcatccatgtccctgcaaaggacatgaacccatccttgggttggttccaagtctttcctattgtgaatagtgctgcaataaacatatgtgtgcatgtgtctttatagtaaaataatttttaatcctttgggtatatacccagtcataggattgctgggtcaaatggtatttctggttctagatccctgaagaattgccacactgtcttccgcaacggttgaactgatttacactcccaccaacagtgtaaaagcattccaatttctccacatcctctccagcatctgttgtttcctgactttttaatgattgccattctaactggtgtgagatggtatctcattgtgttttttttttttttttttttttgagatggggtcttgctttgttgcccaggttggagtacagtgacgcgatctcgactcactgcaacctccgcctcccaggttcacgccattcttctgcctcagcctcccaaataggtgagactacaggtgcctaccatcacacctggctaattttttgtatttttagtagagacagggtttcaccatgttagccaggatgatctctatctcctgacctcgtgatccgcctgcctccgcctgcctccacctgcctatgcctcccaaagtgctgggattacaggcgtgagccaccgcaccctgcccttattgtggttttgatttgcatttctctaatgactggtgatgattagctttgtttcatatgtttattggccacataaatgtcttcttttgagaaatgtctgtttgtatccttcgcccacattttgatgggattttttttcttgtaaatttgtttatgttctttgtagattatggatattagccctttgtcagatggatagatagcaaaaattttctcccattctgtaggttgtctgttcactctgatgatagtttcttttgctgtgcagaagctctttagtttaattagatcccatttgacaatttttccttttgttaccattgcttttggtgttttaggtatgaagtctttgcccatgcgtatgtcctgaatgatattgcctaggttttcatccttataccaaaacctagcagagacccaacaaagaaaatttcaggccgatattcctgatgaacatcgacgcaaatatcctcaataaaatcactagcaaactgaatctagcagcacattgaaaagcttatccaccaccaccttatcaagtcgacttcacccctgggttacaagactggttcaacatatacaaatcaataaacataatctatcataaacataaacagaaccaatgacagaaaccgcctgattttctcaatagatgtagaaaaagcctttgataaaattcagcaccccttcatgctaaaaactctaaataaagtaggtattgatgggacatatctcaaaataataagagctatttatgacaaactcacagccaatattatactgaatgggcaaaagctggaggcattccctttgaaagccggcacaagacaaggatgctgtctctcaccactcctattcagcactgtattggaagttttggcaagggcaatcaggcaagagaaagaaataaagggcattgaaataggaagagaggaagtcaaattgtgtctgtttgcagatcacatgattgtatctttagaaaaccccgtcgtctcagccccaaatctccttaagctgataagcaacttcagcaaagtctcacgatacaaaatcaatgtgcaaaaatcaaaagaattcctatacaccaataatagacaaacagggagcctaatcattagtgaactcccattcacaactgctacaaagagaataaaatacctaggaatccaacttacaagggatgtgaaggacctcttcaaggagaactacaaaccgctgctcaaggaaattggaggacacaaacaaatggaaaaacattccatgcccatggataggaagaatcaatatcgcaaaaatggccacaccccccaaagtaatttatagattcaatgctattcccatcaagctaccatgtactttcttcacagaattagaaaaaaactactttaaatttcatatggaaccaagaaagagcccatatagccaagacaatcctaagcaaaaagaacaaagctggaggcattaagctacctgacttcaaactatactacaaagctgcattaatggaaacagcatggtactggtaccaaaacagacatatagaccaatggaacagaacagagacctcagaaataacactacacatctacaaccatctgatctttgacaaacctgaccaaaaccagaaatggagaaaggattccctatttagtaaatgatgttgggaaagtggctagccatatgcagaaaactgaaactggaccccttccttacacgttatacaaaaattaactgaagatggattagagatttaaacgtaagaactttcattcagtttacctcagaatgccaaaaaagttaagagaatcgatacgctatttgctagacaaattcttatttagataacttcttagaaacatttagatgtaaccaaatgagttttctgattcggtgattattggcaagtatgttcggatatgaattttaaatgtatggaatgatagtttttcatttgcttctgaaactacatgttttttttttgttttttatttatttatttattattattattatactttaagttttagggtacatgtgcacctgcacgttttggctttaagaggatgatcttcttaaccagggaagaaatacagaagaaaaatgagtagagtgaagaatgtatgtaaatgcactttagaaagaggagagaatgtgttatatttaaccaaaaacagtatttttaaattatcatttaagagacagtgatcatgaaattaggacctgttcaactcttaacataaatgttatatattttccatattaaaaatctttatttaaaatattttttaaaacattacttataaggtataatattaaacttatatttttagcagtgagaatgtatttgaggttttgtcttcaagctttagttgcaaagagaaaagtagtttttacccagaaaaaaaaaaatggccaaggaatgattcaacatcctatagtggcacgaagccaactcttctaatcaataagttgtcattgccagtaagctgaagaagaaaagaacagaaatggtttacaattggatatttccaattatttcaaagaagaaaaatatgttaccagatatgagtcaagatgacataaagtacatgatttgtctctattaactttgaccagaaccagaaaaaaatatatcagacatgtgctatacatataattaagccattaatacacaacttaaaatctctcgtgacctcattctataaggcttaaattcctgaaaaatttctccttataccattgccaaaacatgtagctaaccagaccatatacggatctgattccaatcactgtttatctcattttaatgtggtttctttaattataatgccattataatttcaggtcaattaagaatggtgtgtaaatcatacagcatttactaaaatcctaacatgacttgattaaactttctttgtgttcttggcacccctcacattcatgatcaaaagaatacaaaatctcccatggctttgcttcgttctattttcaggtgatctcttccagtttgtacactttttctgtatcttcctcatatagaaagtttttacgattttccgtgatgttacctatttttagtttcttaacttcaacatcttcctctctgaattcctccattaatgaatactgtctattcctcaagtttaattgcctcttattatcatgaataagtttccttgttaataacatataggctgtggagggcatttcaaaaaattgaagttaaaaactgtcttgggcaataaaagccagtagctcttagaggtgaacacgctcaaagacaggacttatttcggtatataaatttttgtatacctatagaaacatctcattaatttattgtgtagctcataaacacattatttttatgtcattcccttttgtaatgagaaatgatgaaaaatagattttagatttctgttttgttcagcaatacttgttcagtactgaccccatacaagtcacagtgataggccttctagaagttgatgcaactttttacattattgcagcagataacaactttattatatatgcagagtgtgctaaagatgcctgtaaggaaacacatatgataaccatcactaggaaatgtacctattaaaatttttactccatcacctcttggccagattaaatttctcctcactagagatagtaaaaaacttagttgtatcgtgtgtatattttcattgttcaattctgaaaaaatctattttatatacggggaatgctttttattaagggggctcaatttcagatttcatcagcacagctctttcaacagtctgtgttagctgactttctgaaaaaacgtttccaataagagcctctcaaaatctagtagcttaatattttatttctaaaccttttattaaaattatattgtaaaaatctaacatctccccaaaaccgtgctcattaactctgggaatctctactgttctaagaaacaaacaaaaaaaaattataagaaatagtcctatgttactttgaagaatcagtagttgcatatcaaactgattttattttaaagctgttgtagcaatattagatataaaaacaatacaaattatgattatgaaacaatttgtagacttcccattttgtaccagacaatgtactcaaaaattcatacatattttctcaatattcagaacagccacagtgaagtagttactattatcctgattttacagattagagagattaagtaacttctctaatgtaagacagataatgaacaacagaactggggtttaaacttgaggaaaataagttttaagaaatcagaaattaagtctttggagataatttttcatgttataatggaaattataaatggaataaactgcaataaactatcatggaataaactgacaaaatattgcataccttactgtagatgtaatgggcaattgaataattatcacttagcttcctttgcttccatcagctgtataggattccttccaggtttgatataattcttaaaacattgcttcctgttattgtattttagaatatgttctttcactgtttgaaatactacatcattttaagtttttctctcttaaatcttgtcttccacccatgaagttatctccttaaccaaaatagaacatgattccttgattgagatgagaaaattttttatttcatttttgtttagattcatgggatatatgcgcaggtttgttacatggttatattgcgtgatgctgaggtttatggtacaattgatcccatcatccaggtagtgggcatactacccaatagctagtttttcaactctttctctatctccctgcttctctcctttagtaatctgaagtgtcttttgttgccatctttatgtccttgagtacccagtgtttagctcccacttataagtaagaaaatgcagtttttggttttctgttgctgtgttaattcacttaagataatggcctccagctggatctgtgtttctgcaaaactgaataatttgaaagacatgatttcattattttctatggctgcatagtattctatggtgtacatgtgccacattttcttttttaaaatttttattttaggttcaggggtacatgtgcaggtttgttgtagaagtaaattgtgtttcataggagtttggtttacagattattcctccacccaggtaataagcatagtaataggtaatttttgatcctcacccttctctctccttccacctcaagtagaccttagtgtcttttgctcccttctttgtgtccagatgtactcaatgtttagctcctacttgtaagaccatgctgtatttggttttctgttccagcattagttggcttaggataatggcctccagctccatccacattgctacaaaagacatagtaacatacttttttattgcagcttagtgttctatagcgtgtgtgtatcacattttctttacccagtctaccattcatgggaatttaggttgactccgtgtctttaatattgtgaatattgctatgatgaatatacacatgcatgtgtttttatggtagaatgatttagattccctggagtatatacccaataatgggatttctaggtcacatggtaattctgctttgagttctctgagaaattgtcaaacaagttttcacaatgctgaactaagttacattcccactagcaacatataagccatccctttttctgcaacctcgccagcatgttatttttttgacattttattaattgccattttgactgttgtcttattctgcttttgatttgcatttctctaatgactagtaatattgaacagtttaatatcctttttggccacatatatgtcttcttttgaaaagtgtctgtttatgacctttgcccaccttttaatggggttgttactgcttattactttttcagtttcttatagattattagaccttagtcagatgcatagtttgcaaatattttctcccattctctgtgttgtttactttgttgatagtttttttttttcctgtgtagaagcttaagtttaagtagatctcatttataaatttttgcttttgttgcaattgattttgggggtcttagtcatgaactctttctccattcttatgttcagcatggtatttcctaggttatcttccagggttttaataattttaggttttgcatttaaatctttgacccatcttgagttgcttcttgtatattttataagaaaggggtccagttttgaccttctgcatatggctagcaggttattccaacatcatttattgaatagggagactttccccgtcacttatttttgtctactgtgtcaaagagcagatggttgcaggtgcatggcattatttttggtctctctattttcttctattcatctatgtgtgtgtatttataacagtagcatgctgttttgaagttgggtcacgtgatgcctccaggtttgtcctctttacttaggattgccttggctattcaagctctttttaggttttataagaatttttaaatagtgtttttgaattctgagaagaatgtaattgaaagtttgatacagacagcagtgaatctgtagattgctttgggcagtttggcatttttaacaatcttgattattcctataagagtggaatatttttctatttgtcttttctgatttcttagagcagtgttttgtagttgcattttagagatctttcacctccctggttagctgtattcctaggtattttattccttttgtggtcatagtaaatggatttttgctcttgttttggctctcagattggatcttgttgatgtataggaatgttactgatttttgaacatttaatttgtatcctgaaactttgctaacattgtttgtcaaaggcttttggtggggtctttagggctttataggtatagaatcattttatcagtgaagatagctagttttgacaacttttcctgtcaggatgcgttttttatttttttctcttgcctgtttgctttggccaggatctccaatactatgtttaataggaatggtgaaaatggtcactctttcctcgttccagttctcaaggggcatgctttcaatgtttgcctattcagtatgatgttgactgtgggtttgtcagagatgacttattattttgaagtatgtttcttcaatgcctaatttcttgagagtttttaataggaagggatgttgaaatttatcaaaagccttttctgtatctattgagatcaaatggtttttgtttttagttccttttttgagatgaataatttattgatttgcatatgttgaacccaccttacttgactgtggtgggctaggtttttgatgtgctgctggatatggatatggtttgctagtattttgttgagaatttttgaatctatgattattgaggatattggcctgaagaggggtgtgtgtgtgtgtgtgtgtgtgtgtgtgtgtgtgtgtctgtctgtctgtctgtctgtctgcaaggttttggtattaagatgatgctggcctcatggaatgaggtaggagggagtccctacaactcaaccttttggagtagtttcattggaatggtagcagctcagcagctcctctttatacatctggcagaattaagctgtgaatctgcctggtcctgggcattctctggttggtaggcttttcttactgtttcaaatgcagaactctttattgttctgttcagggattcactgtcttcctgattcagtcttgggtggttgtatgtttccaggaacttatctgtttcttttaggttttgtagcttgtgtgcatgcaggtgttcatagtagtctctgagagttttttgtatttctgtgaagtcagtggtaacatcccctttgggatatctgatagtgtttatttggatcttccctcttttatttttttgcctgtattagtctactagcagtctatctatcttattaatttttttttttttcgacacagtctcactctgtcgcccaggctggagtgcagtggcgcaatctcggctcactgcaacctcttcctcccaggttcacgccattctcctgcctcagcctcccgagtagctggggctacaggcacctgccaccacgcccaactaatgttttgtatttttagtagagacggggtttcaccgtgttagccaggatggtctccatctcctgacctcgtgatccacctgcctcggcctcccaaagtgctgggattacaggcgtgagccactgtgcccggctctatcttcttaattttttaaaataatcagcttctgggtttattaatcttctgtatggtttttcacatctcagtgtccttcatttcagctctgattttatttcttgtcttccgctagatttgggggtgatttgctgttgtacttctagttcctctagttgataatttgagatcttgctaaatttttcagggatgtgtttcatttttataagcttccctcttaacactgctttgtatgtgtcccagagattattgtatgctatattttgtttttcattactttcaaaaaattccttgatttctgtcttaatttcatcatttgcccagaagtcgctcaggagcagctgcttaattttcatgtaatttgattgtttgcatgattctcttagtattgatttctatttttatttagctgtggtataagagtgtggttgatttcaatttataaaaaaataatttaggattgtttatgaattatttttggtccattttggagtgtgtggcatgtgcacatgagaagaatacataatctattgtttttgtatggagagttctgtagatgcctattagttccattaactcaagtgttgagttcagctcctgaatatctttgttagttttctgcctcgatgatctgtctaatacagtcagtggtgtgttgtagtcttccattattattatgtggttatctgcatctctccataggtctctaagagcttgcttttgaatctgggtgctcctgtgctgggtacatagatatttaggatagataggtctttttgttgaattgaaccatttactgtaaggtaatgtccttctttgtctttttttttttttttaatcttcgtaggcttacagccttttttgtctgaaattagaatagcaatcattgcttttttttctgttttccattttcttggtagattttcctccatccctttactgtgaaagtatgggtgtcactgcatgtgagatgggtcttttgagacagcatactatttggttttccttgtttatccaactttccattctgtgccttttattggggcattttgcctgtttacattcatgattagtattgatatgtgtggatttaatcctgtcatcgtgtttgttagctgggttattttgcaaacttgtttatgtggttgctttatagtgtcactggtctgtatacttaagtgtgcttttgttgtggctgtaatggtctttcctttccatatttagcactccttcaggatgttttgtaaggcagatcttttggtaacaaatttccttagcatttacttatctgtaaagaatcttatttttcctttgtttatgatgcttagtttggctggatatgaacttcttggttggaaattattttctttaaccatgctgaatataggctccctatgttttctggcttgtatggtttctgtggaaaggcccactgttagcctggtgggactccctttgtagatgacctatcctttcttgctagctccacttacctttttttctttcattgaactttggagaatctgatgactatgtgtctttgagatggctgtcctgtataatatcttgcaggggttctctgcatttcctgaatttgaatgttagcctctattgcaaggttaaggaaattttaatggaggatatcctcaaatatgtttttcaagttacttgctttctctgtctctttttaagggatgccagtgaatcatagatttgctttctatacataatcccatatttcatggaggtattgttcattcttcttcattcttttttctttatttttgtctgactacattctgttagagttggtttttgagctgagagattctgccctcagtttgatcagttctgctgttaacacttgtgattgtattatgatatatttgaagtgagtttttcagctctagcagatcagtttgattcttaaaatggcatttttgtcttttgtcttctgtatcattttattgtattccttagagtttttggattgggttttgactttctcctgaatctcagtgatctttattcctatccatattctgaattgtttttctgtcatttcagccatttcagcctgattaagaatcattttctggggaactagcatgatcatttggatataaggagaactctgccttagtgagttgccagatatgttgtgctggttgtttcttatctatgtgagctaatgttctttcaatcgctgaagctgttatcctttagatctttttttttttttgtatttatcttccttgtgttctttaaatcatagacattgttaccctttggatctttttttaaaaaaattatcttctttggtgtctttggggctttgagtgtggtattagatggattcactcaactgtcttcatttctggtagattttatggggtctcagactcggctcaggactcctgggctgcatgttgtaaccctgagagcagttatgaggtcactgacttagttatctgatccattgaggttaggaacttgcagttctaaggtatttttggaccaccgatcacaacactctgttgaatgtgccagccaaagtgcttcatcaggcagtttcagtgggatctgtcctcattcccacatgccagcagcaatgctagagggtggagtgcatgtgcattagctggggtggggcactggcaggtgtggggtgttggcttctatacagatgtttgtagcagtgatggtggcaatgcaatgtgggtggggggcagggccactggcatctgtgcactcaatcacactgctagcagtgttggcatggggacatggtacttgcaggtacagagctggcagtatttgtgtgcacgttcacttcagtagcaatggcagtgcagggttggggacaggtctgctggaatctctgggcacatttgcaccagcaatggtggcacagtcagggagtggcagggtgtgctccagccggcactcatagcgtggtggagtgcatacacacatgtacatccattggggaggggaggtgatgtccacctgtatgcatgtgtgctggcaaagtgataggggggtagccataggcaagtgtatgctggcaaagttgcacagggaaggatatggtggggggtaagtgcgagtgacctggtgcacttcacaaatggctgctctgctggagctgtccgatggtcaggtgcagtctgccagcatatgagctatgatacgggcccccagaaggcactctggctgggcatctgaggctgcactgtaagcaggcacagccagactgaaactccaggtgaggccagcagacagggggctgctctggtagaactggtcctatctcggggcaggatcaatctgctcttttcaggtccactagctctcctagggctcaagtctcctagggaaacccagcaaggcttggaggatggacatccctggctgagcttcactgcagacactcctgtgccaaatcctctgggtgctacactggctgggtttttttcccctactacatctctaagcagctctccctgacaactcaagtgtctctggaggtcgtgtggtcttctgctgccaggattccaggggtcagttgtgagggcaggctgctcctcacctgctcaattcactccatccctaggagtctttgggtgccaggaatgagtcccagggcaccctagcttcatgcaggattccccatgtcctccctcttctgcctgacatctgtgtcctgggcccttggtggcagatatccctcctggctacatctagtcagccatcttgacactgtatcacatttcttaatgcaatccaccatcgatgtgcagttaagttgattccacgcctttgctattctgtgtactactgtgatgaacataggagtgcaggcgtaatttttgtaaaatgatctattttcctttggatatgtatccagtaatgggactgataggtggaatggtagttctggtttaagttatttgagaaatctccaaactgtttttcacgttggctgagcaaatttacatacctgccaatagtgtataagtgttccctttacactgcagccttgccagcaaactttaagaagccaaaaaacgttaagaaatcacttttttgaatctgtaataactgccattctgacttgtgtgagatggtgtttcactgtggttttgattagcatttctatgatgatgaatgatgtgaagcattttttcaggcttcttggccacttgtatgtcttcttttgagaagtgtctgttcatgtcctttgcccactttgtaatgggcttatttgttttttgcttgttaatctgttttaagtacttaaaaattttagatattagatcttcatcaggtgcatttttttgtgagtattttctcccgttctgcaggttgtttactctgctggtttattttgctgtgaagaatcgctttagtttaattaggtcccacttgtcaatttttgtgtgtgttggaataggattttttaaagttaaaacgaatgacttttattataatttattattttgtcattaatttgtgaaattataaattgtaccacaataaaataaaatcatttaaaaatatagcctctgcctgtttatctttttttaaaaaatatttactgaatttttattttacgttcaaggatacctgtgcatgtttgttacataggaaaacttgtgtcatggaggtttgttgtacaaatgattttgtcactcatgtattaagcttagtacacattagttatttttcctgatcctttccctcctcctaccctaccccgtctgataggccctagtatatgtttttccctcaatgtgtccatgtgttctcatcatttggatcccacttacaagttagaagatgcggcatttggttttctgttcttgcattggtttgcttaggataagcaatccatgttcctgcccaatccatgttcctgcaaaagaaatgatctcattcttttctatggtagaattgcatttaaggacatagtgataaattgttcctcaagtctactgtccagaacagtgttttcttctaggattcttgtaatttggtgttttgcattaaaatttttatctatcttgaattaatttttataaatggtgaaagatcaagggtccaggtcattcttctgcgtacagttagacagctatcccagcatcattttttgaacaggaggtcctttttctactgcttgtttttgttgactttgttgaagattagatggctatgggtatttggtgttatttctgggctctctattctgttccattgatttgtgtgtctgtttttacatcagtaccatggagctgttttgagtactgtacctttatagtttgaagtcaggtattgtggtgcctccagttttgttctttttgcttgtgattgctttggctatttgagctcttctttggttctatatgaattttaaaataatttgttctagctctgtgaagaatgatgtttgtacgttcgtaggaatagcattgaatttgcagcttgctctgggcagtatggccattttaatgatactgatttttccgattaatgagcatggaatgtttttccatttgtttgtgtcatctatgatttctcttagcagcatttggtagttctctttgtagagatcttttatctccttggttagagatattcctaggtattttatttttcatgtagctactgtagatgagattatgttcttgttatggtcttagcttgactgttattagtatatagaaatgttactgatttttgtacattaattttgtacctgaatcttcactaaggtcatttatcagttcctgaagccttggggtttctatgtatagaatcatattattggcaaagagaggtaatgtcacttcacctttttctatttcagtgccttttatttcttccttctgcttgattactctggctagcacttccagtattatgttaaataggagtggtgagaatggcgcatccttattttatctcagttctcaaggggaatgcttctagtttttggctgttcagtatggtgttagctgtaggtttgtcataaatggcttttattatcttgatgtatgttcattcaatgccttgtttctgagagtttttatcatgaagcaaggccggattttatcaaatgctcttccttgtcttttgagatcatcatgtcgtttttgtttttaattctgttcatgtggtgaacatttactgatttgtgtaagctgaacccaccttgcatcctaggaatgaagtctacttgatcatgaagaattaactttttgataagctgtaggatttggtttgctagtgttttgttgaggatttttgcatatatgtttatcagggatattggcatgtaattttctttttttgttgtgtttttgtcaggctttggtaacttgggttgatgctgcctttgtagaatgagttagggagaagcccctcctcttgaattttttggaaaaaattgggtagaattggtaccagctcttctttgtatatcttgtggaatttggctgtgaatccatctgctctgggcttattttggttggtgggtttgctattactaattccatgtcagaaattgatattagtctgttgagggtttccatttctctctgattcaattttgagatattatgtgttttccaggaatttatgcattccctctaggttttctagttcttgttattctagttcctctatctggtatgttacattgtttctgtttttttctaactttttatgatagatatttagtgtaataaactttgtttttaacgctgctgtttttgcatcccagagattttggtatgttgtgtcagtgttttcatttatttcatagaagttttatatttctgctttaatttcattgtttacttaaaagtcattcaggagaaaattgtctaatacttggttttgagaggacttcttggtattgatttctatttttattctgttctctgagaatatggttgctataatttcatttagttaacttactgagacttgcattatgacccagcatgtagttgatgttgaagtatgtttcatgtgtagatgtgaagaatttatactctgcgattcatatgtggaatattctgtagatgtcaattaggtccatttgttcaactgttaggtctgggatttctttgttagttttgggccttgatgatctgtctgatgctgtcagtagagtgttaaattcctccactattatcatgtagctgcctaagtctatcagaggtctaaaagtacttcttttatgactaaaagtgctctaatgtttgatgaatagttgagtcttcttgttaaattgaactttttatcattatgtaatgcatttctttgtccctttttttactgctgttggtttaaagtatgtttttatgtaaaaataatgtttcttttttattttctaattgtttaaccgatcttccttaagtcttttacactgaacctgtgggtgttgtttcatgtgggatggttcttttgaagacagctggcagatgggttgtctttttttattttattcaaattgccactctgttccttttaagtacagcatttagaccttctgtcttcaagattaatattgatatgtgaagttttgatactgtcatgaagttgttaactgatagttttgaaggttttattgtgtggttgctttatagtttctgtgggttatgtacttaagtgtgcttctgcagtagcaagtatgttttgttttgtttttctcatttccgtgttattactaccgtaagagcctcttacaaggctggcctagtgctaatgaattcccttagggcttgctcgtctgcaaaagattttattatgtttcatgtatgaagttcagtttggtgagatatgaaattcttagttacaatttttattctttaagaatgctgaaaataggcctccagtctctcctggcttgtaatgtttctgctgagaagtctgcagttaatctgatgaggtcctctttgtatgtaatctaacatgtttctctagctgcctttaatttttttccttagcattgactttggacagtgtgattactatatagcttggagatgttcattttctgtagtatcttgcagttgttctctggatttcttgtatgtggatgtctacctttccaagactattagcaacattttcttgaattactctcttaaatatgttttccagataatttacattttctccttttctttcaggaatgcaaataattcataagtttggttgctttatgtgattccatatttcttgacaactttttttaactcttttttaaatttatgtttttgtctcactggcttatttgaaaagatcggtttaagctgtgaaattctttcttgtgcttggtgcagtctattgataaatatttcaattctattttgaaattccttaagtaagtttcaattcaagaagctctgatatttttttaaagatgtttatctcttccttctattcctgtattgctttagtagtttctctgtgttgattttcaaccttctctttggatatctttggactttcttgcaatccatgctttgaaattcttacctgtccttggcatgtgaatgcccccaaagcattcatattttttatggtgccagaattctggagctgattccttctcatctggagatactgggatttctaatatttgtaatttgtgcattagggttttctcttcgttttcccacaatattattgttttgtttttaattttccttttcttgttctccacccagggtgtatgactgtagagaatattgagtagaattttttgtctgttcttctatagacctatatttttctgtcaacacgttttaaattgggctgttcagtttgacctacaggcctgtagtttgtgctatgggtaagagacagttacagctaacatactgggtagctacttgatcctggtttattaggagattgtctctgctgcctcagggaatgagctgatttgtggagtacacagttttctgaactgcctgattaactctggagggtagggggaaagatgtgcttgtccaaaccaggaaggctcacctacatgtcccctaatggcaggcaagggactgccattaatagtgccgtttgcaagggagaaaccactgggtggccaccaagtgcccagaggtgtgcctcagcatggagctgtgaaaccttctcagttccatgttctatgtacaaggttggagtcgggggttggaaggaaacctaaactcctaatctaggaaagtgactgttcaagaggcctggaggtctgcctgtgcattgactgtagaggccttgctgtgccacagtctgcacagggatgacagggtgactcagcctgcttatccaggcagataggttctgtgaatgcctggagacctacctggacatgccatgcagaggggtcccctgcaccgggatctcttcacaaaagagatggggtgactcaggaagctgttccaggtgagtaggtactccaaatgcttggaaatatgcctgaatgtggagtggagagggctctaatgcaacaccatctatgcacaggaaaggtggcatggctcaggctgccaatcctggtgagccggtgttttgaacacctggagacctgcctaggcatggagtggagagggtcctgctgcaccacagtctgtgttcaggaagggtgtggaggctcaagctggtgatccaggtgaatggatattccaaatgtctgaagatctgcctgggcatagagcaaatagtgcccccctgcaccatgatctgtgtccagaaaggacggggtggttcaggctgttgacccaggtgagcagctgctgaaaatgcatggagatcttcctgagcatggagtagagagggccctgctgcaccacgatctcaagggagtcagttggaacacccagcaatgatacccagatgagttccagttcaccgagctggccctggctgcaggtcttgttaccctggagaaaccacagctgtagtagctcttctcccaccctaggcctgtgatgagggacagcataattccagtgccttttcataattctgactggaggtccttaccctactttagagcaggtgacccaagctctggcccaggactaaaatgcctgtgcagccacactgctgggtcactaaagaattactgactttgtatgtgcccagattaaaaatggcatcctgctcttggtcctgagtttgggaaaatgcccacagtttttgctggtgtcttttcctgacagtgtctactgttttggacaagggagaacactatgttgctcctagatcctctccgtaaattagctctctaagttagccccagggcataggagaaacaaagtgccctcccttttcctgggtttcttggattccattggaaaggtgaatcacagagggtggctgtatgtttctctcatgtgctggggtttcacttacttttatgagctacgtcccgttacagtgctctcttccctgagatctgagttgtccttcacttttctggtggatttctgttttccttcttgaattaaagctcacagaattgatctttacgaactcttgctctttccaagtggctgagacatcttaaaattctctaatctaccatcttgggtttttaaaaatgagatgaaaaactatgagtaaactcttagtggggtctttaaagtcttttttgtttgtttgttttataaaaatgtaatgacagcacatgtcagaaaatactcaagtacaaaatgcccaaatcttctactttttataccaaaaggctggtggttttcagtcaatatagttacagtatactgaataaaaataatttataaaattaaatatgaataataatgtgttttacaatatggtagatacatttatttggaaaaagttacttgataagttgattaaaggaaagtcatttaccaaatgtgtaccctagcttgcaaaatgtgtttcctagattactacttacagagaaaaccttaatgtcaactcagtcagttaacaaaaacataatgtgatatttaggaatagtgcaagttgtcttttaaaaaattagatttttaaaccattttactcttcaaaattactttctgaactctaactttatactgaacatgtcaatcccctcaattctattagttcacctaaagccatgagtctacaatacggtataatttttgagatagaaaaaaaaaaactcagtaaagtatgatattacatttaattttatttttataatcttataaataccttcaaatataattcttacatctttgcaaagtaaaattctttacataagccccttaatcgttagctaatatggcagaaactcttaatatggaaggaatagaatattttaaagatataataaaaataaatgtatatactaaatgtgtttgagtctatgtttatagatagaagtacatcttacagaatatggtaaaatgatttatgaattttactttttaaataactattttatatgtatatacatataaaatatatacacatatatattatacatatatatgagaaaaaccaccaacattacatttttataaaatattcagtgcttcatgatggaacatataacaggattagaaaaatagcaagttcaaaggctgaaaacaaaacatggcctcatctatttgagaaaccataggtaactgtttattgaggaattaaagtctgagagaaaacaggaaatggaatatataaatttcgacaaagagagtctttctcagaagaaaattgtgctttggtttaaaggtttgaaagaataagtgcagtattttggtcaggcctgtaacatgatcagaaacattactttcatggaattgtggagtatagactggaaggatctgggcaaaaattaggaaaacatagttaactagagcagtgctaatgggtatagagaagatagaacttggaacttctggaggttgggttaaatttaccaatgtctgtggaacatccgggtgtttcacctaggcaattacataaaaaagcccgaaggtcagaggagagatctgagctatttttacagaaaaccgaaacaatcaacctatgtctataaacctttgtttatatagagaaaaaaattagaaatattgtttgtcatcatgaaggcaaactaacttgttaattgaactattttcagctagttgttttggcagctgtagacacagccttgcaatcactactcattagggtattggaactatagctccccaccctccaggggaagtagtgtgctttcataaaccatggtgaccaaggaatgaacactttcaatatgatataattaaacattacgggaaagaatgaattagggttctttgtgacatttggctaaacatgctagcaagcaaaaatacacaaatgaaggtcacatttgcaattattatacaagtgtctacattttaattaggtagctgataaatgtcattgagccttagccactgaccaactgtcattttctaaaaggagaggaaaaatgtcacctaaaaagccagaattttttgcattgtcatgaaattaaaaattgtaaccacagtacagtgtgttcagcactaagctgttaaatgggcttagggacaatctcaaaatgtagtaaagaaatatttggacagcatgtgaggtgtcactagtaatacacattttcaagcattgtttctttaaagcattgtgtctttattgtaaaaccacatagagccacattagccttgaacgtctcttctcagagagtacaagtgaacttttttttctttgcctgcagatttgacttaaattcattccttattaatttggactaaatattcactgactttctccctccaatgacaaactaatcttcttaagctcacacagtattgtacctgacctaagaataaaataaattggtatctcatctcttagatattctttattttttggaattttacatagtatttacttgaaaattatttgtccttatcccctaaaaaaataaatgaagtgtgtcagctaatatgaatcccccactaaatttacttataaaagtgccatggaagaaagtaaatatataaatactatgtatgtgagtgagtgtgtgtgtgtattgtctttagagttattctgactgatatttctgaatccattttttttaacttttaataagaaaattcaaaagacaaaataggtcgtgtgcagtggctcatggctgtaatcctagcaccctgggaggctgaggtgggcagatcatgaggtcaggagttcaagaccagcttggccaacatggtgaaaccctgtctctgctaaaaatacgaaaattagtcaggtgtggtggcgcgcacctctaatcccagctacttgggaggctgaggcaggagaatcccttgaacctgggaggcagaggtggcagtgagccaagattgtgctactgcattccagcctgggcgacagagcaagactcttcccccaccccctgcaaaaaaaaaaaaaaatagatacattagatacataaatacataaataaatcaatcataaaatgatcaattagttcttgcaagataacaatgtaaaccttttcttcagagtatgctattatcaaattggaagcaaaacactacggtaaatgaaatccttaatcatcagtgtataaagtgcttttaagaatcaaggaaaacaaatcagaactcaataggataaaagaaaatatttgatatataatttaatgatgaaatatgtatacatggaaaaatatgtgtctaataaagtgcaaatctaatgaaatatgatttccactataatatttgtagaaagtaaaaaaaagataatagatcttagccatcatctaataaaatggtatgcaaaataacataaagaaaatattgctcttttatgatgctaacaggagtctaaatattaagtcaaaaattctagaaaacagttttagcagtagctattttcacttcagaaattctgcttctctgatattcctaggaaattacagtaatagtcacaaagatttatgtacaggggtattcctgtttggttatatatgacagataaattcatctatagggatagggttgaagaagttttaacaaaacacataattgaaatatataattaattaaatgcttctgaaggacatttgtaacagagttacataattataatttatatatatgtgtgtgtgttttaagatggagcctcactctgttgcccaggcaggagtgcagtgacctgatcttggttcactgcaaccaccacctcccagttgaagtaattctcctgtctcagcctcctaaatagctggtattacaggcatgcactaccatgcccagccacaatataatattaaataaaaattagaaaattacgtgtacaaactgattccagttttcttcaaacaaaacaaaaagtctgcctgtgtctctgttggcatatctctccataaatcaaatgaagataaatccaagtttgtttttgcagagtattctgtttctggatatcaagatcagagatgattttgttctgtagtgcgcatatatttgtttataatgagaatatttaaaactagaattcagaggactcttcaggtaccaccgttttggatctgaaccctgtaacttattccctaagggaaagaattaggcgtagggaccttctgtgaccctgaaggcaacaccaagagaaatacatgttagctgattctcataccgatttggaagggtactatactgctttgaattgaattcatttgtaaaacttttgacttgagaagtagtagaatttgtgatgcatacataacttagccaagaaacagcagttccacagctggaagttgctttctgacattaaggttttgttgaatattgtgcaaatactatggatgaggcaaatgtgtggacactgatgatgagagtgacatattaaatcaggctgcaatattttagcccacttgatgtctttgtttcaatttaagtaactggacttaaatgtgctgtcagttgaggctacaaaaatcacaaccacagcagatgagtgaatttaaatggacttttacaggtatttaatctgttaaatgaaaactcacctaacttagctaaaaatgtcattgggaaattttcttttgatatcttttctttgaagaaattgctgttagttgcacagtttcccatttactcctgcatgtgcctcagtaacctgtaattcctagggtcaaagctgtaggtctgcttttgaagaaaaattgccatagaaaaaaatcactcggggacttcaataactaactcaccttgcagggattcctaggcaactttttcacgtgctgggtagcaaaataaaaaccataaacatatttccaatatccatattcccatttgtgagaaatcgccaaagctcgattcaaatttcacctctactgccaagcactttttcttggtatcagctgcttcttactagatgctccaacatgagttagcttgaacagtaatcctattatgcacctattcctctctcccttttaagattgtgccttgtgacttgagcatcacagtgagcctgtgatcactggaaagacagtaacggacagctaaagattataagcatagggttttctttaatggtaaaatataaagaagtttatttgctcagagcagctacacaagcaggagccagtgtacccacacaagtaggaagacacaacttcctttgtccctaccatcttgtttacagacacacatctgcccaagatagtacccatgtggagtgaggactcccccaggcccgggaaaaatttttgtttactctatgggggagaatgatgtcagaccctcttaatgctatatgcttctattaagtgtaaaaataaattcacttatagccccaatttgaaaacaactaagccttttcgctaaaacaaattgtgagtatagttttatctgagtggctctgttgctaagttttgttgaaattccatgattataaagtgatctccttgaggtttattttttttctcttagtttataagaactccttgaaggcaaagattgtatgttttattatactttttaaaaatttccatagttaccttttaatgtgggatatataataatcatttcacgttaaataaattttaaatcctatattgcattatttgtgtctatgtccaaaaatgtcataattatttttggccatctaggattccattatataattagccatcttgaattccattcctaaatccagaattgaatgagtacacccaccttttacagattctatgttctacacggcaccataggaaacactgaacttgatactgaacataatgaaacacatgtttatttttaatataactgcatatgtaaaagcacaacttgcccacagaattgtttctaaaattgggaggaaatacattttgtgtaattattttctaattgctaagcaatgctagctttttttgatttgttataaaatactgtctgatctatcttaaacacacagagaataggaaagtaaaagctaatataatcattacagttaaaactttactgaaatctttaattatccaaaacaagagggaattctttaatcactaaattaatttggttatatttctcaactagctcctgcctttgctaatttcctcagtgattcatattcatattgtgagggaaatattaatttaatgcaaccatatattatgctcttggtgatttaaaaagatagcatcataacactataggtttttaaaaacttaacagccatgaaaaaatacaaaacaagaaaactgttagaatctcctttttggcaataaaagtctataatacccagtttaatttgtaacaatgttcatgctctatctgtgaatacaactaagaatttactatttagaaaagacaaagttatccaaatcttacataattatgactacaaatatttacagcatacctgagtatcagttgtagaaataatttcaaatcacgcttcttttcccttgtaaatatgtctattttttcagtcttatgcaaggaataccaggaatgcagtgccgttaactttttttcttgtatcttggaactatcaaagtttaaatgcctgactccagtgctttaaaaatcgtgtatttcatcctctgcatatgctttttgctcttgaagctacaacactgtaaactttacacataatacatttcttggagaaagtgctgagttgagacatagagtacatctgatttgggctatttcaaactctcatatgccatagatgcagacaaccaaattgaaatgatgcacattatttgtaaattattaaccatttctaaatattctccacacgactggctttgctgaggtgtttcatccatccttgcaagcttcataaaacagtagcaggccaaaattgcagagttaacattaattctcatcaaagagaggacagccttagcaattactttgaaaaaggtcaggtatcagatttctttatgctgactttgatgccaaatggagtcacactgcaggcttggatattgtatgtcttctgtttttttctgtatactctgtcatgaatacatagtgccactctttgctgtctgacatataagttgatgatggaatattctcaagaatattatgctctcaagagcatcacacatcatttggtactataatttatttatatttttacacaagagcctaaacagacatttaaaatcaaacttcaaaagtagggaatacatgatttatatgaatatctgtcatttcatgacttgtgggtgttgctcactcttctgtaccagtaaaacttaacagcattgtgtcgggagtcgatagaaaagattcagatacagagtccaatagtgataatacagttttatcaatcaatattttaggagcggtaaattttcttgtaaacatacctctcatatttagggacggaaatagaattctgaagttttattggtgtcagaaaattcaggaatattttgatgatagcaagtgattaaatactttaaaatatatttttatcatattgacattttattttatcttcttcataaatattgccataaagaattttagttctgcatattctaatccattattttgttaatattttatttataatatttatattttaatattataactattatatttataatattaatattttgttaatattatttacattggatggcaatgttatgatctctaaaatgaccttttatttaatggaaaagaatgctattagttccaaggactgaaagtggtggcaatgtcattctgacttaatggagtacagttttattaaataatgcaagttcagttgtcccagggtcattatattaggaaatatttaatgaaggtattaatatttactcctacccaacctccagctggaatttcatggtgtgagagcaccaggttaattgagttttatcacaaaatctctgggccactttagaaataactttaacacatgctccctaaggtctaacctacaaaaagtgagaaaatagaaaaagaaatgattaacatgtaactagatttagctgacatcttcagcatagttatttattaaaagactgagcaactgatgaaaatttttctctgaaaagaaaaaggtatgggtttgaggagagtgggtaagatgctaattatccgtcctgtatgatgggagaataaatggaccaggaaagtgaagtagtatttcttggaaactcaaaaggcctactggaagtcagttatcacacactgagttcttcctttcaaaccctgaacaggaatatggagaaaagatgggtacatgttgctctagccaatagaatcacaagaatatatacttgtggagttttctgtagatatatagagtctattcatatccaaaacttttcttttagaatttgtttttgggaatacacctgttaggaaaataaaaaatgtaatcatttcctttctgctcttcactttttcagttcctcagggtaaaatgaatatgacaattcggtattcatattctcattttgtgacccagtcaaagctggaaagggtaaactcagtattcagttatacccacaagagtggtacaggataataactaaactctagataataataacaaaaaataatatagaaaatgtattgagttcttactatcaggcaagcatagtttcaactgttttctgtatattactttatttgatctttacaacaatctatgagggaattcctgttgttatcctcaatctaaagtcaaggaagctaaatcacagagctattcctctcttgctcaaaggcacagagatattacgatgtggaatctagatttgaattcatgccatctgactttggaacctctattgcaaacagatttactgacagagctaatctcacccaaaaatttcattcagtaaaatgcgtggccaagatggaggaggaggatatatgcatcgtagccaagcgtggagcttttattcccaggaactgagcgatgatggcggtactgtaagaatacaagatgttggcaagttttcattcaaaggcactctgctttttttttctcctttatgtttattacatgtattatagttcttggttttataaatttttagaataattttgtttgtttaatgttcctctactaatattttaccaactggtaaaatcttaccaatttaccaattggtaaaatcctccaccaatactcccagattgtaaattccacaagtcaggtatcatttgtggtttattcatggccatatcacctgttcctaacccatcgtaggcattcattaaaaagttattgaaaaaatatcagtgaaggttgaatgagaaaacttggaaaaaagaatgttagaggttgctgaaagaatgcgagggattatgtgtacaaggagtctggtccagaccccatcagagcatcactcaatatttctatttcactgagcctctgaattctgagcctaaaatttagatcaaacctactctgctatttctttaagtgacagctcttggggtgatgaataaaaacagtttctgaatcctgagtatgatttaccaaatggtctatcttagaagacacctttccatgacagaagtgtggaaattgttaggatctgaagcaaaaccacaaaaagagagtagagaggtttttgttttgttttgttttgttttactaaaagtaggagtttaaaagagcataggaaaatattggaatatcaaagacagaagtgagttcaagtaactgagactaaagatgaaattcctctgggagggagttgatcatttaaagggtactttagatagagaaaaatgtttcctagggtgtgccaacattgaggagacaaagaactagaaaaggagataaaaagtttccagtgaaatagggataaagacataaggttgtggtatcttggaattacataaagacaatattcaaaggaaaaagaaataactgtgtcatacactcctaataggtttaatgtagcaaaaaatggtccttaaacttagcaatatcttggtaatttttatctttaaagagagacattgtggaatgatataagcaagagatcttataaaagttcaagggaagaaggggggataataattgaatacttttaccatatacagcacttctaaggagtcttgttgtaataaaaattaggtgagagaaatgataaggtcatgataattttatttaaaagagaactttttatatagttatgagaacattctaacaagcatacaaaaaattgatgctgaaagagagacagaaggaatcatctggagagatgtccttgaacagtgaagatggaatggaattcaacatacacaaatacagggattggcctttaagagatgtacagacatcattcatgtgactcagctcatattaatgaaacaaggctgagtgtatgcgtgtacaggcagatggtgggagcatgtgagggactgtctcttctgattgcctctattttcttaataaaatagaaagcagcaccatcaagaaggtcagaaaggtatgggtttgaggagagaggctaagatgttaattatccatcctgtattatgggagagtaaatggaccaggaaaatgaagtagtgtttcttggaatctcacaaagcccactggaagtcagttatcacacattgagttctttcagcatgatactgtattctttggctacagagtgtgtcgacagttggacttaaattagcaggggagagagttagcctgggaaaaaaacagtccagggtgaagagcagtgtgcctgaaggtgcattgaaggaattgagtaaggttacgaattatgaactttaacctggaaatggagggagttgaggaaatgagagcagggtgaaagagagtgaaagagtgttaggatcagtagattgtaggtcttgaagtagttgagatgccaaacagaaagagatgaaattatgtattagtctgtctccaccctgctatagagaacgtctccaaactgagtgattataagggagagatttaattgactcacagctccatgtggctagcgtggcctcaggaaacttacaatcatgatggaaggcaaaggggaggcaggcaccttcttcacaaggtggcagtagagagaattgactgaaggtggatcttgacaaacacttataaaaccatcagctctcatgagaactcactatcacaagaacagcacgggggaaactgcccccctgactcatttacctccgtttggtttctgccttcacacctggggattatgaggattacggagattataattcaagatgggatttgggtggggacacaaagtctaaccatattaaataatataagatgtacagaaaaacacacttaaatgtagcaaggggatgcagctatattccaccctcaacagatttctgcatttgttaatttaatttagtctcacaaagttgagcgttagataaagtcctatcaatgaaacaacatttcccacttatttatgctaatatattttcagagatgagaatcctcagaactaagactgaggagtggggaaactctgaggatatgtcatagaaaagggctgggcagctaagagggcaccaagttggagagttaaaaatatccctgagagaggaggagaccccacaatactgtaaatcagttgcactaagaccatacgactgatgaaagccactttctaaggactgggcttatttgtcaaatagaatggaaatggtaatgcagggggttccagaccatgtccagatcttgaaaaggcctcttcatcccttatgtctgaactcacttttactgaaatctgtgtgcagtgccctgtgtggagcaggcaggaagctatgatactgctgtgtgcacaccctctgcaggaccatcttctccacacctaatccacttgaattgatttaacaaaagtgggtctctgttgaggatgaaacataactgaatccactttctctgttgaaattcaagtattggcatttctgtctatttcatcttattattccatctctttttgtctaggatcccaactccttcaatacttaaaatagactgattttaacaccctttcagtttctgcaccttgcatctatttcttcaattccctccctcaccgggttagagtccgtggtccataacattattcacttccttcagtgagccttcaactacactgcccttcaccatcaattattttaacagactaacctctctaacccccaatttaaattcaactattaatagactatagctagagaacactgatcttcaaaactattgaatgcttccttgtctgtattgaaagactttcgcttcctttcactttgtgacattccactttcctacttttttccttccctttccagattcgagtagctctgcttttcttcaaaaaaaatgctaatgttggtcaaaattccattttcaacaccctatttcttatttcacatacttccttggcaagcttgtctattctcagtttcaataaccatctatttggttaccatttcataatctctctgacgaacctgcgtcttccttacgtctgcagaatcttaacatcaacatgaatgtcctggaggcaccataggctctccatgtgtctaaaactgaattcatgagcctttacctcaagctcttgccttttccttcattcttacctatcttctagtggaggcaaccttgcctgatttttcacttttctttagtgcctccaatcaaataaaccaataatcttatttactattcccatacgtattatctccccatttctgaccaatctttgcctatattacagctttagacccttgagtcatctttatttggtcttgttcaaatatggcactacagccagagtgatctagaacttacgttgctctcctttcaaagctgtaccagtttaacatgacatgctagacgtttcatcatcggcaccttgtttacttattcagccttacatgtcctcccacctctctccctcataataccctgcgctcctattttaatccaccaagcaggccatggtgcctttactttcaaggtttttatatattttcttccctgtctagagtatctttctttccctactgaagacttgactgagctaatcactaatgaactttcaggactcagtttagatagaatatccactggaaagcattttctgatgacttaaagctgaatgagagttttctctacccatgcggggagcccataggtccttgaatttacttttatatcacatgatactaacattgtatgaatactgccttttttccccactagatcgtagctccttgagggctagggcaggattattcacttttgtttccctagcatttggcacctactaagttgttatcacatgtttgttgaatgaatgcttgaatgaatgaatgaatcaattgccacatttctagtaacagctttgcgttcacattaattgatgaaaagggaatctttactgcaacagataaaactgattacataacaaaggaagacctggcgtagtgcgcttagccaaattagcatttggctcatctctgtatggagtggcacaagcccatttgtgtaccacttagtatttggttaaaatatgtataagatttatagccacaatgatgttcctggcctttttaaaccttactatggcctttctacttttcaagtttttcattgattattcttatctggctttaagaactataaaccacattatcatacttcactgtaattgttaatactagtctgggatagttttttttttttttttttttttttcctttataaatgagcagggcagagagttaaaacacaaagcaatagattgcactgagaaatgaatacgttcagaaactacaactacaaactaccttaaaggaaaactcattcacttttcattaccttacacctctaggtgccaaaacttgcatttaattccatgttttaaaggagactttatgtctacccataatctgttcacatatagtttgcccaagggaggttaactcttttcagttaaaattgatccaccttcatcagacttgtggttgaccagcaaagagtcaaggacatgaatctcttaacacctcctgatggtcttgggctacacatatcatgctcattttaagtgtggaaaacatctaaaaatatactttttagagtttcagagaaatcatatttacagcttcacagaacagaaaatattaaacttaatttgatgcttaacacctaaagtgttattttcaaatcatagaaaaatgctttttgcattctaaaatatctctgtaagacagcataattattctaaataattttaattaattatgagaaagcttacttacagtgatactttttttaatcaaaaatttagttagcaatgattattaagtttaaaggccagatactctgaacaaaactaccttttttttttttgagacagggtcttgccctgttgccagtctggagtacagtggcatgatcgcagctcactacagcctaaacctcccaggctcaagcaatcctcccagctcagcttccccagtaactggagctacaggcatgtgccaccacatgtggctaactttttgtactttttgtgtagatggggtctcactttattgcttttgctggttttaaacacctagctgaagtcattctcccacctcggcttccctgagtgctgggattaaaggcatgagccgacgtgcctggccacaaactgccagagtcttagaagtatttccaagatcagcaaattgtccagcttaattgatactgtacatataaaaaatttccaattccttatttctctttagagttcatcataattagtttgtatttttaaaaatttgatccatatactaaacttattgtttcttatggacataaaggaaagttagttcaatccattttaggcaggatgctcaacctttctaaccaaacaccttaggaattaaaatatgaaatttatcaataatcaataaaaatgaaaatttcatcattgtttccccacttaatagtattaatctgtacacattagataataaaacctagaaaataaatttcattcatttttttatgtaccagagtgaatttgactacttttcaagaacatgaggtattacttagagcctagttaaaacacatgtgctacattgaacacacctcatactacataataaattttagtaaatgaagttcctatctatgtttgtagaatataagtgaaatgttggtttcctcactgcattttaataataaggaaagaactgatctatgtgaatgggtattgtaatattaaggtaaacttttaaaagttaatttacaaattttcctgacaaagtataaagcttgggcttttgactgtcttcccttctttcctacttacctctctctctctacttgctttcttccttcccttctgccatcatttttccttttccctctcctctcctccccttccctcccctctcctcccctcccctcccctcccctcctttccttaatattatagctagtagaattttcagaaaatattaaaaaatataaaagtaacattttttcacactctcactgtaatctgaatttgcttgcagctccaaagaaggtttttagtaatgtcttcaaagaaacaatcttcataagaaaaaaataaactagtttcctcaaaattcagattttattatattttttctcttacagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatggtaagtgtcaaaggaaaatggctccagatagaataaaggaggcaaagaagacttatttaatactgttgcaacagagatcaagactattccagtaggagagagtgattgaactcaactctgctaaaaatgaaagcaggagagtttttaaagctggggtgagctagtagaaaactggaggatgttaggggagatactggtaaatgtgactaggccatctgtgtttattgattggtgcttgttgaagttaggctactaccttttcatagagactgggagatagagaacctgtttcttgatggtttcatttcaaatggagagctcccaggccttgagacagacactactgggttataaaaatgacaagagcctgtgttggttgtaagttagtcttcttttctaaacatctttaaaggatttgtatgcattattatgtaattgcactctataccaattataatttaggattaagactaaatactctcgtagaatgaaagtaaaaatagacatttttggaaggccaatttgacagtgaatatcggaaacataaaacagacctatccttcaatccagtggttttatttctggaagtgtattctgtgtaagaaaataataaagagagcacgcaaagataagtatatacttagcattacttatgaatggaaaataagaaaaaatctatatatccaacactaagatatcagttaaattaaagactgctctacagctattggctttatagtttgaataacattttctagatgttgtctacctttgtcatttttggatccatcgacaaaataatgcctggttcattaacagcaggatgaacggcacctgttattactagtctctatccagtctattttatatagatatgccattcagttttctcaacacatatgtgaagtagatattgttactgccttctatagaaatgaaaactctgggacagataagtatttttcacaaggtcacactgctaataggtatcatagctaattttcattcacatcaacaatgattttaagactagtacacttaggctgcatttcatttatgactgatgaaagaataaacattcaaagatacatctcgaaggaactaagatattggaaagattctgggaatgtcaattattaggttgtggtgccaggtgcaggcaaacttatcctttgtgattataccaattgttgccatgtgcagcattgtctcgtagtgttggcatctaagttgtatgtaagcatgatgttagaactccagaaatgttttattttccaaagtacttacatttaatataagtttttaactttctattaccttaagcctaatatgaaacatattttctttaggcattattatcttgtggagtggcattaaggtagaaaatcaagtgatcagaactgtgatctacttgtatagtcggtataattttcagccaactagtgttctgcctctttgttctcttgtatcaaatggaagttaaggtagtcacaatggtcaatataagtatgaattcaaatccatgaaaatgatgagaacaataaatattgggacataagatggagccagctgtgacaacaattcaaggtgtctactattaatgcttgtacacctactgtgagctgatcctattttgggtaattagcagacagaaaagaaagaaaatctggtcagttacatatttcacagtatttcaaatattaaaatagaattgttattcagtaaaagcacaactctctgacactttgattagacaattttttttttctggaagatcatcattaggagtttattattcgatataatggcaagtgacctgaacattacttttactgtacccataataatgagtttcatctgtttcaataaaggcagatgaaacccaaacagaaacaacaaaatgagaagtagtaattctctaaaactgtgctcctcaatctttacagataaaaccctcattaaaataagaccccccttcaaagattgaggtagggcaagagaataccacttacaaaaagctcccaggtgatggtgatggtgctgatctgtggatgatacttactgagtggcaaggctctaggctggtaaccaatttaatatcatttggtcctctgctaatctagtttaatccatattttagagtataaggaagaatggataatctgagtattttccaagtaatcttccataactactgttttctcttctgagcattttataaatcttagctagatgtgactttgagttctttttctctgacaagagtctgacgtatggcttttgtcaggtaattccctttagccttaatagagagtaaagctgaggttgacatgctcttacgaaaaatgagaaaagtaacagagcctgaatagaaagtcatcccactcctgttcagagttaagccaagaagtaccccagacagagcaaagatttttatgaaaaatataaagactcagcttacagagcaatttggggaagcaattctacttccggatatacaacttggagaaaccttcccatacaagtacgaggaaataaaacgcatcttcaccacaatatgtttaagagtaaaggttggaaacagatgtccatcagaaggggaatggatacgttgtattatttttatttaatggagaactaaaactgttaaagtgaatagaaagaaaatggatagacctcaaaatagagagtgaacatggtaagttatggagtattatatataatatgatatcacttatgtaaaacaatggaaaaatatatcctatttatggatacacataagtggtataattttaaaacatgaacttgagatagcaggttgactgcagtgcttaccactgcggacaaagggagaatgagagcaggaaataagtaccaggagagggtatatacattatctcaacttactgatactttatttcttgaaagaaaaaatctgaaataaatataactcctgtagtgactagacactaaaatgtctcacagtaattctcacttggcatttacaatgtaatctctcactttatctgttggctatggctattaacttgcctctggagaatagattataaataaagtaatgggatatgactcccaacaatgggttacaaaagccactggcttccatcttgtttgtcttttttgctttctggcttgctcatattaatggaagtcagctcgtgctgagagctgtcctattgacaggcccactgggagtggcctctggccaacagcccaagagtaagtgaaggactcagttcaacacccctaaggaatttgaatcctatgagtagtcacgtgagtgagtttacacgtgtatccgtacctattcgaacattgggatgagacagcctcccaccttttgaaagacacagagcaagggttgagccacacctgcttccctgacccacgaaggctgtgaggtaataaacacataatctttgttcattttctgggtttcctttctactattttaactgtaattctatatttctgcagaaaatcattctcatagtttcatagctttaaagtttcctttatatgtttcatctattttaagttgctgtgtcatcttgtgattatctcaacaggttggtattcttttctaggaagccagttcctacattcagcccagatttgtttattcaggtcttgattatgcattcttctttgttctcctttatattttctacaaggcctactttttagtcctgtttgttatataaacagatgctacagagaaaatctgaaaaaaaaaggcaaatgctgcaattagaagagatataattccaattgtcctactattttaagtgctcatagtttatattaaatgtattattctttattcattacattagaaattgtcaaatattgaaaacataaaggaaataataatttcatgaaagtgtcttgtgactatatattaagtttattaaactttaatatttttccaaatttgtttcagtattttttgacataaaattaaatttgagagttcttgagtattttgcttggattgtgtctcacactttctccactcttagaggaattactatacttattttgtcatttacatgcatatatttatatttctatatgtgtgaagcctataaagtacatgtactgttctttaaaatttttgtgtcaatgatactgtgtatatcagtcatgatccaccttttctggatcaacattatatcctagagattcatgtatcttggtatcttcagttctaagttcatttcatttcctgtaaagcataccacactaggactcaattacagtttctttattcattccctttttgtaaatatttaggttgttttaattttacattgttacatgtcaaatggattttttcatgcctcattggtaattgtattataagtattttaggagtgcaatttttatataaaagcattgtaacatttccagatactgtcaaattgctttccaaagtgattgacacttctaccaacattattgtataggtgttcgtatttctccacattgtcaccaacataaaatttttttggcaatctcttgagtatagtataccattttattgtggtttagtttgcattttcttgactagtgaggttgaaatttcatgtaaatattggacattctggttttttctaatgcatatttcttattcatatatgttgactgttatttctgttagaatattttacttacatttaactgtaggaaatttacaaatcagttggtcactggttaaatgcattgcggatatattttctcagaatgtaacttaactttttactttgtcagtagtaccttttgttaaacagaattttttgattttgtgtaatgagatatagcaatattttcctttgtagtctgtgcttttcatgtcctaaaaaaaaccctttttaccttaaatttttatttccttccaaatttaaattttgattttcatatttaggtgtttaaaccacatgaaattatttttgtatgtaatatgaagtaattacctgattttatttgttttccatttttggagtggtatgtattaaccaatgtcagtgatctccactgatttgtgaaaccactcacttatatatgttaaaaatatactttaaatccttcagtaacatggtttaattttttggaaaacatttttcacatctttaagcttattcctagatctcatacagtttttgtctcctcgaaaataataatatagtaagaatagcatagtgtttgttaagttggtatatagagccctatcaatctgttactgttgtctgttatttctgttagttcttgctcatatggcgttgtctaatagtatgtgttagatactatatttggaaaaattgcttgtaaaaatagtttgtaaaaattgcttgtgtgcttaggaggaaaacagaaaaggtttggttaaaagtagccagtatctgccagactctttaatttctttaggatgttttcgcttttcccttgctttacattagatagactgttttctatatgtaattcctctctcttgtattttttttgcatcatatgcctatttcttttgtgattaccattaacttagtctatagtgattatcactaatgaaattaagaaatttctcaagtataacattatttgataattttgttgtttcaaacatatgcgtcctttagtgttttctcttttactaattttaccttattcacaaaaatatgtttaaaaatcaatacttaattatattttctgtaacatcactatctatagtcataatttcttataatttttctctgtgttcactttttggatgaagcatattttgtggtaaaaaggatatcactgtgacaaactatcttagtctttatctgtctgaaaatatattttgccattactcttgagtgatagatggttttggaaagtgtaaaatttctaggttgatagttatgttccctttgtactttaagtatctgctggcctcttttgtagcgggcaagtttatcaatctagttgttatttcctttgttaatagacttccctgtggaagttatttttttctaatgcttgccattttgtacctttactatgtactttctaaaagtaaatttatttttgcttattcacccagcacttaagagacaattcaaaagaaaatataatatagaaatgttataatttcagagaaaatacaacatctttcttttcaaatgtgcaaaatccagctctttttctgattcgtctgttcttcatttctacacttttttgtgttatatatgcttacttagtttaaggaagtccattcctgaatttgtactttggagtatcgtaagcatatttattttaaagtcctgatagatataagtgtattttatctgggataagttcttattcctattattgactttggcttttttttgcaatatagaattttttatctatgttgtaatttttggttttctttgcaagtacatgtggaaaggaagtatttttattatgtcttataatgtctttaaaatgtcttataatgacattttgaggcattacagttctgttggggctattgagattcagtcactttccctgggaatagcttaactaagttcacagtcaagaagctatatctgccttctttcatctttgcaagtccacacctttcaatgtactgtagcctcacatgctcacagaaacagacacacatacgtacacacaaaaggcatccaacctgttgttataggtatcatgacagaggtacagtattatttggtaacatagaatagaggcatcaaatttaacctgtgttgtatgatcgggtgaagcaaaattgaggaagtgatactggatctaaaatatattgcatgtgtagaagtacattatagataaaagaaatcatgtgttcaatggcaaaggggtaagagagaacactcctatgtttaaggaaactgcacgttatatattatagttgtagcaaagtatgaatggctgcaatgaaattataaataggcttcttattaaggagtctaaaaattttatctgtgttaacagcaagcctccattaatcagtggaatctttttagcagcagttgcctgtgagacctctgagcatgcagatttaaaataataataaagtctctctcatgggaggaaggaagtaagggggggatcagaaagatgctttcacatttataaaggaaaaaactgataattatttcaaggaaagcagtagtagcagagataaagagaaaataatagttcatcaccctgtattctactagagtctctccacatagatatatttggtcagagcagctgtgttcattggttttttgctttttgttttgttttgtttttgtttgttttaatgcgagacagggcttcactctgtggcccaggctggagtgcaatggcctgatcttggctcactgcaatctctgcctccagggttcaagcgattctctaacgtcagcctctctggtagctggaactacaggcacacactaccacactcagctaatttttgtgttttttggtagagatagggtttcaccatgttgtccaggctggtctcgagctcctgagctcaggcgatccacgcaccttgacctcccaaagtgctgggattacaagcatgagccactgtgcccagcccattcattggttctttttaagttttattatgtctaattgtcttctgtgtgtcctgaaatgttttcagcattataacagcaatagcctgaatccattatagaattccaaccatgtgggactaaattaaaaggtaaaatttaaaacaagactagactaaattgttagagtaaattccagaagaaacatgagcagcatatagtgataacacatatttttgttaggtctgttttggcccagaaacattttcatagagacaaagtgtatatctgtaataacttacacatagctttgtttccaatattttaacaaatatttttagaggcttattaacagattggctctaaaaagtagcttgaatggctcctttatacaattactttacctctctatagtataatgttaacagtaatcagaatgctttctgaatgtttgtgacgcaaatttttacgcagctctctcgactatttttctttgatcggtcaataacatatgtagaataggattactactgtgaacataaaacactatctgtacaagtttattaaacagagatgtactttttacattttttctgtaggagatattggccatctactgtgtgcaagctgtacattaactcatcacaagagagttattgttttaatctctaaagttttgaaagtatttgataagtatgattgtatagcacattcatatgtattatactttctatttgaaatagaataaaataataatagttatatagatcttcagagatatgtacaatgattttggtcaagtactaaatcagtaatgtgaatagctcattataagagtaatttgtgaaaaaaaactttatgagcctttatataatggctactgcttctttgtaaactaatgatagcattctgtcttagtccattttgtgattctgttacagtatgccacaggctgggtaatttaaaatgaacagaaatgtgttggctcacaattctggaggcagagaagtctgatacaaagtgctagaatctggtggggacattcgtgctgtgtcatcatatggtgaagatggaagggcagagacagtgagagcaagaatggataatgcaattgcaacaataatggcctaaccacctcttaaagtcccacctcttaatgctgttacaatatcaattaacttttaatataaattttaaagggaagcaccttgaaatcatagccgataccctatgctattttattaaatagaaagttaattatcaatgaatatgaaatagtttttgtttacacatgcataatcatggaagcttttatccaaatttaagtaagatacatggaaaactgaaagaacctttcatatattattttactacactcaagagaatttacattattaaaatcatgtatctttatcttcagtggtcatgttgatgatgtattttagtcacagatattaaatttgattatagtagttgtcttaaacaatgacaaatcccatctaaatgtgagcttttgtataaaatattcccatattcatggaatgtatctgtacttgctatattctatttccagcgagaattagaaaacatcatgtctgatttcactttattatttatcatagtagttagatcattttagcaacaaaagctattccatttagagcaaatttagtgattatgttgtgatgtttaaaaagtgtgatttacaaaaaaaataaggaagcttttggttatattttaattagctctgttcttttgaagatattccctggtgatatacttaaagaagcatcaaaatttttagtgatctgaaatgatgaaaatacatattctaatctacttaaaaatatttggatagaggttaatctcataatttgctatacatatgtccacatttaggaagtacagaaaaaggctgcattcagaattactgtgttgcatgacgatgaaaacatggttgtgaatattgtggactggtccatactaggcagagaattcacatcacatgttatactttggtcatccccaggctttatgtttgaaaataatcaagaaaggcacagtagtcagtcactgatacttgattgaggtgaagagatacacatagtcaatgaataaaaacttctgagctagtctcataaaataaagaagagaaatggagcagtacctggaaaggtgagtgctgctcattggcgttgagcaaccagaaaagtcctcagtatctactctgttttcaacccgatactgttattttggataatagctttgatctcttgaaattgtgtcaatgcaaatgtttcatagacctaagaggtataatgtggtttaaaaaggaacaactgagttgttaataattactctaaagtagttatttgagtacaaagagtgacatttaagtgatttaaaaaattgaccaaggtttaaagtaaaaatatgcaaggtaacataggttaattgaaagctcttatgagttaacacctcagacacatgcaggatatatgctttcgggggacataggcaaggattattaaccagagctgacactatacctgttcctccctctataaatataaactgatccttgatttcatctgtttttattgttgttatgattttagtaggagtaaacttaattaagtgtagggtgcatttcattcttctatttgtgatgagatggttaggttaagatattttatttttgcagagaggcagtctggattaggagtgattcaaattagataggtcaaacttttttcgggggcggggagcatgttcttctgtttgtcctgattcagagactacagtgctgtttttgatggcggaaatggtggtccttagaggaagcaaattatttttctactaaggctaagcacataattttgctctctttaattccctcaatggtaaacacaatctgcactttataaaccctctgtgtctacgcaagcttttaaaatttttagcactgtcttctgacaattggatgattcctgcatttacaaatttgtggccttatgtcttcagtacttttggctaaattttatcatgaacatgatttattaacagatttgacttggcacatgggcaatggcatcctgactcaaagcaacccctttggtgacaattttctgttgtttcctcaaaatactctttgctgataaattgtttgagagacacaagcacaaaatgtgatcttttatgaaaataagaattctctcttggagggggaaattgtattttatttggatgacacacttctaaataaaatacatcatgtcagtttccccaatttaaaaattgagaccatattctaataataactttacagtcttatgaccattcatcaaaactttatgactttattctgctattgtagtcttaattttaaagccatttattattttatacttaaatgcttttttaccaatttaagtatatgtggtgtgagcaaataccatttcatagtctcctctttattctctttcagcacttacagcagtgcaaggttactgggagcttaacaaatattaaataagcaggaacctatttgaggactgcttcatttttcttgaaatctataggctgaatttctataccatgatagtatatttactaaatatttttgaacacaatagtggattttggattataaatggaaaggagaaagaataatgtccaccttcaacaagatgacctattggtttggcatcctgtgaatcttaggttggtgtaaatggaattgaggtttcggaccatgaattttaaatcatgataactaggttccaatacatctttattaatcaaaataggaacccacacatttttgctaatgaaaaataaatttgtttattcctctaacataataatccatgcttcaggattcagcaaactcttggaaagcattttctgcatcctcctggttgtggaagtgtttttcctgcaaaaagttgttgagatgcttaacgaagtggtagttggttggcaaaaggtcagatgaatatagagaatgaggcaaaatttcatagctcaattcgttcaactttcgaagtattgcttgtgtgacatgcagtcaggcattgtggtggagaagaatttggccctttctgttgaccagtgccggctgttggcgttgcagtttttggtgcagctcatccatttgctgagcatacttttcagatgtaatggtatcaccaagattcagaaagctatagcggatccaactggcagcagactgccagtgaccataacttttttttttggtgcaaatttggcttaaggaagtgctttgcagcttctctgttcaaccactaagctggtcatcatcagttgtcttataaaatccacttctcattgcatgtcacaatgtgatcgagaagtggttgattgttgttgcatagaataagagaatatgatacttcaaaatgttattttttttaattttgagtcagctcatgaggcacctacctactaaggtttttcacctttccaatttgcttcaaatgctaaatgactagaatggtggacattgagttcttcagcaacttctcgtgtagtcagaagaggatcagctttcatgattgctctcatttggttgttgtcaacttccaatggccaaccactgagttccttatcttcaagttccttgtctcctttgcaaaacttcttgaaccaccactgtgctgtacattcattagcagttactgcacaaaatgtgttgctgatgttatgagttgtctccgctgctttatgacccattttggactcgagtaagaaaactgcttgaatttgctttttgtctaacatcatttccatagtctaaaaaaaaatcaagtaataagtcattagcaaaaaagcaagaaatgcccattaaaatgatatataacataaccacatttaacaatgcattccaatatccaatggcaaatcccaacgaggcaaaaactgtaattacattggcatcaacctaacacatggagttggtgcactttgattgttatcataagtgataatattactgcatcctctgacctctcttttatatctgtacgaaagtgacaaaaaacctattagactttaacttatgttgtgtgtacaacgaaatgctacactacccatgaaacattcatcaatatgcttgttaataaatcgttctcttcaattcttagaaatccttgaaggttttatagtttatacttgtttaagtttcataaacttcatttcaatgttgaaaggcaacttaaagttaaaagaagatttggacaatttttttaagaattcatctaagatacttggtgcaaaaatttttctcaccttgtaactatgtcatcataaaatataatttctagttaacacttcaaaatttcttgaaattgtcacataaagtatactaatgatcattaaaatggcatttcttaaaattttattgggcatgataggctgctatttcctttatattatattactgagacacttagtttacattacatgaataagctagtcacagacataaattacagctaaccagcaggcagaacagttgcagcctggcattagatgtaatccctgagaaaaataagcacagaagttgatgtagatgtaatccctgagaaaaataagcacagaagttgatgttaaaaagaggatttaagcctgaaaggcagatttagaattgagggagacatgataatgttgggtcatgatccaataaaacaatcgaaacagtgatccaaaaccaaaaagcaatcctttctgagaacctggctgcaggagtctcagatggatgatacttaaaatgtcttgatatgaaggaagttataaagttagtatctgggtagcctatcagtaagtggcagaagtttcagaaggagctagagaggaccggacactaacttgatcctaggacaggactctataaaggaaactattgtctccataacaagataatatacagacaatccctaatttaaggtagtttgatttagaattttttaactttatgatggtgtgaaagtgatatgcattcagtagaaaccatactctgagaacccatacaaccaatctgtttcttactttcagtagagtgttcagtaaattacatgagatgataaaactatattataaaataatctttgtgttagatgactttgcttaactggagactaatgtgagtgttctgaacaactttaaagtaggctaggataaactctgatgttcagtatattagttgaattaaatgcatttttgaattataatattttaaatttaggaatacgtttgttgaggtgcaatcttattgtaaactgaagagcatctgtactactgctcctagaaactccacttggagataggtagatggggcttccagagtcataatttataatagaacttgatcatcctgttcaagaccctcttgtagaagactcttgccaacaccaggctaactttaggcagccattgtctcctgtttcttgctctagctcagtgattcccagttgctgtgtcgcttccttcttcgtgtttcagacatttgtgggggtagtctcagttattcaaggatgtaactttcatttaggtagtagagaccaggaattccaaatgtcctataattgcaaagcacaggactcttaagtgtcctgacaggcatttttgtgagtgaaaattctcttcatagttatctggtaaaataatctgactggatatttcattacctatgtggtatttttaaatatagtggatattttaatgcaaacactgtatgaattgcaagattacacttagttttgttcagaacttaaccagaggttgttgtccatttagaatacctactacctaacactggtgcctctcatgacacttgggtcaccaattgtagacacctggattagtttgcgtttgtagatgctgcattcacggggatttttatgaacaaaaactcttgattgcttctttatgttgtctattataattctgaaaacttacatattgaaaatttattgaattaaatattgttttaggctgggcacagtggcttatgcctgtaattgcagcactttgggaggctaaggtagaaagattggtttagcccaggaggttgcggctgcagtgagccatgattgtgccagcctggatgacggagcaagaccttgtttcaagaaaagaaaagaccaaaccacaattttacagcaaacgattgcacttttatttgtccttttaaaatcatttttaaaagaattacccgtaggtagttagaatattcattaatttcatttgacaatcacaaaggaagagcataaaatagttatgatttaaaaactttgagaactgctagatggatgtaaggtactttttctccattccatattgtttttctcaacttgctgagactaagatagatggggttactactaaggctcagggataacaaaagagtaagggaaaaacaggaatacatatatatgattttataatttacaagtttagtttaaacatctctgatttatgctactctagatgactgcctccacagtcaagaccatcttgccctagccatttatttgataccttgttttcctaatgtaaagctgagagaaagctatccagagtaattcaggagtttcccttcttatatgtctaccttccatgtttcagttaactgtttgaagacctattgcttccatgatgcaaactcctttcaaaaagtttatgttcccctccaaggagactctgtcctttacccagattattgagtcctactttgctgtacgtggttgccctgtggcgggtaagatcagtaccatcactacctaaaattggttcagatgcagaaactgatgatgacgcatatgttcaaaaagggtatgaagagatttattcttcgtaacatgaggctttctgagaagacacattggtatgaaaacagcctgagtgaaaaaaggaatgaatgacttggatttttaactgtggttgtgaggtagggttgggatgagggttcctatgtgggccagggtttgtgtggtgtaaacttctccactggagtcagggcaggaggtgcccaacttctgaccttgcccagaggtgaggcaatagggaaaaggcaaataatgtggcttgaaagctgtcagcagtcaaagagctgacataatgtcagactcttaattacatgagtctatagtgaatgtcagtcactttaaaatccaaaacaagaaccacagcagcacccatacaacataaatgtgtacgtaatagcactgggccttctagaagggttaacataggatttaggaatggaaacatatggatgaaaacccattttcagaatatggccatgtgaagaaggcttggagctcaagaattaagtagaaagctaatttaaaaaactggagcactataactggtcaagctaaatacatggttgactggttaaatacctcctgtcataggccctaggcctggaaatacatgctagctaagtagtaagcaatcaagtggtctgaactagagaagatggtttatcagcaagactatgtaatattgttataggaaagaggtccggatacagaccccaagagagggttgttggatcttatgcaagaaagaatttagggcaagtccgtaaagtgaaagcaagtttattaagaaagtaaagaaataaaagaatggctactccatagacagtccaaagggctgctggttacccattttaatggttattccttgattatatgctaaacaaggggtggtttgttcatgcctccccttgttttttttttttttaatttttctttttttttaattatactttaagttctagggtacatgtgcgcaacgtgcaggtttgttacatatgtatacatgtgccatgttggtgtgctgcacccattaactcgtcacttacattaggtatatctcctaatgctatccctcccccctcccccaacccccgacaggccctggtgtgtgatgttccccaccctgtgtcgaagtgttctcattgttcaattcctacctatgagtgagaacatgcggtgtttggttttttgtccttgcgatagtttgctgagaatgatggtttccagcttcatccatgtccctacaaaggacataaactcatccttttttatggctgcacagtattccatggtgtatatgtgccacattttcttaatccagtctatcattgatggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccttgaggaatcgccacactgtcttccacaatggttgaactagtttacagtctcaccaacagtgtaaaagcattcctatttctccacatcctctccagcacctgttgtttcctgactttttaatgattgccattctaactggtgtgagatggtatcacattgtggttcatgactctcctttttagaccatatagggtaaattcctgactttgccatggaatttgtaaaatgtcatggtgctggtgggagtgtagcagtgaagatgaccagaggtcactctcatggctgtttttgttttggtggattttggctggctgctttactttagcctgttttatcagcaaggtctttatgacttgtatcttgtgcttacctcctgtcttatttgtgactgagaatgtcttaaccatctgggaatgcagctcagtaggtctcagtctcatttttcccagcctctgttcacgatggagttgctctgtttcaaatgtttctgatgatgatatacagttcaatgaactttgtttcttaatgaaattacatcttctttaatagtttaaaatgattttattttaatgtaatattagccaacatcagaaactctggacactataacaaattacttcttaacacattaacatgtttcttttgtattcacatcacattctgcttagttgttgaatgaagtgctctccatacagaaagttttggaaccactttcagttgatctaatatctttgatatcttttaaagccttactggcatcttctgctcctttacctttagaaaactgacaaataggagaggataaaagattgtgcatgacttttttttgtatctagtcctgtattttacatacatttcagtctagaactaagtcacatggccccatgtcaaacctaaaaaaggccaagaaagtgtcccagtgttcctaggaaaaggaaatgggattagggagcatctagccagtacttgccacacatgagtaaaaaaaaaaaaaaaaaaaacctatcaaatatcacatgtgataatgatgacattaaaattacactaatataattttaacatcaagaataaagtgggctcttaggaaatactttattgagtgattatgattaaaattatttaaggtcagttctatgggttatatagaaacagctttgttttagtaaaagctaaaagtaaaaaaacttcatttttgttaatttctcatttttcataatattttattagagggacttagggtatccttagtagaaacttcaaattttaatcttaaaatatgaagtttataaaatacagaaaatatgtcaatttctataagttaaatagttatattaacatgcaggtaaatgtaactaccagaaaatcttgagtaaagtatgtctattatggagtagaattgggtaaaaaactgtcctcatctaggatacaaatttacggttttaattttaagatgaactttatcttcagacaataatctgttatgacctcatgtattactggatgtaaccaagctaagactggatatagatcccacagatatttttggaaatgatgcctgaaatgaatcgttcttcttccagttctgaaagcttatggccctatgatagcataaaaatcaaacatctatcaagtatttttattttctccagtatcactctttgtaaatgatacttctatctcttattttttgttttttcatcttttatttttaaaataattttctcacaattaatatagggagaggaaaaatggtttattagttacctattcctatatttaaaaaatcctcaaaacttagcaatttaaaacaacaatcaagcattttctcttcaagtctgaaatctgagtaccttagctgggaggttctggctctaggtctttcatgaggctgcagtcatgctgtcagttatagctccattctcatttgaaaactttacaaagggaggatccacttaacaattcacctatgtgattgttgttaggcctcagtttcttgctgccttttggccaagccaggtatttcagttccttaccatgtcggcctctccacagcctgaaaaaatttcctttggatatgcaatggtcttcttcttgagggagtgacccacgaggaaagtgtaccccagaaggaagttgcattacttagtattagaagtaatatagtatgccttttgcttttagctagaaataagtcattaagtcaagctgacactcacggggaaagaaattaagctcaactccttgaagggagggttatcaaaaaagttgtggacatatcttttaaactaacccaagtaggtttggaaaaattcttcacaagtaggtttggaaaaattcttcacaagttaattggtctaaagatgatataaaaggcatgtttactttatatcattattttgaaatacaattaaaacaaacaagattaaaaaggaggcatgaaaaggttactttcattgaaacaaggaaaaaaggcttgaaaataatgaggaaagaaatatccgacaattgcctttgtcgtcagacttcaagacaaatatcagtttacctaatggtaagtcaccagcccttaaaagaaatgtgtactcaattgttcattaataaaggtaaaataatcgggtgaagtctgtgtgaaagtggacaaatgactcaggatacttcagaacatatcgaaggaggcagtgaaataagaactactatgacaagcgttttatatatatatatttttttcaatctaagtttttgtatgggaggaccattgaagttgaggcagagggaaggaggcaagagattgagaaaccgtcagattatagtcaaactcctaacctaaggattttccctgtgaaccacgcagatgtccttaaaaaggaaatagggttaatacagacatataacatctatgcatttagatattactgataatcacattactaagaacagttaaaagaagcaatataagaaaccaaagtagatataagataatagaatatgatatgtaagttttggagctcgggaaacaaatggaagagagaaaaaatgattaaagagttgaaactcttagtagtagtaatatatttgcacctaattagatagtaatacagcaaccaaactcaacaaagtcaaacaaaaaagaagataaaccattacacagtttatggagagaactttttttctttttaaagaaaaacaaggtatgcctaactggtatgaggggaatagagcaaatgagaaataaattttcctgaaaaagaaagtcataagactgaaagttaaaaaggccaactgagtcacagaaaaaaaaatcgtacaagatgactacaccaagacatatccctcaaaattattgatattcacgggtgagtaaagaatcctgtgggtgtccatgcataaaatctggtcacttaaaaatgatgacagttaggccggagtcagactacttcaccatggtaatgtccattgttaccagagggtggaaaaatacacgcaaaatcatttagttaaattagtagtgaacgtgtaatttgatacctgccaagttgtctcttaatgataaagaaagaatacatacatcttaactatgcaaaaaggaatacagcatacaagagcttgtttttggtaaaaaataaggaacttagaaatggaaaaaccatgggaagatacataagtatctagtctcataataagaactatgaataagaaactttgtaaaatatgcttatcaaacaattgagaaaatttaagaagtatacttgagaagtccatcattcttcgtagcagagaataaacagattatttccaaattgaaacaattcttttctaagaaaaaaaaaagcctcttgagtatgaccctggcatttcacagacaataaccactgacgttgtatgttcagccaactacagatacctagcagtttgttaataagagatctgatagaggaaaaaaacacagaaaaccattgcttttatgagacgttaacattgtgtgtgatgacatctgcccattacacaaatgtgtcgaaggcttctacttggttgaagagtttaattaattggctatcaagatctttgtgataatttgctattatacagcatttgaagtgttatctccaacaagttatagattccatcaagcaaaagagtgcagaatgtaagtatatggatttaaacagtggatcattatgaccagaagataaaattcactgctacagcagaatgaataaaaaatgtatctcagtatatctataatctctttacagtagaaacatcactgattatctttgctggggactgggaagctgtacgtagacatgtttcttttcccccccttaacatgaattttacttctaagatgaaaaaaggaagggaagggagccactgtttaacttggcatttgaaatactttctttttcacatttctatttactgtcatttatgttgacgcactggcttaacagcaacaaaataaatgatggagtcactgaatagggctaagatgctttgggaactaacaatgaacagcaaagagatgtctcacaaagtatgggcagtaataataaaatatatgttcagattagtcccttattatttagcctataatttaccaaatcttacttctctagttttccccagccggaccatattttatttctcttgtcctgttttcacaattttcagaacataaaatttggaaccagagaatcttaaaatcaactgtcttcttatacggctaactttgcaggagtctcctctaagaagcttggagttttcagcttgcaattagaaatgactatgatactgagctgagataattagataatatatatacatatataaaatcatgctttataaatgttagcacataagtataataagagtgagaaaaaggggaggaggaggaaaagaagcagcagaagcagcagaagcagcatcagcagaagaggaggaggagaatgaaggagaaggagaatgaagaaggaggaagagaatgacaagaatgaaaaataagaagaaataatagtcatggtagtagtaagcagtttcaagaattcaatagccttagatttatattccaggtttgacatttatatatatatatatatatgtggtgtgtgtgtatatatgtgtgtatatatatatacacacacacacacacatatatatacacacatatatacacatacatatacatatatatatattttttttttatggagtttcactcttgttgcccagacaggagtgcagtggagcgatctcagctcgctgcaacttccacctccattgttcaagcgattctcctgcctcagcctctgaagtagctggaattacaggcatgcaccccacgcaccaccacgcccagctaattttgtatgtttagtacagatagggtttcaccgtgttggccaggcttctctcaaactactgacctcagatgatgcacccacctcagcctcccaaagtggtgaaagtacaggtgtaagccaccacacccgggtatttcctttctagatttagctaattgttttctgtctcagttttgtcatctctaagataaaaggactgattattgccaatggtgattgtgagtgtttcgtgatattatgcatgagaagtattcagcataatgtctggcatatagtaattatactacaagtaaatattagttattaatcacaatttattcagtgcttgcaatatacaaggtatttgcaaatgttaataacaactgatattcctactaatactgtaaagtaggcattattatccacaaataatacttgagtagcagataatcaaagatgtttggttcatggctaaaaaatactactactagaatttgaacttacatgtgtccaactctaaagctcaggagttgtctataacacttattatatgtgaattttatgcagcatagctatttttaatgtttaagtcatagttttaatgtgtaaagatcagaaagggttttttttcccacagcgtaattctgcaagttaattcttaaaatttgatttataaaagttgtgatttataaaaatttatagaagttttccaattttttataaactcataatgcaacaacaaatacaaaattttgacaattttctctagttatttattaaatcatttatttttcttttccttattgaataaaagttttaattgacagcaatataatttggtacagtgagacatattctggttattttggtgtagtattttgctcgtagctcaaaaaaagtgcagctaggccagtcgaggtggttcacttctgcattcccagcactttgggaggcctaggcgggcggattacttgaggttaggagtgtgagaccagcctggccaacatggcaaaaacctgtctctactaaaaatacaaaaattagctaggcatggtggctgtaattgcagctactcaggtggctgtggcaggataattgcttgaacctaggaggcagaggttgcagtgagccaagatcgtgccactgctctctagacagagtgggagtgagactctctcaaaaacaaacaaacaaaaaacttgcatctaggttatctaggattcaaagaaaatactcgtcagtacatgctcatagtgactgctcaatttttatttggtttagaatactgtgaaaacttttgttttacttcgccaagacaaaatatttaaagaaatatatttaaagaaagcaaatcattttactccaaatttgttcttctaaatataaggtgtacatcttttcccagaatttttttttagctcaaatttcctggaacatttatttttatactttttttctgaatattttcttgtgattatctgcaaaagatataaacttctgtttaatacatatattggaactatgtctttactgaaataatttctctttatctgtagcagtagtttttaacaagggtcattttgatcctagagcacatataacaatgtctggataccttttttattattacacattggagagagatgctactggaatctagtgggtagaggccacggatgctgctaaccattctacaatgcacaggacagccccgcctcaacagaaagatctgtcccaaaacatcaatggtacagagactgagaaacctgatctagggctattatgtgatcaaattcatgatcaatgaaaattaagcaaaaaaagctttactttttcacaaattcacaattcactatgctatagatcttagatacgcacacgatgctctgaatgcttacgtaactgtgggctgacataacttgtattatcctctgtacatttgctcatcatttctccagctgacttggtctaaaactcaagtccaagttgacatttgaagtccatttttagtttcactttcttcatgaaattttcattagcttcaaattacttttatcacacacagaatttctctgagtattagctaactaaaatagaatcgagtgtctggtatatagtaggcaataaatttatgtgctcttcccactggcctccacttccttttatgccttttgtcttctgatcttattgactatttagttgtataaagttttgccattttaattaagttgtctttttttgaaagcatgtcttatttattccatgaaaatacctttatgcatgttacatcatttttttacaccccagaattgttagcactaaatgtagtgcttcagtgaattaatgaagaatataaaaaaatgcaagaggactaatattttcatacctgtagcacctaagtagtgacacaatattaatatattacttttgcgtgtgtattatttttaacattctaagaattttacaaactttcaggttttttaagatattgtttatgcttaatattattatccttcagtctgattttgaaaaatgaaaacaaagatatatatttaaaatataaatgtctgaggtttgttttttatgtattacacgtttaacagcatttttagttgattaaaaattatatttggttctttacaatttaataaaacaatgcagttttctagctattccttcttttgggaatttacctgttgattacaagaaaagagcaagaattttgaatataagtaagatggaaaagaaaaaaacacaaaatatcttgctagtttaaggaaatttaaaatgtgtctgttttgtctttacagaaagtgtggactatgggccagtttttgtgcaagaaccagatgatattatttttccaactgattctgatgaaaagaaggtagcattgaattgtgaagttcgtggcaatccagttcccagttacaggtaggaattcactgttaatcatttttcttaagccttaaaaactttccatcaatgatattctgacactctcagggaggattatacatatttgtcttctgattttttcctaagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctgtgagtaaaatatatgatttttctatatatatgtatatagtgtgtatatacagtatggatttttaaaatttagttcaggaaagaaaagcctaagatctcaaatcttttttttttttttttttttttttgaggcggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtttcagccgggatggtgtcgatctcctgacctcgtgatccgcccgcctcggcctcccaaagtgctgggattacaggcgtgagccaccgcgcccggcccttcttgggatattttgaaattttctaaaagatttgctgtcctcaaaataaacttgataaactagcctgacaggttgaagtccttttcatgaaagtagataaagttttagaattcataacagtctattttgaaacccaccactttttatgtgttattttcaagtctttgagttcaaattaagcttcctatgagaaaaaaaaatgataatccaaatttcttttgaaatcggattctctccatctcctttttaagatatctataattctactaactactatagtcaccatttgctatggatttctaagaatataagatagcatattctaaaacttctgcttatagccaggtaacaaaaaatacctctgaaatgctaatattttagattttgactatatctcctagatgtcccagttttcgtattgcaaaaaagatattgtatgtggctatacggacatagacacacacacacacacacacacacacacacacgaatataaacatttctaaagtagataatacacctgattaaatgaaaattagccaggtgaggcagcaggtgcctgtagacacagctacctgggaggctgaggcaggagaattgcttgaacctgggaggtggaggttgtagtgagccgagattgcgccaccacactccagcctgggcgacagagtgaggatctgtctcaaaaaaaaaaaaaaaaaaaaaaagaagtgtgtatatataattaactaaatatgttcttaaaaactcttgaaattattttacttataatgagagcttacaataaattaaaaataggctaataggtaaaaccttttattattattccttaataagtaatcctacttgaaattaagttcttgaggatagaatctctaaaaaatactgagaaagactaggaatctttatattaataattaaagtgtaattgtagtggctacataagagatcatgaaatgatttttaaattaaagttacacctggaagaatgtaataattgatatttctctatgtaatctttcccaggtatcatttctaattaacccagaattcagacaccctattaaagaagtgtgaaatagaaaaggaaagaataaagaattgataataaatacagtttgaagagtaccgagataggtcctagaaaaatgtaaatatcatattttaaagtagatttgcctaaggaattcagataggtacatttacataggccaaagacaccaagatagcagcctaaatagattcttttttattttggaaaatattatgtggtgtatcacagaacctaatactttacattatgcacaattaatcaagtagcctaataaactaaataaataaccctcataatagctcctttattcaatagtcttttcaagatagatgcagaatatcaagaaaatatgctatacaaatattagtggcttataccttacagtttggtctacagtatttgatacaaggtataccagttagctatagcctgtatgtcagttgtttttccctttgtggaagcaaatcatgccaacttttttctgcatgcgtttagagcagaaagctatttattttacatatccatatgactgtcctaggttttctggaaagaccaaacatagttgtcaaatacactcatctgaagtgatgactttggcagcagcgtttacaattcaatgaccaggcatgggaaatactgtttatctaaagtatcttacctatttagcatgaagctgtcttcaacttgatttagagcaatatctgcttatttttaacttaagcattatgggcttacataggtattcagtggtagcaccttatgactctgcccctctctactttccaccaaactcaggtcattggctacatacgcataaaaacccacaaggtacctggttaaagcagacagttacccagggaagaccaattctgcctcaaaattgtttctccacctagatgccattatgcttattcctatgatattgaaacaatgaagtcccatagatgtagtttcatctatttttccagtttatctttgaaaataaatgcaaatatgggcagtagggagaaaagatgaagatttgattaacctaccagtatacctggatgggagtttgggtgctataggattcggggactcagaatcgttcaaagattagggagagaaactgaggtaggaagttggggagaaaaaagaaaaggggttcctgaaatgaagtgaaagaacacaaaggcaaggtgaaacttgaaaaattagtccgcaggctgggcgcggtggctcacgcccataaccccagcattttgggcagccgaggcgggcggatcacgagttcaggagttcgagaccatcctggcgaacacggtgaaacccatctctactaaaaatacaaaaaattagccgggcctggtggcacatgcctgtagtcccagctactagggagactgaggcaggagatcgcttgaacccgggaggcggagcttgcagtgagccgagatcacaccactgcactccagcctgggcgacaaagcgagactccttctcaaaacaaaacaaaacaaacaaaaaattcggttggcaactttcctttacattgagattttctgaagaccaggcttgtaggtcaatatatttaatagaatatactcactgttgctggagtgtttaatgtctgaaaggatttttgtggaggaatgcttattacttttgtcacattttaaagctaaaatattttatatctaccaggctttatttatctaaaaatataaatattcattatacaactaatatttcaaaattaatatatttaatcgactgagataatgattaaagcatatttaatccaattttgttaaacatttattaaatattgaatatgagtcttaaatttattaaatgttttaaaatcagactaaatttataaatcgtcaaaatgattgcaaaacttttcactgatacagtacttataattccactttgtagctattcttgaggcatatttgcatatgttactcagtttataatagttttattgaatacttatttttaccttttacactttaattttatcatatgttgtaaaatacctttttagattatttttatgctgggctagtgctatcaggatcttctaaagtcaaacatgaaggaggactgtattacccaattcaaagtctatttttgaggtaccaaccaaatgagttttgattgcctctttcaaattcgagatctgtttaacagaccagttcactttggtgattaaccattattattgttatatcaatgatactttctaaatcttcaccttttactttttgccttttaaaatttgacaactttgcttgaaattgtgtgattctataacttgttgaacagtgtttaataaacgtaggatggggctctcctaattatattcataaaaaaggtactaatttgtattttataataggtatatacttaattgaagaattaagttatccatatactaacataatatcaaattatccatatactaacaattattatacatatttattgtgataagataaatattaaatataataaaatgtaaagatatatcatcgaagttttctttcttttgcatgaaaattacatattttcaaagaaaactttgatttttagtatcattaaagtcacatggctttttgcagattcaacatatatatatatatgcataattagtatatatatacacatatgcataattagtatactgacactcccttaatgctaggagtactcttattaaccagaaatatattttaaaatgttctgcctttccactaataacagcttgccttcctgctcccaaccccttgtcaggcatagatttacctgcttttcaatgagtgtaatgtcatagagactaaaatctaggtgctgcaggtgcatattagatagcaccaaataagttctggtggtaggtaggataacattattgctaaaccagatagtaaaaaatattttttaaaaataggttttgaatgtctcaagctcacattgacagcttgtatttactgaatgcttttgttgcagacgatgctctgtttcaaatacattaactcattttatcctcataaccaacatacgatttgttcatgttgtaaaatgtaaattcatttttcagatgataactctaatttaaccctaatagtactcaatctttccctattccagtataaatgtgtattggatttcttttttgacttagccaatttgacttcagaagttctttttctaaactttaattaaattggaatctttttaaaaatcttacatgcttgcttcctcagtcatcattttagaatttattaacacctatgtaacaaaaattaatattagtaatgaaaataagcatgcaatcatagtgttctgcatttcttctcattgttcagatttagtttaaaaccacttatttaattttccttacagaagtttaacagtttaggagacattgagtttctttccagatctggaattttgggcttatagtaattttgatgtgtaatcactctttcttactaacatattttttcttttaataaaaccttttcctcataatttatttattgaataacatacagtgaggacctagaaagctacattttctaaatgaatttgagacaggacaaagataactgcagctattgtcaaaagctgatatcatcataggtcctagctttcgcagaaaatgatgacaaggaactgagtattgacaccttttattaatatctggtgatgtagcaaaaataaaattatatatagcatttggaaaaattaagcaagtataaagcaaattaaattgtttttaaagtttcatttctattcatttgtcacccaatatatttacaaatatgaaatagcaaatgtatgcttgtataataatgttactttattaacatatttaatgtttacctctttcgaaaggtgatttttttttacttgctgtgtaagatatatgctcaagatacatgtgtaataaagtaaatatagtcctaggaaaaaatgtaccttataacaggtcaaggtagtacagaccataaagtgaaacaaatatttccctggtggtcagagcaaaagaaagaaagaaaaacatgtaaaggaatctaacagaatctatttcccctgcacacccaacacttcctcaaagaaacaaatctactcttgacaaattttcataaaaattttttgtttgaggctttttattgcaacccctacagcatccctacttcaattcaatagcaagtttaattagcttgacataaagccaaaaatttccttaaccggaactagaatttaatcatgaagccattcactttattcactgattaatttttttttctaattttgatttggacaactaacagatttagcagctgctctgtagtggttcatccacccccaacctgcctcatgggcttaaatgtctacccatgaggaacttcattttaaattctcccataaataaatatttatatataaacatggttcagcttagttagtgttaacacttagtttagcattaataaacctaaccctcacaagggtgtagtaaaaattaatgaggtggagaagctgtgttaatgaactggtttttaaggttaaaattaaaaacataagcgcaaagctggagtgatttcctagggatgattattactgattatcaatgagattatttttgacaaaagatattttattcctgaagcttatgtttgtcatgaggataatttcctcagctactgtagtgatttctcttcagtgacaagcaagaatacaccatataaaactttgtcactctcacactttgcaaacatccttcagaaatccaaagctcgtagcagtttctccacagttgggatttttagaaataattgatgccagaaagtcaaacatataatgaatcaggaataaaatctccttatgctgtctcttacttcaaaaatacctttatatgcaattcttggtaaattgatagttcctatctaaatttgaacatactgcttttcagcgcatttagtgatttagatccagaatattccattagttttccttgaagcagttgattaaaataacctacttaactctttgagagattatatgactttttaggctttggatttaagccctttaatttaacctttcattttcatataaaactcaaaaattacttctctggcttttttcataactttttctcctaaggtaaaattgaccttagagtttaaaaccacattttactagtagtgtttaatacctaataaaatgatttgaataatcccaaactccacagtatatgcaaagctttatttcattagtctctgaggcttagcctataataactttattaaatcatttgaatattaatctgaatgagtcagattgacatggatgaatttactagttgtaaaattattagatgttattacaaaataaattagtgtttgtaactttatcttccatatacaaatgactctttttttaaggaaatcacaactcacaataaaataatgtttaagtgtttctttaaaagtataattactttggtcataatagatacagtaactgtgagtgtgtaatcccttggcaaaatacagtatggattattggattaagttcagaggaaacaatttaaaaatcaaaaatacataattttatgatttactttaaaatactgtatagatggtgtctagctatttgcccaggctggtcttgagctcgtggtttcaagtgatcctcttgcctcaatcttccaaaatgctgggattagaggcatgagccaagatacccagcctaattttatacttttaaagcaaattatgaagagtgaataaaagttgaaatctgttttagactaccctcacactcttatttcttttacataaatcataaatttgcaagtttttttaattcaagtacaaccaaacaggtactttcattatgtatgaaaatcatgaataactctgtctttatgtgacagatgacctgcaacaaaatggttccattttcctggcttggcacagggtatattttatcatagtgctcttttgttttgcttttaggaattcacaaagtcagttcttcattcaagttgtaaagtaacaaggatcagggactgtatacatcttctgacctttaatgctcaagcacatttacttaattaattgtccttaatccttagtagagtgtttgtggagacctttcccaagcataggagattccaaagcactaaagaacaatagacattttaaatttcacttaattgtgtcaggttaacatgataaaatagcaacatatcatgataaaacagcaaaatatcaggatgacttatgatcttcttgagtataaagacaccaatatagtacaaaaaagtatcaacaaaggggcagtataaataaaggggcagatagagactattctaagatcatttcattccacagtaaaatatttcactgagggacaagtcagaacagaatatgtagtaccccggagatcttgcagacttaattacacctgagtcaaagaaacaacaattattatgcattgactttattccacaccaagtgctaaatgttgctatgtttcatgtgtaacgaatagatagacggataattgatacttacatagatatacatagagctatagatgtgtgtgtgaatatatatatgtagcaggtatgtgtgtatatgtaatatatatacgtatatatattatttgtatatatatatttttttgagacggagttttactcttgttaccgaggctggagcacaatggtgcattctcggctcactgcaacctccgcctcccaggttcaagcgattctcctgcctcagcctcctgagtagttgagattacaggcatgcgccaccatgcctggctaattttttgtatttttagtagagacggggtttctccatgttggtcagcctggtctggaactcccaactttaggtgatcctcctgggattacaggcctgagccactgcacccggctttatatatattttaaaataacatggtaatagtaaaatttattgaacatttaaattgtaggccaactgctaaacatatttgatgcaccaccaccccctttaatcctcacatcaatttgatgaaggaagttctattattgacctaatgtataagtggagaaaaaaaaaatgaagctgagggaagtcaaggtatttcttcagccacacagctagtaagtaataaaacagtagctccaaatcaaatctaacatcaaacttcctacttaaaatctttataatactgccttgttcaactcaaaacatactttgcattacatttttgttttgcatgtctgtaattaatgtatgcatgtagaatttactcattatctgatccctctaggacattgttctgggtgttagcctatagtgagcaatggacatattaatagtgcttgaggctagcaaaatcagtacaaaccattctatttcatataaatttccttgcctacctggaatacctgaccactttttctatttcctaacatttttcttctttactccagccccactatactccctctgtattgcttattggaattatctatgcaaaacacaattctgactaggttacccctacataaatctttgatggcttacattaattgcatggaagtttgtaatttgccctacgggtatacagaggacaccaaagaataagaatgttgccttaggaatatgtatccagagaactctgtagggaaagtcacattaggaggtcattttaatattccaggtaaaaagggcttgaattctccctctgtgggaggcttgaaaataaacgagaatttgtaagtgaatgaataggtggtggtgggagtataaaaacatatggaggagttagaatgacatcaagattctgagcttgatcaattctattgaacaatttataatgccagtacataatcaagtcacacagataaggaatgtaggtttctgggagaataagtaagtttagtctgagatagatttattctgactttcaggagaaaatacccaacatttaaaaatatttgttggtgctcaggaaaggcagatgggaactggccacaaaacatgttgagagactcaataaaaccatggaaatgtttcaccaacgacaatttgtgctaggaaaaaagacaacagacctaaacttcaggaatatatgtgtttctctcacagagacaaaataaaggtagaaagaaagaagctagtgaaagagagaagaaaggatgatgcaataaaatagagtataatacaaatgatgttcaaagtttaaagtggggactgatatcacatgctaaagtaactctcaaaaaagacctttgggccaggtgctgtggctcacacctctagttgcagcactttgagaggctgaggcaggaagatcacttgaggctaggagttcaagaccagcctgggcaatatggcaagccctcatctctaccaaaagtacaaaaatcagccagacgtggcagtttgtgactatggtcccagttacttgggaggctaaggtgggatgatctgttgagcccgggagtactaggtgagctatgatcactctactgcactgtagcctgtgcagtagagtgaactctttctcagaaaaacaaaagcaaacaaacaacaacaacaacaaaactttgggttttgagacctttaaaggccaagttcagtatgatagaaacagaaatcataatccaaggcaaaccattttccagctttctctgtaattatgaggctatcctaaactctatatagtcctcaaattaaagtactaggtatcataatgaatattgattttggccataacaggaatgaagatgtgaacaacacagcttcatggacatgacatgagactgaaaccatggtggtctttagtagtagaaagaagagagtccatctagaggatgaggctgaaattagaaaacagagtctgattagtgaaatgaatttctcctttccaagtaaggtatctagatcctctagattttcttcttccagggaaatattctgccatatggaatatagtcagcattgtaaatattatgtcaaactagaaaaatttagagtctgcactctcacatcttgacctataagcttaaactaagtaaaccatttttatatcagccaggaaggtatacaatttctagaaatattttcttcattctttagaactaattttcatttcatatccttagaatttttttcaataaaatacaactattatcataataaaactagaaaccaatatactctttccataattctctaacatccagtgaaaaagtctcatgatggttaggctaaactgataattttcccattttaaaaaatgcagagagaagtaagaggataacaattctttctaagaaggctcactaattacctacgtgttgtgcagaagggctttagcacctgtgaattcatggcctcagttcctaggtgagctttctgcagtgttctgttttgtttttgttttgagtctaattcagtattttgggcaatttctagggctacagctggaatttctcccggtaaattctaacaagtcatcttctgctttttacagagcttttttaaagttcaagtcctcttcagctaactgcagtgtcagccttggttcaaattataaatgatgctgtatgagtctgtgtagagaggctcagattagatacaccttatctttcacaactttcttagaataccctcagacagtggactttcaatctattctacaagaagttgtttaaaatggtacccctggaagttatgtttgtggtgcctatagtctaagtgtagcctcagatgtgatcagagtaacttctgtatgccagagagatgttctgctcattccatgggacttaaggggcaagtatggagtagcactgtgcactttattcttgaatctgttggaagactaaatatttgagaacacattgatcacatagtgctctttgggtcggaaaagctaaaacaatgaaaaatattagctctttgtctaaatctattcatatccatagggacagggttaatggcttatgaaatggttaccataccccaataaagttcacactcctacaaatggcctcaagaccatttattatttggactctgtcatttttccagatttctctataattattaggctgtcgtaaactatatatatagtcctaaaagtatttcatgctcatttatgatatcatgtctttatatcatgttttctctgcctgctgggcaactgttcaataacccacgtctctctgactgtcttcctctccctgttactccctccctccttccctccttccctctctctctatctatctctatctccctctctctctccctccctccctctctccctccctccctctcttcctctctctctgtctctgtctttctgtctgtctctccctttgtctcatatgattcctttatttatttctggtgacatttcattacaactatttaaaacaatggctgaagccattccaagcacaccactgactttattagactataaactcattgagggcagatttcatgtcttttttatttctttattttagtttaataacctacctctaacatgtaagatcatagtcaacacttggtgaatgctggcgtgataagtgaattaataaaatatcctccagtaccacagtagccactaccctcaaaaagaattcccttatgacacctatgagaagaatgatttcttaggaggaacatacagagccatctttaacaattgcaatagagaatcaaatcatacaatttatgcagaaatacttcatcgattataaggcccccaaatagatgatagtcaaataattgctacattgaaaatgaatattaataactatgttgaatagaattaatgttaatatcaatacaaatgttaataaccattttaatgcagtaataatatttgtactcataattttgcatactattggtaatatcttacatatcatattcgatgtctgaagcaaactaagatacccccgaaaaatataggaaagttacctttttaaaaaaactgattttagatgtgatcctaagtgcagagagaagaaaactctctgactttcctttttaaatatagttctataattctagcaatatctctttattgatctccgtggcaataaaagtttcctatccgtttcatagtgtcattgggttgtaaacttaggatatagtgacagaatttatcaaaccaagcaacaaaacgtgttaagttttttgaaaatgtatgtgcaaatgttattctgtttgaattgccagtgcttaaagtgtctacccagtgccactgccataattcatgtcaaaatatccagcaaaaaaaaagttacctctttcagtcaggtttttaaagatcttgttttccaggcaattataagaaaaaaatgaaagtgtttatgtcacgcctcttaataggtggatgaatttagagaattgtctttcctagctcacaggaaattaaatagcattttcaaaggatcacatctgtcacaacagaataaccaaaaatgtgtctataaactgtcagtaaagagcatcacgaggtcatttatatcaattctgttttcataaacatagtaaatcatccacctaagaaatcacaaccattacagacttatttaaattataattcatggaatttttgaacagtcattaaattaccaaaataaaaaattgtataatgtctggtatggaactaggatgtttattaaagaaaatctctatgtctctgtgcaccaatatgcaagcaggcctagtaacttgacctctatttcctaaattccattataagaatactaacagttgccaaagctatcaatgtttccctatcctccatttatttaaaaccctcatgagaaatagaataaatgtgcttacctttagaaagattctgtggcaaaagttttattcatctaatttagtgatattgtgttttcgagagtttttttaaagttatttcttaagatgttataaaaatattttaattgatttacctcattttagaaatgaaaaaaaaaggctttgctcataaaatagaagctacaataaaatattattaccaacttgcacgatttttaaaaatgtcagacatttagattaaatttaaacattaatgacaatgctaataataattgataagatttattgagtgattattatgttctagacactcaggtgaatgttttgcatttaccttcatttgaacttcaaaaaatcctacaaattaggcattatttacatttctaaacatttgaacattaggaaactgtgcctgaaggaggtaaccaacttgctcaaagtagcatagttaaatggagatgaaacaaacatttatctttctttacctgactctgtgtctagatctcttaagaaactaaaagataaaatctcctaatgtttgtagatgttatgcatgtgattgatctctaaatcatctgaaccatcctgagattatgcttagtattctcacaatctctaattttgagatcagactattgaactgaaaaggatcatatatcctctttatggtcacacggctcagattactgaacttaacgtatgtaatatatctgatgtacatatgcacatttaggccatccttttttattttcaattgattatttttattttctcccaactcttattttagattcagtggtttatgtgcaggtttgttacctgggtacattgcatgatgctgaggtttgggttacgggtggtcccatcacccagttacttagcatggaacccagtagttagtttctcagccttccccccaaccccacttaatagtttctagtttctgtttttgccctctttgtatccacatgtacccattatttatctcgtacttacaggtgagaacgtgtggtatttgattttctgttcctgcattaatttgcttaggataatggcctccagctgcatccatgttgcttcaaagacatctttcattcttttttatagttatgtagtattccatagtatatgtgtaccatatttctttatccactccactgttgatgggcacctaggttgattccacgtctttgctattgtgaatagtgcttcagtgaacatgtgagtgcatgggtctttttggtagaactgtttgttttattttggttatatacccagtaatgagattgctgggtagaatggtaattctaagttctttgagaaatctctaaactactttcctcagtggctgaatggatttacattcccatcaacagtgtacaagttgttttcttttctcaaaagtctcgccaacatctgttgtttttgatattttagtaatagccattctgactggtgtgagatggtatttcattgtgattttgatttgcatttctctgatgattagtgatgtggagtacttcttccatatgtttattggctgcttgtttgtattcttttgagaaatgtctgttcatgtatttcactcatttttaatggggttatagattctgaatattaggcctttgtctgaggtgtagtatacagatattttctctgactctgtaggttttctactcttttgacagtttctttttttttgttgaggatttttagtttagttaggtgtaacttgtcaattttagcttatgttgcatttgcttttgaggacttaatcataaattctttcctgaggccagtgtccagaatggtgtttcataggttttcttttaggattcttatagctataggtcttacatttaagtctttaatctttcttgagttgttgtttgtatatggtgaaatgtagaggtccaatttcattcttctgcctatagctagacagttatcccagcatcatttattggttagtaaatcctttcctcattgcttaattttgtcaactttgttgaagatctgatggctgtggatgtgcagctttatttctgtgttctctattctgttccattggtctgattttgtaccagtaccatgctgtttggttaccatagccttatagtgtagtttgaagtcaagtactgtgatacctccagctttgttatttttgctcaggattgcttcggctatttgaatgtttttcttgttgttgttacatatgaattttagaatttttttttagttatgtgaaaaatgataccaatagtttgataggaatagtgttgaatctgtagattactttgggcagtgtgggcattttaatgatattgattcttctattccattaacatggaatatgtcttcatttttttttttttttttttttttgagacggagtctcgctctgtcgcccaggctggagtgcagtggcgcaatctcatctcactgcaaactgcgcctcccaggttcacgccattctctggcctcagcctcctgagtaggtaggactacaggcgccaaccaccaagcctggctaattttttttgcatttttagtacagacagggttccactgtattagccaggatggtctcaatctcctgacctcgtgatccgccagcctcagcctcccaaagtgttgggattacaggcgtgagccaccacacctggcccttcatttgtttatgtcatctggagatttctatcagcagtgttgcatagttctccttggagagatctttcaccttcttggttagatgtattccgaagtattttttgtaggtcatgctttcttaaaatctattcaacagtgtattcacacaaggctggtggtaaacttaagcacactgattatgccgatacaatgatacaaagagaagatgcatgccaactttcatgcatgactttcatttgaatttttttttccaataattcaagcaatatgtagtttcatattatgttgaggacttcatattggttttattatgtgtaggtaaaactcaaaatagtcctaattacaggtgatataaaataaatagaattcatgtaatttgactataaatattatcaggtcatacatgattaaggggaacatcaagactgtggaagtctcagtaatgaagtcgcagtaatgtaatttaacttggttttagcttctaaaataagcacaatccagcctattgtgattgttgtactcaccttaaaagaaggcttacctttagaaattagggatattcaaatattctactttacttcaaactattttctagcatcaaaaatttatacctactgttgttgtgagcataaactaaaataaattgaatacctagtaataagtatttttctaatttcacagttaaagtttagaagccaagctttaactgtaattcaaactttattatctgagctttcaaaatttaggaatactagaaatataaaatttataatcttaatctaattacatacaatattttttccagcataacttgtatgctatagtaaatatggataagactaaatgaatatttaaatacaaaacatacaaattaactgtcaacctaaccatgtttacaaccctggcatctctgcatcatatttaatatgatacttcctttcatgttgctaaatacatttcagcatgacaactagctaagggcaaataaaatttaataatacattcacttttacatgatcttttgaacttgaaactttgtccttgcccagggtccattgaaactcttcggccacaaagcgatatccttcatcttcgcttataacagatgttttttttccctggattctgacatggagacaaattaccatcttcctatataactataaaacagaattgcttttctcattcatggattatgtggactttgtaggcctgtctcatttccaaaatgcacagtattgtacaaaggagtagaaaaaacaacaaaacagccatgtatgctgtactaactcctatactaaaatctgactttgttgtctatttcttataaaattcaattaaaatatattttttatttagtttataaagtaattactgattaattattaattatatctaatttttcaaatggtaaatcactggtaaacaatgacaggaaaaacacaaggccaaccagtgattcatcatttacatttgaaaggatcttagtaagagaaaagcagctcattggatatttaattcttgcataaatataatagctcattagagaaactttcacctactaaaacctcatttaataaatgagatgatttttctcaatggcttaataaaggcatgtaaccttcattaatttacattaatgatgataaattgtgagaagtcgatctggggaagtgtatatatatgtgtgtgtttggttgagaggtggctttgattacactaaaaagtataaatagcaatctaggtcatcaacttgtattgctttattataaaatattaatcataataaactttagaaattaacattagctcaagcaaaaactgaggattagtttgctgttggccttctgttgtgttagagaaaataatatctatcctatttatggcctctctcctagtgaagagtaaaatagaaaatacgtgagttgctctttcttccgtcaaactggagcccaatataatgaaagagatggaaaaaagcagatgcttttctctccatagaaggacaaagtcaatgagagataatatagaatgggaagtagacaaactggttagtatagtcgtaggacacaatggagtagagattttcaggtaggaggatttgccagtcacgtcaaattcagctaatttgcagggaaaagggataaaggagcaacatttgtcaattaatagagcacggttgtatataaaagtagcacttccattacaggaatgaggtagaagtatctaggatgtgaggaagtgaatatatagtaagaaaccgggaacatcaagactgtgaaagtctcagtaatgtcatttacctgggttttggcttccaaaataagaacaattcagcctattgtaattaattgttgtactcatcttaaaagaaggcctacctttagaaattagggatattcaaatattctactttagttcaaactattttctagcacctaaaatttatagctactattgctgttgttagcctaaactaaaataagttgaatacctagcaatattaagaagcgttttcctactttcacagttaatgtttagaaagcaagctttaattgcaattcaaattgtatgatctgagctttcaaaaatttgcttctttggaagttaggcaacagatggatagtggaatttacagtaataagtcaagggggtatgaaggtacacagagtgaatcttgggcaggttgttttcttatccgtaattgaggaatgaaagtaatatttatgtcataagaaatatatggggaaagacatgtgagtctaatgcttgatccctgagtctgggatccggacttcgctcacggatgtatctcaagtgctttatatggtgtctggtgcatattgttaatgcatgatatataatagtatgaaaatgttaatattactgaagttaatgttattaatcttaagaatattatagtcacttatatacttgtttttttgtcttctactagtgaaagaaatccatttatccttctaccagatattaactgaacacttagaatgaaagagatactatcctgtagtaatactaacagtaatactaacagattactactccctttctgtgccttctcttcctgccactcactctctgctatcgtcctgccactcactctctgctatcgtcctgcaggtttttggcacgtaatattctaatcttaaccctctccatatcttatttgtgcaccctttttagatgatgtttttacccttggctgccaccttggacttgctatagcactgtagtcttccctcgattccacaaacccacttgcccattagggtcttgttttctcagctgcctggcatgctgattccttggatcttcctatgtttccctctttcaactcaggatctcggctctgataccattttcctcaaagagcccctccctgaactccctaagtaattcattttaaaaatcgacttcttttgataggtgtcatagtgaaattatttgcctcggagtttttggggatttgatattgcattaatgcattagcaaaccgatggaaaaagcaataaaatattttctgtgtttataatcactcacatataaatacatgaaagtgtacattcttctcttgaagcagttttcatataccacgattactgtttgtttccactaaaaggtataaaagcttcaaatactgagataatatttgtgaactgttaagaataaaaacaatcattggcatataataaaatgcattaaattaataagtggatatcagttacatgaagaggaatcagttgcctctgccttaatctatgtaacaaatattaacaaaacacctattttgtgacaggtactggagtaagcatcttccatctctttgtcttgagaccttgtattcattcaaggtttgcatcaaatgtcaacttttcttttgcatcctctctataacctccttccttctgtgcttcaatagcatcataccttgttatattgtagcaatttttatgcagaaaattttcatatgtcttcataagaatataaatgtctgaaagtttgggacgagatctttgaattctcaagaataaagaacagtcactgggacacaataaatgtatatcagattaacaaaaaaaatgccaggaatcagaagaggaattcaaatatatgtgtaatattatctatttttaaaatactatgaaaattataatactatagattttaatcaattttttttattttaccaggaaaaaatcatggcttataaaattattaacaaaatatatatattgaaatgaatatgttatgatataaaataactgccaaatgatatataaattaatgatataactacttgagaaatatattttaagtaatctaaacaattacttacaatgaagggaaaatatcagaatttttagataaaagtggctgagataaattatatttatctcatacttactgaaaatgtttcttctaaagtataaactaaaaagtgttattgcctaagccacatgcaactcttttacaggccattaattaatagtaatgtgtgatttgttaagtttattgcattttccacaactcattaaatttaggcttataagtagctgtaacctggtttggtttcacttgttttaattattttttgatgatttaagacactagccatatggattcaagttttttagtttttattttcctacaccataccatagtagaactattactgttgttatttatattttttaaaaaattcacttgtttttctcgagaatttgtgactgatttttatgttatactgcataattcagtaatttcacacattaacaacatccagggtcatgtgaggatgagttttctagcttctgaaatgttctgaggatgtaattttttaataagaggaaatgtgatctcacagactatttgggtgttttccaagtgacttgtcacgaatggttttgctctctagtgcacttctgagtacagaaaaccaataacccaaacttttttcccccagcactcagagaatttggggaatgacacaactcagtagttattttgaacattttctaaggtacagaatagtggtaacttctcctgggtatttagtattttttttccatttaaaataaaagcttttcttttattaattacttaccttgtgcttggaacattattagatacttatatattttaatttgcaatacaatctgcaagaaagccatttttattgtaatttgctgctgagaaaactgaggctgaaagaagtccaggttctttttcatggtgtggctaaagtcttctcaaaactcagggtatctgctatgcatggtagatttaagtttttgggacacttggtactaaaatatgcatcttgtgactccaagccacttaataacatctttagagctgaagtttaggaactagtgctaaaatgagtcaagtaaaattctactgttgtatgaatctgactcaggattacttatttgctattgtgaccattgtgaggaagtgttgcagggtgctggcacctgctggcttagcccatgggcgctaaggtcagactacatttcagcaccttgggcactcctcccttgtggtcatttctcttcactgagaggcacattatagtcagtacttaccaatccctcttcacccttcccacaacatctttgtatagataggtggtcacctgagagacagacatgcttgggttatttggaattgtatagatagttggaggtttttacaattttaggtgtgtggaaactatataagttaatgcagctgttcacatagactatattgaagaagtcttcaatcccaaagcattgtccagttatttagaagtaaacctggaattccagtcttgatctgagtgacttcaaagcttgtgtcctttcaactaatgctcttgtaaagaaagagcaataaacatgttgcatcttgcagtcaagatcactgttgtccagatttaagacctatctttcccacccttcatattgttttcttcttttcacataggaaagaagcagcataaggatttgttcttaagtaaacatgtatttattgagtacctactatgcgccagtaccatgctggattctatcataagaaccagagtgcatgaggtttctttggctgttgtgacagattatcacaaacgtagaggcttaaacaagagcaaatgtattatcttaaaattttgtttgtcattccaatacgggtcttgcagagcaaaagcaaggtgttggtgggactgcattccattatggaggctccaggagaaaatcaatgttcttagattttccagtttctggctgctgcccacatttcttagcttctgatctttttcttccatcttaaaagctagaaccatagcatctctctgactttgctcccatcatcacatctgtcctgactcttctgcctcccccttctacttttgagggcccttataattacattggcttcacttgtataatccagtagaatctctctattataaggtcaggtgattaacagacttagttacatattcaatgttaattcctttttccatgtagcctaacatagtcaaagatttgaggattcagatgtggacaacgttgaattgttttgcctactacctggaaaaacaggaaattgcccaggttgtgccagatatggtatacaagagacaaaaggcaagaagtgttctacataaaactggccaagcgcggtggctcacacctgtaatcccagctgtttgggaggctgagtcaggcggattacctgaggtcaggagttcgagaccagcctgaccaacatggagaaaccctgtgtctactaaaaatacaaaaaattagctgggcgtggtggcatatgcctataatcccagctactcgggaagatgaggcaggagaatcacttgaacccaggaggcggaggttgtgatgagctgagaacgtgccgctgcactccagcctgggcaacaagaacaaaactccatctcataaaaaaaaaaaaacaaaaaattgtattctacataaaacaatcagagaacaaagcattgtataagaaaatatgcaacaacaataacaataattgtaaacagagcttaagccaacatttgttgaaaatttgttgtatgccagttactgtgcttattgctttgtatacaatagttgttttaattttcaaaacaacttgtaaagataagccatcctcattttgtgttgataaagataaataggctaaggcttggccaaggtttcctgggtaacaagtaggaaaatgagatttaaacttaggtttctgatttcaaagactgtgctccatttcgcaaactattcatatagtaaaacagggtttagaacaaaatgatttcaagttggttcccaactttgaagagtgcatccagcatgttgtcaacaggaatatgctgaaagaggcgaaaagggagtgaatggaagtaggaagtggtaaacagcatggtgtgtagtaaggaagattgactgttggagagtgttggagtttgtgctgggaagtcagggagataaatactattaggaaaaatgagggcgttttagctggtctttaatctcttgagtctgcacattcatcagcaaataagaggggacacgtataggtttttaaatgatgaaaccatgttttaggtacattagtctgacagcagtgggaagaatgggaaagaaaagaagtagaacaagttttaaaatgctgacaggcaatagcagtgatttcaaacaccaattaagttggaacgttcagacccaagctcctgtgactggtaatcacccctacagtgtcttctgattcagccccacttattatatttatcaacgtctcaaaacttaatctttttaaaaaataaaactcgttttacctaataaaacattatgtttcagataactttaaaaggatcatttcctccgtagatttttgttaggtttaggtctttgaatgtttataaagtgttctcacatacattttcatacctgggcctgtgaatttggtgaagcacatagactcacatgggatacacagaggaaattaaaactccaagaaattgtgaattgtcaaaatcaagagtaacaatttcaatccagaactcatctcaaagatatggccctttgtgttatagattgttgggtagtagataaatatatataaaatttaacattttgaatatatcttacattaaagagaccctaacttttgtttatttttatgaaactggtataattttaaactgagattacttaagaattttagcaaacatgcaaatgacctcttcaactatccactgcctaaatgtcctttccatcacccaaacggcaatcatagtcacttctacttccgctgtatattgtaaatatatagcagaaacatactcatttcttcagattacacaccaaaaaacacagtcaccagctgcaactttctgacaggccaaaatatgaagaattgttaatatatgatcaattgatctggatcgagcagagtgcagcttactgtatgacatgttgcttttcatagacgttatctctgttcaatttgcttctgcatttaagatattaaattcagatctatgtggcaaagatgattagaaaaaggtaactcctcccttagggatctattttaaaatgtcaaaattaaaattttccagaaagttttgagcagttttagcctcctggctgatgcaatatattgagtagcactgttagcttaaggatgctgtctggaaatggaaatgctgatttacccttcccccctgccatgccacctaattaaaaggcaccactctcagtggtaggcacactaatacatgattttgctagtggaactgggaatagcataataaatgtgttgtgattgaggatatatgctgtgcctatatttggaaagaggaaaatgtttaattgctctttaaacaaatttgattgcacaaatgtagcatgaagaagaagaaagacgtgatttttttttaactgaaggcaaaaggtatactcattttacctccaggttgataattctcctgtgacagtgtgaaagtaattttgtccaaggaaaaaacaatggtttccaaacagccactgtcacttcactcttccactccttacacgttccaaccccactttaccatcaatatatttgacaataatataatataaataatagcaaggaagcttttctgttagagtaggccatgtatggatataaatgtcatttttatgtcataactagacatgataaaatataaataaactgatatagtatttaaacataatgacaaggtcacaaatacatctttttttactgtgtaagccaaccaaactaacaatttcaattataagtttagtcagaagtaaacattctaccatcaatggtagacatagacctctgggtcagaaaattaaatttacatttaaaatagcaatgttttccctagcttttctttgtaattacggacaatttgaaagctgccttaggaattaaaaaggcagtgatctcaccaaaaccttcatcatatttcccctctccttaaaggatgaaaacagaagtgagttatatgttaatctcatatactttggaagaggttcaatgattttgttacatttgagaggttttgtctgatttctcagacttttgagtttcatagcaataacatacattgaaagcgaatatatttatagccattatttaggttccatatggccgattgtatttcttgggaggcgtgacctaactatagttagagctagcatatattgccttaaaaacatgggaacactgggtaaaatgcctaatttatttgtaagtagcaatttactaataatagaatcaaaccaatcttagttattgaatttaagaaactacaaaatttcacagttacatgttattactattgttgatcccctgagagtagaactaagggaaatataatcactaagccctaggtaataaaatcagttcttgtagaaaatatgaccacaaaagagaattttcagtgtatagaaaaatattaagcgaaaattataaactagtagacatttaaataatcagagctctacaattttttaatgagcaatgaagattgattaaaatacagaccctggttaatataatcattattcagatgatcttaacattagtgagcctaatctggattgtttaaattgcaaataattgctgccttaattgctattaacttggaaaaaatgattttcttctttcaagattaatcatcaggctggtgttaacagctgtaatttggatcatgatgataacaaacacaaaggcagttctcttgaaactccaactatccagcatgtgtttaatgtcaggtactgggaaaacgtgatttatatacatttatggcttagaaaacaacaaaaggacataaagttgaagggaggaaaaatatgatgaatatttttgtggatccattgtcttttttctagcacagcttttgatttgtccacaaattttaaaaaagctggaaaaaatcctgctgaaatgtaaagttgattttgtcaccaagaagtctatgtttaaatgcctgatggtacaatgtttacttctgattaaatctagtgattgaaattattagtttggttggtttacacagtaacataatagatatagttctgatctagccatgatgcatattggctatatgcattctttatatatttatatataaatataatattgtaacaaatgccacattaatattgttaaatttattaaagaaaaacatagcccttagagaaaaataaatggaaacaatggttatgcacagtaaaacaaaacaacttttttaaaggacatatttatgaacactgtattctttattgaccattgcctgtcatctgcgggtcacaatagtagcaatacttttgaaatatatcaaacaaaacattttgttgtatccaaagtgtccacctgtttttataacaagtgattctaggattcatcacaaaattaacacattaatacactatgaaatgaaaaaaaatttgaaattggcttttgtttctttgctttactggaaatatattttgtggtgaattcatctgagttattttttacttccagaaagatgattaccatatgtattttatttataaatttcggttctgattccaaaaacacaatatttaatgaaaatgcatagaacaaagccttgagatgaaaagtctttaatattaaaatattaaacacctatgtggaaggaagtttcttgcctcattccctaaggacagcagttggctaaacaagtataagtgaaagaattacaattgaagataccctgcagaagagaaaagaaaagtcctgccacccggtactctgaagacaaaaatctgtatctgctagcaggagactttgtttgcaagacagcagaggtgattcctagaagccggactttctggtggaaatcatgatttttggtttcatctagtcttccaataacaagcaggttgagtcctgaaaaagcataagcacaagatggcattatatgagtaacatgtaccagtttctcaaaacatttcatttaaagatatctttacttttatgtctgacatactgtccttaatagcaatcttaacacttctgaattttaaattgttacatatttgagattatattttcataaatcatctaaaaaataagaataactctatatagctaaccaaccgtatactaatgaacaatgtggctgagactaataacatattttggtaacaggctgtgtccacttgatgtttatttcatttttacccttataaatgtaatacaagcaaaacagaccacaacaatttttattttttaatgaatcactattacaaacacttttgtaactgccacccaggcaggagctagaatttcggcgatagtttcagtagctgtgccacatcccaatctcagacctctctcactaaccatacataaccatgttcctgaatttaaattgttacttccttgagttaacttagtttgtattacccatgagttcattcctaaagtttgattttgcacattaaaaaaaaaatacgcctttttaaatggcagaaaatatttgaaaatgatgcctcaggataaataattagtattcagaatctataagaactcaacaagaaaaaaactaacaaccccattagaaacgggtcaaaagacatgactacacatttcacacacaaaaaaaggaataaagcagccaaccgataataaaattctcaatatcactaagcatcaaagaaatgcaaattaaaaccacactgtgatatcatcttaacaccagtcagaatggcttttattaagaggtcaacaaacaacagatattggcatggatgcagaaaaaacggaacactcatacactgttggtaggaatgtaaattcaatctttatggaaaacagtatggagatacctcaaagaactaaaaatagaactaccattcaatctagcagtcccactactggctatctacttaaaagaaacgaaattattatattaaaaatatatctgcactcatgtttatcatagcactgtttacaatagcaaaatcttgtagctaacctatatgtctatcaaaggttgaatggacaaagcaaaggtgatacatacatatcagcatggaacacaatgcagccataaaaaaagaatgatatcatatcctttgcagcaacatgaatggagttggaggccattatcctaagtgaactaactctgaagtagcaaatcaaatattgcacattctcacttataagtgggagctaaacaatgggtaaacatggacgtgaagatagaaagaataggctctgggaactctgaaagagggaggaaggaatggggatttgaaaaattacctaccaggtataatgttcactgggtaatggatacactagaagcccaatacctaccatttcacaatacatccatgtgacaaacaagcacatgtagctcccgaagctaaaattaaaataaaaaagatatgtctgtttaattcctattaatctgcagggtcttcctccgttcctttccttttcttaaactcatctgttgaaaacttaagttatttgactgaagaaatccccacagtctggattaggatttttctgattagacacacatggtttagagctcaacatgttgccagaattggtgtatttcccacacattggcagctggatccagaggcttgagcagactcaggttggagccctttgatgatggtgatgaattctttcctcaggagggaatatctagttgtgtttctttttgtgttgttagtagctattgacggataatacctacatccattaacacattaggtttgcaagttggtgatattctaatctatcatttatctttttatttgttagttggaatacttttaaaaggaaatacatcttcgtaatctgctattaaactacctaatggtagatgccataaagaaaagatatatgcttgattcatcccctttgtcagttccaagtcaacaaattgaattatttgaagatgaacaatttacttgataaaaaagtaatttatggatttaaatacattgatagatttgcagttcaataacttgcaatcattattcttttggaagctcaatttttttccttttggccatgggagtcccttcaagtaggctcctggagccgttcacaatgaccctaatagtctgtgccagcttcctctcagtgtgctgtgacaagccacaaagttaaaattcatcatttcttctagaaggtctagtttctttggttgggaaatggtgtttgaagaacacagattactggaggtgctcattgctgtagcgttagtaagaatcaaatatatcaaattatactgatacatataacccaaattgaggattatagttttcttaatcttttctgaacatctgtatccctttacctccacactgaaaatctttgttctaacagttaccaggaatgacagaatagatctctcctaattattctttaacttcatctcacatacacacgtgaatctcagaaaaataatacttcgatcagtgaaaagtaattactgagaatttttcttttcatacgttggtatgatttttatttagttcatagatttgtttgaatctgtttatcataactgggaagttgattattaaaacactcttcatacttaaagtggagcaaaataacaagttatcaattttctttcatttgctttttttctatatgctcctgttattaccactgaataatataggaagctcataaattttcccatagcactaaggtattaaaaattataaaatgtggatgatatgtgtacattcgtagttctgtgtgcactgtattcttttatatagctcctggaaaacttcagcttcctcagatatacctccctaatctctcatattattttgtacagtcctaaagcattccatacccaaacactcgacacatttgtggtaactctttccaaattgtcttgctaaaagtctgtacactctggtgtaccttttttaaaggatatatatatatgaaatacataatagacaatacacatttgcaaaataaatgactcaatgaataaatcagccttcccatattttacataagtgttaaaaatattgacttaattgtataagcactgttatataaggtcatttttgtagtgatttttcacaccataaaaggaaatcacaaaagttcaacagatttttatatgctttaattaacactctaaccctggagagttagaagaactctccaggctggacattgataatttaatactagcacaaaattaggaataatgagtgaaatactacatatcatctcctgctgaaaggcatcaaataagctttctcatttttttccagttttgtgatgcatagttgctactgtctagaatactctgtaactttcactgagctgagctatccctatgccatgcgaccaacatccgtaaggaaactcctcacatttccttatggatggttgttcaggacctgcatctggaaccccatggcttcaaatgttaggccctttttcctaatctgttactgctaacctctgtttctggctttttgcactgtccgctaactatacctttgtactgatatatgcccctgatatctggaaattgatgttctagtcttgatcccaggctcccctcattggttaactgtgttcccttcctacactgcattctccctttgttccaggcaatgcatgagccctatttagcttctttctcatgatccagccgcactatatgtacctggagttgatgttgcattaaggagtacagtggggggtatggtctgaatacatgtacatttattgtactataacacatgaggcattcaagtttcttggtcgagttatcaaatgaataaatgatctttcagagactgccacagaagcatgaataacatagtataaaaattagcatcattttagaacttagcaaactttcttacatgtattatgtcaatgcccctaaaccttgtagcaatcctgaacaaggcagattattcagttttacacttaatgaggctcagatatattaagtgattttctaagttcacactgaatttaggtgagagaatatgattgaactccatcaccttattgctatactaaatgataaatttcattcttgcatcaccaattgtgtaatagtgaccaaacttcttaacttttgtgtgcctcagtttcttttattcttttattcttttaaatgattttctctgtagaagtgagttatctatgtaaattgcttttaaattctagggagaaaaaaagagctgtaggagtgataattagatgccatgatatagatggttttaaatggagttgaaaggttcatggaataaaattctttccatattttcattaatatggatttttaataccctttggaaattaactttaaaagtgttttccatctttgtgaaaaagaaactttatttccattgactataaaattctttataatagaacatgctccagttttatgaaaccccgtaggataaatagtggcttaaatacaccggcagacagatctatctttaattgaactactcagccagatcccattgggagtaaaaatctagtctttcaaagacattggaaattttgtttctgaattcaggtccagtatatcaacagtgacatatgcaagtaggaactggttctgctcatttactctgcctttgaaatttaccaaaaccacattcttggctcctaagtgacagagataagtctctttctatggatcccacagcattaaaaaatctaaacacaaggtaaatttatatctgcatttccaatcaaccattcagatttagtggatttttaagtttatttcttcataatctttagtttaaaaaaaaaataaggaaagtgctgttttaacatgtagaaagggtaattttaacataacagtcttaattgcttaaaattacatgctgtagtaatatacaatactgtgcagctttatacagtactatatctgcatttgcattataggttttcaatcatatgttaagctttcctcataactattaaatctgttcatattgcctattgactttgtaaataatgcataagttttccatgtcagtataataccaatttatttcaccattcactatcaaaagtttttaaaatattcaccacattctcatcttccagtttattgctttgaagggtaggattctgtgagagtgcatggtaatgaacttcatattaagcagtctacttcaatacagtctgccttaattattacttattaagacaccccacaagtttcacaccagctattttctgttaaatatgtagcatacattataactgtaccaaaaaatgatggcatctggaattgtagagcagaaagaaagtttgagattatttcttttaaccttcttattttagaggcaaatgaagttagatctaggaaattaagtcttttctaacatgacagaattgactgttgagagccctggaatcagagtcaaatgtcttggctcccattcttaccttctttttgctttttcttttacactacttcttctgtgtgttttgtcataaaagatatataagttgactttactttgatgaagggaaagctactaatggcatgtgagagaaggactgaagtggggataaatagttattgtacaacttacaattttttcaaattctgaacaacagtgcaaggtagtgatggcatgtgcaataggtgtcatgcacattgtaaaaaaaactacaggtaaaataccattaaaaaacacactctaagaagcaaagcctttctgtcattaatcagtactttggttttgattatttaagatgatacctctggctcacgcctgtaattccagcactttcagaggcccaggcaggcggatcacgaggtcaagagattgagaccaccctggccaacatggtgaaaccccgtctctactagaaatccaaaaattagccgggcgtggtggcgcgtgcctgtagtcccgctactagggaggctgaggcaggggaatcacttgaaccccggaggcagaggttgcagtgagccgagattgggccaatgcactccagcctggcgacagagcgagactccgtctcaaaaaaaataattaataattttttttaaaaaaagatgatactcccaaaaggttctggtgaagatacatgttttgttttttgtttttgtttttctcttgagacggagtctggctctgtcgctcgcgctggagtacagtggtacgatctgatctctgctcactgccacctctgcctcccgggtccaggcgattctcctgcctcagcctcccgattagctgggattacaagcgcgtaccactacgcccagttaatttttgtatttctagtagagatggggtttcaccatgttggccgggctggtctcgaactcttgacatcaggtgatccacccacctcggcctcccaaagtgctgggattacaggcgtgatccaccgtgcctggccagtgaagataatttctggtaagttagtgggaaaaggaaagacctcacaaaatcaaagagtaagggaagccttaaaaagtagaaagggaaaaataaataaacaaaactgcatgaaagcttctcttccctgtcattataaaattaattttttcttagttactgatgatatatatcaccggaccagatagtacacattggtagcttttggaaaaacttggcattttgaaattggacagaacaggtaaacatagaagctcccaaaactatgcagagaatgaaatgctacaggtttaagaaacttctatcgatgttacttctgtctacatcatacctagtgcgaactgtgtttgagtttgggttttttttctgatttgtttcattttgtttttaactgtggctcctaaattttaaaacactgctagctaccgtttattgagttcgtttatgggcagtcctatgtcaaatagtattaacactttattccatgcaatgcttacgacaacttttacacaagctgcttgaaattatataggtttgcaaattatataaaagaaagagattaagaaactggcctaagatcgagagtgtgtggaaactgggatttgactttagtaggtctagcaagaagtctatgtccttaacaactccatagtcctcctgcacactcattttcaggagaagcagtatttatttattaaaatacttttcctccttaaggacaaaaatgtcaacaaaaacaaaattcattgcagtctgtgagaatatctttcaaagtgaggtgggtttccctactagccaaccaggtttttctccccgttcactattcttgaactaatgccagattgaagaagtaaactgtatatagttacatattacattttccctcacatgcatagcgtgtgttcattaatattttgcatatgatcaatgaggcaattgaaaacattttatatcatggaaaatcatgaaaatataaatggacaataaatagcattcatgttgccattgctctgtgtccctcttttcctctcacaataaatgttttgtaattcacagagtggtacatggctaacagttgcttatgcaataatactcatagaataagaaatagtactcatagaataagaaaatagtactcatagaatcagaaaagtaaatacaaatatgaaagagaataactgtttctactccattcattttttttcactcgtggttaatgaaatagaacaaaacaggactggcactgtaaatgaccaactggcgattaaaataagcttcaaaagtttttcggagttgatgaaatccttatttcatgccacaagcagctcccaagagactaatgtttgatgtgcttgctcaattttacaaatacaattgaaattgaaggtgtataaaaaatctgtagacaccaacattttctgtaatactatgaattgcttttgtcctttgcaaaatgttattctctggccttgacaaaaaataatttgtttaaatcaccttctcagtggagaatttcaaggatattattatacaacagtagggtaatagaattgtcatctctatttaggtgtaggaaatattattttggagatagtaaaaactcacctctaccacttcaaccatctatttgtgaggaagcacagggaaatgttatgacttttttaatatttaaaaaaattgtctctctttgaaataaaacttataaagtgtacctaaaaattgtcatggttcattagaagctatccactgagaaaattaaggctaactatggagatagtaattgactttaagagttgcaaactagtttcaattaaaactggcagcaattatttagcacacatctatgatttattggaaattcagacagattgtgcagtagcattaatagaggtatgtttctggattggtacaggtatgatgagtgagatttttttctgtgctgcaggcagtctaggaacaagagctgctggaggacacatttgatctacatactacacactcttgtgaaatacaaaccacagtacatggtttcacaggataggaaacagtttttaagttttgacagttgaattataatgattatacaaaataaaatgcctactcccaacttttgtaaattatagccagaacggagaatgtttttagttccttatgaaatgatttatgtaagtgatatttatgattttacatggggaatgtatggtacatttcctgagaaaagtcactttgattctacattagttatgctttttaaaaattcattgaagtccactattatgaattacagcatcattgttctcatatcagtagcatacaatatgtcaaaagggatttaagggctatttaaacattttaaaaacttgagtcctcaggtagtatatagtgataacaatgttgttatttttaaaataaaataaagggggggagctggcttagtaagtgctgcgtataaactaaatctgccctgaggcaatgattttttactggtacagaagctgctagtgctgggttttcggtcattactatgatttgtagcaaagctagctctccctccagccgtgtatcgcagagcttgcagtttattcagccgactactatctgagagttgcacagtattgtctgataacattctatagcttccaagtaagttactcctatctcatcttgttcatcacagtagatcacagtcttagctattactgttgatcaaatatagcactgaatttaccactactctgctgagcctgaatggggacaacagaagcctgacagataagctcagatagtgtagtttagcactgaaattgtggagaggcatataacctgacacaaagccatctcagcctattttagcaaagatgactgagggactgtgaagctaaaaggcaaaatgctaataaagtcttctgctgaaaataagtttaattgtaaaataatacatagataacacccttaatggtcatggtttatattttatatatgagttttcatcagtaagtgatctagatactcttgtgaagctctcctgttaaaagacttatggttttcataaaagataactattgctggacttgcatgaagtgggatgaatttataagagcacactcactgccagcctatgcacccacccctccaaagaaaaatttttgctaaaaatgaactttgagcagtaaacacccaataaaagagatttggtttaaaagtagacgctgaagtcagttatacattcagtagcctcaagcaagaaccagcagtaaaacattctgagtaaatctgaacacaattttgagaacaagagatctctaaatcactcattttttatttttttaatttaatttttgtgggtacatagtaggtgtatgtgtttatggggtacatgagatatactgatacagacataaaatgcctaataatcatatcatataaaatgaggttatccatcccctttagcatttatcttttgtgttaaaaacaatccaattatatatttttagttatttttaaaatgtgcaattcaattattattcgctatagttagcctgtcgtgctatcaaatagtaagtcttattcattctttctgactactttttttgtgcccattaaccattcccatgtcctctttattccccccacctccattcccagcatctggtaaccatctttgtactctctatcttcatgatttcaattgttttgagttttagatcctacaaataagtgagagcacatgatgtttgtctttctgtgcctggcttatttcacttaacataacaacctctagttccatccatgttgttgcaaatgaaataatctcattcttttttcttttgtggctgaatagtaccccgttgtgtataagtaccacattttcttcattcatctattgatggacacttaggttgctttcaaatcttggctattccaaacagtgctgcaacaaacatcggagtgcagatgtcactttgacatactgatttcttttgggtgtataccaagcagtgggattgttggatcatatggtagctcagtttttagtttttttgaggaacctccaaactgttctccgtagtggctgtactaatttacatttccaccaacagtgtatgagggtccccttttctccctatccttgccggcattcgttatctcctgtcttttggatataagccgttttaacaggggtgagatgatatctcattgtagttttgacttggatttctctgatgagcaatgatgttgagcacctattcatacgcctgttagaaagtcaatttctaaatggaatgattggcatgggcctggcttccttgttaacatgctcatggtgtttactggcagaaagattatgaagagtccctattaaacaaaacaaaacaaaacagtgaaaacaaaaatcccctaatcactcaggatactcctggcctgtcttgataacctattatgtatgaacctggagtttatgtatttataaagtatggctgtctggagagtgagaaaagtcactatcttctatctgttgaattaaatagaaaccaggagagccccaaaactaaatcagctttctttaagaacagcatgtccacacccttttcagactcactatatgttaatcaaaaacaaagcaagtcctgttacagaagataagatattagaagccacgtcttctgcaactcatacttttccagaaaggaatgttaattttctgcatgatattgcttctaccttttaaatcactggtaaaaattcatattggggaatatgtacaattaaagtgattctgttttcacctttagtgttcaaacaagttggaaggtagctgtaacggcccccaaacagaagcacccctgaatcctgagaagcaaatggaagtgctccctggaggaaagatcctgaatctatattcagaaattctatatagacctcagaaattctaaaagttaacatgaactatatatgaaataacaatcaaacatcatcattcataaaggaaaatgttacaacaaatagtaaaagatcaaagagaaaaaatattagatttgtaccctgaaaactaaaataatataatttgtagatacggaatataacataactatgtatgaaatgtttgaagaaaatagtaatttaataaaaataaacaagaactaagacattatccaaattgaccaaagagatttgaaaaataatcaaatataacttttaaaatgaaatatgtttactgaaatatttaaagagtagaatagacattgttgaagcagaagagaacggaaataatagtgaaagaacaaatatttaaagatgcagtggctgagaattctccaaaactcataagaattatgattccacagatattgtaggtacgtatatactgagcaacatgaataataatgaaatccacagttagacacattatagtgaaactgtagaacatatattacagagatgttaaaaacagtaagaaggctgggcacggtggctcacgcctgtaatcccagcactttgggaggttgaggcaggtggatcgcctgaagtcaggaattcaagaacagcctgaccaaaatggtgaaaccccatctctactaaaactacagaaattagctgggtgtgatggcatgtgcttgtagtcccagctactcggttggctgaggcagaagaattgcttgaaccagggaggcagaggttgcagtcagccgatgtagtaccactgcactccaccctcagcgacagagcgacaccccatctcaaaacaaacaaaacagggagaaaaatccaggcgtggtggctcacacctgtaatgacagcactctgggggggtgaggagagtgtatcaccttagcccaggagtttgagaccagcctgtgcaacatggcacaatcctgtctctacaaaaaatacaaagatagcagggcatggtggcatgtgcctatagtcctagctactgggggcgctcaggtgggagagccgtttgagccagggaggtcgagtttccagcaagctgtgatcatgctgctgcactccagcctgggcaagagggcaagatcctgtctcaaaataaaaaaaagaaaaagaaagaaagaaaagagagaaaacaaaagcagtgagaaaagacaaagctgcctacacaataatgacaagtaaactattcagcagcaaccaaagaaaccacacaacttggtgataaagtcctcaaagtgatgaacaaaaaaatagctgtcaacttagaattgtgtcttcagaaaaataatctgtcaaaaatgttatttacaaaattgtaaataagcaaaactgagagtttacaaccaataattataccctcaaggaaggattaaaatttttatctcaggcaaaaataatcctaacaggaacgttttaagatgcagtaagaaatgcttagcaagatattggtgaattgactatccagccaaatacgcatcactgcacataataataacatttttgtagttaataacgtagatatctctagaaagtttggtgagtaataaagagataagacaaaaaatatattaagaatgagaaaaacggcacaactccaagtgtaatagagaattgaaagaagataccatgaatacatttggcaatgaaattgaaaatgttgcaaaaagtcctccaaaagtaaaattttccaaaactgattcaagaggaaattaaagcttaactagaactttgaacattaaaaaattaatcattaacttaaaacatttctacagagaaaatactaatccatttttattgtaaatcaattccatcaaacttgcaaggaaaagatcactaggaaaatgtgtatctacattaaaaaattaagtttatattcaaatataatctctgataactttgagaattaaatgtaaaagtcaaaactataaaacatttagataaaacatatagaaatatctttatgatcttgaactagggaaaactaagatgtttcactgtaatatattcacatattcagttgcattcatattaataactcttatttaaaattcagcataaaaatgtacatactaaaatctgaggaaaaagatctggacatatataactgacaagtgattagtaatcaaaatatataaaggacttctacaaattaaaatatgtgtaagtatgtatatattttatgaaatagtcaatgcatattaataggtatttacctaagggaaaacccatggtaaaacataaatatgctcaaacctaataaatagaaagattcaaagtaagtccatattttataccatttgatgtctaataagtagtcaaaaatgttgaaatttcataatatcaagtattagagaggtgtgggttaagaattcataaacagttgcttgtaaaaacatttgggaaaaccatataccatgagacatataaaagactgttcttagcaggatcggttgtcttaacaaaaatactagtaatgacgctagtgggtatcaatagaaacatggattaaaaaaatacagtacattcagaaaatgaaatatgttaatatgttacagcagtgaaaactaatgaatccaaatgcacgcaatagcatgaagaacccttaaacatagcattgagtgcaagcaagttgcaacctacttcatttttctaaaattcaaatgtaaacaatatattttgtgataagcatatgtgaggaaacttcttttttttaaaaaaggatctataagcgcttatctcaaaatattaggagaggggcaggaggaatataaaagataggaagaaacgagaatacaaaagaccgattatactagtcaggttctgtttcttaaatactgtggctggttcattggtattcattaagttttccataactcaggattatgttacatacatgattttgatgataatattatataattattgtgtggttaaaacattaaatattttatttctttatgttcatgtgagttggacatgcatctgcactttctctcatcctgctttccctaaggcagtcaataacataactgccaagatttccaccgtggttttgaccaatgatgtggtctctgctaatgagacctgagggagaataattcataaagattggcagagatggtaattttttgtaaatgtgaactgagatttataagtcctttaaaactattatttcagcagtaaggaagtgttacataatcattaagaacatggtcaaataaattttatgggatttctagctctgtaatttactagctgaatgtcctagtgtattagtcagggttctctagagggacagaacttataggatagatgtatatatgaaggggagtttattaaggagtattgactcacacaatcacaaggtgaagtcccacaataggccatctgcaaactgagcaaggaagccagtccaagtctcaaaacctcaaaagtaggaaagctgacagtgcagcctttagtctggtctgtggccgaaggcctgaaagcccctggcaaatcactggtgtaagtacacgagtcgaaaagctgaagaacttggagtctgatgtttgagatcaggaagcgtccagcacaggagaaagatgaaactgaaagactaagcaagtgtagttcttccagcttcttccgcctacttcactctagcctagccatgctggtagctcattagttgatgtccacctagattgagggtgggtctgcctctcccagtccactcactcaaatgttaatctcctttggcaacaccctcacagacacacccaggaacaatactttgcatccttcaatccagtcaagttgacactcagtattaaccatcacacctagggagtgttatttatttcctaattctcggttatctcctgttcacaatagcttctacatcataaggctacttttagaactaaaagaggtaatacgtatatagcactgaacacagtccctggcacatatttatgctcattatatgttacgaatcattatcatcgttccatgcacttatctgtcatataagaggtagatgcttactcttctattttcctgaattgctaaggagaagggatgtacagccacagtgcaagcaagttgcaacccacctcacttttacaaaattcaaatgtaaagaatatatattttatgataagcatatgtgacctgaaatgttttcatttttctttgcaattaatactacttgacaaagttgaaatgttgatactactctaacaatatgttaacttagatgactgaaaagagcacagagactcagatgttaaactgtgattgacagtcaactgacaacaggaagtgcctaataagcctatggtactagtgacaacatggcagggtaccatcggggaaacatctggggcatcaagaaagagagctgaaacaggcttatttttatttctaagatcagaaagcctgaagctgaatcacatttgttaggcattgattcattcttggtagtgagctgtcagcaatgggcaacatcccaggaaagaaaacctctgtggcaataacagagagataaagaaaggaaatattaacaggacattatcctcagtgctctcaaaaaatcaaaatcctgagaggtgaggaattacggaacagttgagcttacatactctagtgtaagctggacctgagtttgacacattactgcgtgacgcagggcaaatttaatttctctaagtttacattatgtcatttactaaatgaggaaaatgctcacagttttgagttgtcaagaggaagaattcgtataaaatgcttaacattgtcattagcaaaagggagggttcagttatttaattttcattattgccatcacttaccatcatcatcatcatcataatcatgattaactgacatccgtagaattttacaagtatagagagcaggcaaaatgaaatttgttatccagcaacgatccttattatttaacaaattgagagaataaatagatattgtctaaaatgtcatacaaacatacatatatgggcattgtcataacctgcatatattacatttcctaaaataagaaagactggatgttgtcagcatgggcttatgtcacattctggttcctttctccagagcaggtgtgtgtgtgtgtgtgtgtgtgtgtgtgtgtgtgtgtgtgtgtgtgtgtgtgtgtgtgtgtgtgtatatatatctctccatcatatatatgaaatgtgataattatgagaaagtaaaatacagtattctataaatagtgacacataaaatagattatatagtcctctgtaccattaaaaaaaagtccaacaagctcaaaacattatgtgttatgttgaaaaattccactagacattcttttttttttttttttttcttttgagattgagtttcactcttgttgcccaggctggagtgcagtggtgcaatcttggcttactacatcctctgcctcctgggttcgagcgattctcctgcctcagcctcccgagtagctgggattacaggtgcccactgccacgtccagctaatttttaaaatatttttaatagatactgggtttcaccatcttggccagctgggcaggctggtctcgatctcctgacctcaggtgatctgcctgccttggtctcccagagtgctgggattagaagcatgagccaccatgcctggtctagacattcttatacttccaaaatactattgaggtgtttttgctacagaaaataacttatctaaaaattatttttaaaaattatattctacatactgatttattttatcttcacctcgataagatcacctttttcattgtcacaaaaaggactacaattagagatcttagttaatcacatatgttttctcatagtgcttatttgtcatggaccaaataaattattactcatggacaggaaatcagaaacttatgttgggtttcccctcaatgggcaatatatttgacatgaagaattgaataaaaaagcaataaagtggaagaatgtatgaaagttctcagaaacaacaacaacattccacagtggtgggatatgtcaacaggagccaattgaaagagctcacaatggcagaagctagaacaatgagaaacaaaagaaagtaatattgaattataacacaaaatataaaatatctatgaatcatactgaagtatatatatctcagtatataaagaaatatattccttctctctcttccttatatatatatatcagtatcaattcatagatacttattttatattttgtgtaatattggattatatataagatatattcaatgttgaatatgtacatatgtattcaataatgtaagtctatatacatatatgactgaaacatacatgtatgtatacatacatatatgattgaaatagacatgtgtgtgtgtatatatacatatatgattgaaagaattactaaaaggagagaatagacaaatttcccattcagagttccaaataatttttgaagatactccgccctcatggagacaaaaaccaaaccacccactgcttaagtgtggcatgtacttagagatttccttccaaagaatcagcacggaaaaagggaaaaggaataattttatagaggggaagcctggcaaacacaatctcgactaagggataaaaatcaacatcaacatgtcatggtgataatatgaatcctggataagctgtgtttgaaatggcactttacctctgtgatctttctctctcaaaccaatatccccagtaagataatgggggaaaaaaatcagaccattgccaattgagggacattttgcaaaataactgaccaaaactgcaaataaaagggaagtatgagaaactgtcacaaccaagagaagctgaaaaagacatgacaacaatgtaatatggtcttctggatgggatttgaacagaccagaaaaaatacattaggtcaaaacttaggaaatctgaataaattgtatactttagttaataacaatatataaaattggttgattattgtgacaagtctgccatatttatgtaagataagggaatctggatgtgggtatatggggactttctttactagcttctcaatttctcttacagtctcaaaccattctaaaatgaaaagtttattttttattattttttgatgtcccaatatctttttattattattattatattttaagttctggggcactagttcagaacgtgcagatttgttacataggtatacacgtgccatggtggtttgctgcacccatcaacccatcatctacattaggtatttctcctaatgctatgcctcccctaggcccccaccccccaacaggcccaggtatgtaatgttcccctctctgtgtccatgtgttctcattgctcaactcccacttatgagtgagaacaggcagtgtttggttttctgttcttgtgttagtttgctgagaatgatggtttccagcttcattcatgtccctgcaaaggacatgaactcatccttttttatggctgcgtggtattccttggtgtttatgtgccacattttcttaatccagtctatcattgatgggcatttgggttggttcgaagtctttgctattgtgaatagtgctgcaataaacatacatgtgcatatgtctttttagtacaatgatttataatcctctgggtatatacccagtaatgggattgctgggtcaagtggtatttctagttctagatccttgaggaatcaccacactgtcttccacaatggttgaactaatttacactcccaacaacagtgtaaaagcatttctatctctccacatcctctccagcatctgtcgtttcctgactttttaatgatcgtcattctaactggcctgagatggtatctaatagtggttttgatttgcatttctctaatgtaatgatgagcttttcttcgtatgtttgttggccacataaatatcttctcttgacaagtatctgttcatatccttcgcccactttttgatggggttgtttgctttttttctcgtaaatttgttaagttctttgtaaattctggatattagccctttgtcagaaggatagattgcaaaaattttctttcattctgtaggttgcctgttcactctaatgacagtttcttttgctctgcagaagctctttagtttaattagatcccgtttgtcaattttggcttttgttgccattgcttttggtgttttagtcatgaagtctttgcccatacctatgtcctgaatggtatcacctaggttttcttgaaggatttttatggttttaggtcttacatttaagtctttaatccatcgtgagttaatttttgtataaggtgtaaggaaggggtccagtttcagttttctgcatatggctagccagttttcccaacacattttttaaaatagggaatcctttccccattgcttgtttttgtcaggtttgtcaaagatcaaatggttttagatgtgcagtgttgtttctgaggcctctgttccgttccattggtctatatatctgtgttggtaccagtaccatgctgtttttgttactgtagccttgtagtatagtttaaagtcaggtagccttgaggcctccagctttgttctttttgcttaggattgccttggctatgtgggctcttttttggttccatatgaagtttaaagtagttttttctaattctgtgaagaaagtcaatggtagcctgatggggacagcattgaatctataaataagtttgggcagtatggccattttcacgatattgattcttcctatccatgagcatgaaatgaagcaatataactcctaaatatattgcatgagcattaagtgctctatttggaggaagaatagaatcttttcagctgggagtctcagcaaatgtttccaggaaagattgaggactgagatcaacactgaaatataaaaattaaccactccacaggaatttttcatttagtaggaaaattccagaacatgaaaatgcctttacatcaaaaaggtccacttttaaattttacagtggcatctccaatatgaacaaagaatatcagtgtcattttcttccccaactatgtatcaagacactcttataacaccctaaaaaagcacatgttcttatttgtcattactatcatttaaataaatctgattattattttgagcaaataataggtggacaacttggactaccacatcatgaaagatttttaaatttgttatctgctctcttgctaaaccttaagaaactttagaaaaaaaagtttgcgttcagatagtaattcaataatgtattaatttattagacaaatgtttgttgagcacccactaaatggcagacaggatttcagacacagaaagcacaataatacctaaagcactgcagtctctcacaagctgatgcctctgtgttcatggcaaggatactgcaggaaggatgtagtgagttgtgggcaaagaaaaaaaatcagatcctttttgatttctatttaggttgaatttgattgtctccaattcaatgataatatggtaacatatgttctgataataaaattagcaccattctatccattccttcacattaagctaaccaacatcacattgtctttatctatctatatatgtgtgtatatattaacataagcatatttatatattttgtcatatatttggctagagcaaataatatatagtttttaaaaaattatctggctttgcatagtttaatcatttggggctaaggatcaagagagagagtgagagatagcatttctctttgttttctgatgtttgtgcagctgttgccactgccttgccagggttttttttttccaaaagggagctactggtatccttaatgccagctggtggcattcttttattaagcaagatgaaaataaaattatctcttcctgctgttgctatagtgactgctgtacttaccatctcccgttcccacctagtaggtggtatataggtttttctggagccaaatatattgctcatggtggcatagttcacatttcaacctggtgcttcatttgtccacagactgttccttgtttatgatgcaaatgatctttctcgtcctcactttctaagaagcaaggtttaagttcaatactattaatctctgttaaatgtaaaggcttataaagacaccagagtcctaaatgtgatgtgaatagttctggataaccaaaacctaaataaacaactggagagtttcaaattttataggtttttttttcacaagctatttttgtttaccacctgcaaaaatctaactacaactgaaaaaaaaaaattcccagtatattatgacaggtaccagcagcaaaaaaaaaaaaaaccaaaaaacaaaaaacaaaaacaaaaacaaaaaaaacaaaaccaagcaaaacaaacaaacaaaaaaaccatgaattcacagcagttagatcaataaattttgagaactaaatatttataaacagacaaaaatagggaaatgacttttggttagctgttccttggaaagttttttcaccttactaataaaatatcaatgattatgcagaaaaacaagtgctagctatgataattttgaaatccaaagtcaaattggagaggatttatataaaatgtaagttacgtggttttggatttagaaacatctaaattttaccttatgaagaagattagctctgcttactgaaaaaacataggaagacatattgtccttcctcatggcataccatcaccatcagtgctactgcccaaagtcaccagagtatttttcttgacatgccccaagcatttacaataatttgtagttagcacttcctataaatatataaggcagaaatcaggtaggcctagaaaaggcacatcgcatttgaattatataaccccagtggataaagtgctaaaggtagggcataaggatattaagaaccttggtagcatcagataatagaattgtgatttttgctgctccccatcagttcagtgtcagtactaggcatccaagaggggacaatgtctcaccttagtccagcagagctgtcctagataaatgtctgctagacctgggaatttgaaaagggctagtcaatattgacattccctatagttagttaccatagaagaagacttgatctgtacagtaagtgaaatgaaaacttctcataccctatctggtggcaaatgtcaaatgaagagatatctcctcaagagacagttaagaggtttcagttcaagatggctggctagacccagatagtgccatgcctttctcatggaaaggaaacaaaataacaagtgaatactaacacttcaagtggattatctaagagatcactttgtgattcaccagggaagtgacaggacccacatagagcagagaggaatgaagccatgaagctgaacattaacccacccagaactggtatggagccgaggaaagctccctaagttgggaaagtgagtgggggaagagtgagtgagtaagagtctcccctggggatcacacttctgccatggacttttgtagttcagctcttgactccctcgggcttccagaacagcagagagctatgtggagtctgtgcagaggcactgctcaagcccacatggaaccaaccccacaagcttttggttttctagcagcccggttccagcagccactgccccactgagaaaggagacacagcatttttccgtgtccctagaatagatggcgcatccatagtactaagaagcagctagactccatactgcgtaagtccttgcctctgcagctccttagtaggtgggactcactggcttgggtccccagcacagcctccctgaatttcctgaacactgcagtcatggctctgtttctctgagtgcataactcccagaggtagctaacaggcccttcactatcactgctgccttcactcctcctgtccccaagccagggagggaacaaggaggtggggcacatttgtggacctccagtatggatgtcatagctgacatatggaggaatagtggtaggcttgtgccccacaagtccctgccttcactgctctctgccaaacagggcttgctgcctttcggcccataacacacttactcatcccctggctgatcactgcggtcatggctctgtgttctgagtacataccttccagaagtagctgataggccctctgtgatcacagctgctgctgtctctgcacatgctgctcccagattgagagagactgaagagatgggtcactttcatgtacctccagcatgggactccatagctgagatacagaggagtagcaggcacgtgatgtaccccacaacttcccacctctgttgttccctgccaaacagaactcactgacttccaatctccaatgcagcctttccacccctgcctgatccctacaatcatgggttattcctctaagagcccagtttcctgaggccagcaacaaatattcacaattgttgcttccattgattctgcccctaccacccccaggccagttcaggagcaagaaggcttctcacctttgcatgcttcaaacaatgaaatttagaactccttgtgtgggagggaggttcaagcacacaacatgccccatagctgtcagctgccactgtcccagctgagggttcctgctcttccaatgaagggcccacgtcacagctgccctgccccagcctgaatatttaagctttgacccagagccctgttaaaaacataaaccccacaggcctctgatattcccttgggatcccaccacctaagcattctgcctgccctgacctgaaagttctgccagtgacccgggtaccagcccatccctccccatcatagcgagcatctgaactagactagaccaagtggaagaaagaacttcaatgcgtaaaaactgttcttttgaactagcccagtcagttgcaaataaagaaaaaaatttaaaaaacaaaacctttgagaaataagagattatgtaatgtaactaaacctacaagttattggaattcctaagagagaaaaagaaaaagtaaacaacctggaaaacatttgagaggataaataattaaaaaatattgctagaggtagatattcggatatgaggaaaccagagaacacctatgagataatatacaagataaacattactgaggcatttggttactagactatccaaggttggtgctaaagaaaaaatgttaaaggcggctagagaaaaggttcaaatcatctacaaaggaaaaccaatcagactaacagtggacttctcagcagagaccttacaagccaaaagaggttggtgttgtatttttagcctcctttaaaaaaaaaatgtcagctaagaattttatattactacaaactaagcttcataaatgaaggagaaatactctttcccagacaagcaattactgagacaatttgtcaccactagaccagtcctacaagaaatgctcaaaggaattctaaatgtggaaactaaaggatgatacttggcatcagaaaatgacagatatatacagaactcacagaccctataaagcaactgcgtaattaaaactccaaaacaactagctaacaacactatgtcaggaataaaaacttacatatcaatattaatcttgaatctaaatgacctacataccccacttaaaacatgtagtggcaaattggataaataaataagatctaatgatctgctgtcttcaggagacctatctcacatgtaatgacatccataggctcaaagtaaatggttggagaaatatctgtcacacaaattgaaaacaagaaaaagcaggttgaacaacagcatcaagtcagaaatcaaaataaaaagtttaatgaaaatagcaacataacatacaaaacctcctgaatacagtgaaggcattgctaagaggaaattttatagcattaaatgcctacataaaaaatagaaaaatcttcagctggaaatgtaatgctgcatctcaaagaataagaaaaacaagaacaaatcaaacctaaatgtagcagaagaaaaaatactagagcagaactaaatgagtttgaggccaaaaaatgatacaaaggatcaatgaaataaaaggttggttctttgaaaggataaaggaaattgatagaatgctagctagcctaaggaaaaaaaagagagaagattcaaataagtacaattggaaatgattaaggtgacatcacaactgataccagaaaaacaaaaaaagatcatcagagactagtatgatcaccttgatgtacacaaactagaaaacctgaagacgtaagataaatagcatagttcctgcttcaataagctcacttattcattcactcaatcactgcttctttcaacaaatataaattaaatgcctattatattctagacacaggcactgatgatacagcagtgagaaacaatgaatttgccttttgaagaacactaattgttttcattcattttgttatttaaagaatattcctagaaattatgtattttcattgtgtggtgactaccgtgatttttttttcattttacaatttctgctttatgaaatcttactactttttatctttattctaatgattctctgagtttagcagatatagaaacataacattcccaagtaatgttaaatttatatctcttttaaacaattttatatcctgtatttttctcatttcacctattctactgaattacttagaatttcaagatcaacgtaaagttgcttctttagtggaaatgcctctaatgtttctctattaagtataatatttgtttcaagttagatagaattaatgaaactaagctgttgagatcttaatttggttctcagcttgaacattattagcgtatggaagtgctactgacttttgtatgttgatttttgtatcctgagactttactgaagtcactaatcaggtctaggaatcttctagaagagtctttagggttttctaggtaaacaatcatatcttcagtgaacagagataatttgacatcctttttcccaatttggatgccttttatttctttctcttacgtgatagctctgtttgggacttccagtattatattgaatagaattagttaaagtagccatccttgtcttttcccagttcttagtgaaaatggtttcaacttttccctgttcaatctgatgttgcctgtagtttgtcatgcatggctcttattattttgaagtatgttccatctatgctagtttgttgagggtatttattatgaagagatgttggattttatccagtactgttttttgcatctattgagatgatcatatagttttcattcttatatctgtttatgtggtggatcatgtttattgatttatgtatattgagccatccttgcatcccttgagcgaagcacatttgatcatggcaaattatctttatgatgtattgttggattcagtttgctagtgttttgttgaggagttttgcattgatgttaatcagaaatattgacctataattccttttttattgtcattttgtccttccctgattttggtatcatggtgatacaggatttgtagagtgagttaggaagacattccttctccttgattttttggaatagttttagtaaggttggtaccggcttttctttgtacatctggtaaaatttggctttgaattcatgtggtactaggctttctttttgttaggagattttttcttattactgattcaatttcattactcattgttggtctattcagggtttctatttcttcctagttcaatcctggaagtttgtatgtttacaggactttatccatttcctctaggtgttctagcttgcgttcataaaggtcatcatactagtctctgtatcggttgtgatgtcatcttgatcatttctgattctacttatttgagtcttctctctttttttttcttagcccaactagcgttctatgaattttctttatcctttcaaagaaccaaacttttacttcattaattctttttatctttttttttttggcctcaacctcatttagttctgctgtaatatttgttacttttttctgctacctttcatttgttcttgtttttctagttctttgagatgcaccactaggtttctaattaaaaatcttatattttttgtgtttactgatttatgtatattgagccatccttgcatctctggaaaaaaaacacatttgatcatggtggattatctttttgatgtatttctggattcagtttgatagtattttgttgaagatttaatgctataaactttaatgctataaacattcctcttaccattgcctttgctgtatcccagaggtttttgtatgttacatttctactttcattcattaattttttttttatttctgacttgatgttgttgtttaacatgatcttttttgttttcaatttatgtaatagatatttctacaaccctttactttgaacctatggatgtcattacatgcaatgtgggtatcttgaagaggtcaaatgattagatcttatttatttatccaatttgccactatatgttttaagtggggtatttaggttatttacattcaagattgatattgatacatgatgttttgttcctgacatagtgttgttagctagttgttttggagtttcaaataatttatttacatcttaatactccctttttttcatcactctgtttcccagctagcctcatacatgtctctaaagctttatatgttactatatctttatggtcaaaagatctctacagtgattcagaatgtcggctctggcatcagacatcctacttggaattttgcctctattatttactaattgtgtaacattgggcaaggtacatagcttctctgagcttcagtttctcacaaaagtgtctaactaaaaggatattttaataagaaatgaattaaaacacacatatataaatattcattgtatagtgtgtggcaggtagtgagtattcagtaaatggtagctatcatcatcaccatcttgtctccattgtcaatactttttaaatgttttgggtgagatgacattagaactataaactggtaagattttctgagaacttcttttggtcatacattttctattttttttttcttgaaatggagtctcactttgttggtcaggctggagtgcagcggcacgatcttggctcactgccacctctgcctactgggttcaaatggttctcccacctcagtctctcaagtagctaggattacaggtgtgcaccaccatgccctgctaattttttgtgtatttttaatagaggtgggtttcaccatggtgaccaggctagtctcgaactcctgacctcaagtgacctgcccactttggcctcccaaagtgctgtgattacaggcacgagccaccatgcctgacctggtcatacattttctattcatgagcatagaatggtttatttttttctaaatctaaattcagctcaccactgagatttattcattcaggaatatctattaagtacctaatatggtgcttggcacatatgcatgcaattaatattagtttaataaaggaaaaagctgtgaattaaaaaagaaaactgaactgttatttggtatacatggtgctagatgctggatacaaggatacatatgctacctttttatgttatttaataatggctgtcatttattaagggttcagtgtaagttaaggtctgtttttggataaaatgcaagcgttatcccctgacaatcattttgaggtaggtattgttattcctgttacacaagtaaggaaattgaggtttatctaaggttacatggttaataagtggaagagatgtaattcaaatccatgtctttctgattctagaggtcaagcttttatacattgcagatgtgtaaataacttgacctcccaccacaatgacatgaactggcaatacggaaaagtcattgactttctaatagtagaagattagtaaccttttctactcctgctaattttagtgaaccagagcgtggatctactcctctgtttttgtacagcccgcaagctaaggagtttttttttttttttttaacatttttaaatgtttgaaaaatccgaaagaataacacttcatcacatgttaaaatcatataacagtacctacattataccctcaattttgccttttgccttgcaaagcttcaagtatttactaagtgaccctttctagaaaacatctgcctaaccttgaactagactatttgggatgcccttcagtaatgtgagtaatgcttatgccatagttgatttacagaaaaaaatgtatcactagtaaatagacatattagtcctacacagtttctggaactgttttcttacacttcagtgcaaaagagctagagcaacaacaaaacagaagcaaaaatcaaaagactactagtacattgggctgatgcttcatgtaaaaatgagattcattctctcaagaattaatttatataattaatgaaaaattccacacaaaagtaacctgttaaaaataaatgattttaaatacccttttaaatgtgcagacaataaactgaatccttccttaaacttgagtattacccaaagattattttacatactagttgagcctaaatgaagatcacaaattaaaactttctgaaataattaaaagataggaaagaaagaattgggccaaggacggggagcagatttgctttaaggcaaggcatgaagtttttagccaagatgtaagataagttgaaaattgatcactagtcaactgagttatgaaatgaaacagcttccaacgattttttaaattaaacatggtataaattattcagatagaactgttgagtttatagcttataagagaaaaaatgcaaatctatgttacttgattaaactatacaacagcaaatgagctaagggaatcaagaaagcaagcaatttacttcttcaggtacttgatcaggaggccaggactattgtgagtgctctgcaatacacgaatgaagttgaaaacaaatttggcagagcaaaacactcaagcacacatatgcgaacagcataagaattcctgtaaagggctgtttagatttttactttggttatggtataaccataaccaaaaccgtaaccatagtataatcatggttataccataaccaaactaaaaattcaaaacagtcctttacaggaattcttatgcagtttgggactggattggatttgcaaagggaaaaaaaaactatttctttatgaaaatgcagttatcaggttgaaaagcataatgttatactcacagtcaaactgtcttaaaaatctactcaccagttaattatgtttttctcattggatatgtggaaaagaaataactgtgtcatctagaggggctgttctaagtagagtctagtggaggcaaaaattgcctgaggagttgaaagaaacatagcagagggaaatttctagtagataataactgccatcacccttggtcagaggaacaccgttagctttaaaactatggtagtttccaagaaactctaaatataatttttttagagagaatattttcaaactattcatctgacaaaggattaatatccagaatatccaaggaactgaaataactcaatagcagaaaaacaaataatctgatttacaaatgggcaaatgagctgaatagatacctatcaaaacaagacatgcaaatgggcaccagataaaagtattcaacatcataatcatcagggaaattcaaatcagaccacaatgagacatcatgtcatcccagttagaatggctgttataaaaaaggcaaatataacagatgctggtgaggatgtagagaaaggggaactctttttaatgatatttttgttttcttttattgcttgcaaatattgtatatagttctatcatcatatatagataattttgtatcttatatatgctttttattatacgttaagttcttgaatacatgtacagaatgtgcaggtttgtaacataggtatacacttgctatggtggtttcctgcacccatcaactcatcatctacattaggtatttctcctaatgctatcgctcccctagcacccaacccccctccccaagcccggacaggtcccagtgtgtgatgttcccctccccgtgtccgtgtgttctcattgttcaacttccacttacgagtgagaacctgtggtgtttggttttctgttcctgtgttagtttgctgagagtgatggtttccagcttcatccatgtccctgcaaaggacatgaactcatccttttttacggctgcatagtattccatggggtatatgtgccacattttctgtatccagtctatcattgatgggcatttgagctagttccaagtctttgctactgtgaatagtgctgcagtaaacatacatgtacatgtgtctttatagtagaatgatatataatccttttggtatatacccagtaatgcgattgctgggtcaaatggtatttctggttctagatccctcaggaattgccacactgtcttccacaatggttgaactaatttacactcccaccaacagtgtaaaagcattccaatttctccacatcctctgtagcacctgttgtttcctgaccttttagtgattgccattctaaatggcatgagatggtatctctttgtggttttgatttgcgtttctctaatgaccagcaatgatgagattttcttcatatgtttgtcggctgcataaatgtcttcttttgcaaagtgtctgtgcatatccttcacccactttttgatgggtttgtctgttcttttcttgtaaattagtttaagttctttgtagattcttgatgttggccctttatcagacagatagattgcaaaaatatccctttctgtaggttgtctgttcagtctgatgatagtttcttttgctgtgcagaagctctttagtttaattagatctcatttgtcaattttggcttttgttgtcattgcttttggtgttttagtcatgaagtctttgcccatgcctatgtcccgaatggtattgcctaggttttcttcaagggtttttgtggttttaggtcttacgtttaagtctttaatccaacttgagttaatttttgtataaggtgtaaggaaggggtccagtttcagttttctgcatatggctagccagttttgcaaatagcgtttattaaatagaaaattctttccccatggcttgtttttgtcaggtttctcaaagaccagatggttgtagatgtgtggcattataattgaggcctctgttgtgttccactggtctatatatccgttttggtaccagtaccatgctgttttggttactgtagccttgtagtatagtttaaagtagggtagcatgatgcctccagctttgttcttttttcttaggattgtctttgctgtacgggctcttttttggttccatatgaaatttaaagtaattttttctaaatgtgtgaagaaagttaatggtatcttgatggggatatcattgaatctacacattactttgggcactatggccattttcatgatattgattcttcctatccatgagcatggacgccttttccatttgtttgtgtcctctgttatttccttgagcagtagtttgcagttttccttgaaacggtccttcacatcccttgtgagatatgttcctaggtattttattctctttgtagcaatcgtgaatggaagttcactcatcatttggctctctgtttgtctgttattggtgtataggaatgcttgtgatttttgcacattgattttgtatcctgagagtttgctgaagttgcttattaaggagattttgggctgagacgatagggtttgctatatatacagtcgtgtctcctgcaaacagagacaatttgacttcctctctgcctattcgaatgctctttatttcttcctcatgcctgattgccctctctagaacttccaatatcatgttgaataggagtggtgagagagggcatccttgtcttgtgccggttttcaaagggaatgcttccaccttttgcccattcagtatgatactggctgtgggtttttcataaatagctcttattattttgagataagttccatcagtacctagcttattgagagtttttagcatgaaggggtggggtgttgaattttgttgaaggtcgtttttgcatctattgaggtaatcatgtggtttttgtcactagttctgtttatgtgatggattatgtttattgatttgcatatgttgaaccagccttgaataccagggatgaagctgatctgataagctggtggtggataagctttttgatgtgctgctggatttggtttgccaatgttttattgaggatttccacattgatgttcattaggaatattgggctgaaatttctttttttgttgtgtctctaccaggttttggtatcaggatgatgctgccctcataaaatgagttagagaggagtccctcttttctactttttggaatagtttcagaaggaatggtaccagctcctctttgtaccactggtagaattcggctgtgaatccatctgatcctgggcttttttttggttggtaggctattaattactgcctcaatttcagagtttgttactggtctattcagaggtttgacttctttcttctttagtcttggaagggtgtatatgtccagattttctagtttatttgcatagaggtgtttatagtattctctgatggtagtttgtatttctgtgggatcagtggtgatatccactttgccattttttattgtgtctatttgattcttctctcttttcttctttattaatctggctagtggtctattttgttaatcttttcaaaaaaacagctcctagattcattgaggtttttgaagggttttttgtgtctgtatctccttcagttctgttctgatgttagttatttcttgtcttctgctagcttttgaatttgtttgcttttgcttctctagttcttttaattgtgatgttagagtgtcaactttagatctttccagctttctcctgtgggcatttagtgatattgatagaaataaatttgatttttaacattaggcagagtatccttgaattcatacaatatagaagagtaggcatttaggtatagtgctacttatgctacagctcttcaaactgcagagcaccgtcaggaggttggggtgggtatttttacattatagtcttttctatattcttcaaataaggaacaaaactatgttgtccagttgcctattattttccaaaaagtgtatcctggaatcttagaataatcccctttattgttacgtcttgtaatacaaagattggggctgtatacatatattattaaaaatatttttactttatttaaaaatatatcttttattatatgtcaaacactataaaaggctttaaaatgtaattaattatgatgtgaatataaagtcttctaatgtataatttaatagatatatatgacacattttctcaactgtaatggaagaatattcatttcagcaacttttttctatgttaggtttctgagataaatcatgctaaaattacagaaagttgtaaagttgtaaataagtgggatgaatttttatactgataacattgttttgctcttagagtatcaaatcaattatcaaaatataacatattttacttgctattcattgtaataatgggtattaggaaaattctttcataaatgtgaacctacccattgaactaagttcgaaattataggtaatataaaattacacgttgaaaattgttctgaactgacagtcataggctgtgagttaaaatcatgaagtttttagcatctagagatgtagtcccagtgtgaaaaactatcttgcttcaggctaaatctggctatacaagtgtttttgtttttttacacttgcagtgtaagagcagaataggcagatagtccaatttaacaaaggctgaagttgtgccaggggaataaaatgaagggagaaaggggtaaggagtcatagtagtaggcaagaaagtaattatataaggaaatattatgaaataactgaagagggtagttaagcgtgaaagcttgagagacaatttaatacatctgcaagttataagaattgctatactaaacgattttctggttttactatgacatccttttctcatcataatggatttgtagtactcaaactctctgtgtatgttgtatttatcctttcacatttttctttttaatgcttagctttaaaatttcctaagatttttagtcaattaagactgatctgaatttggaaaaaaatgaacttagaagtaaacaaattaggattattatataattgtttatgtagatgttagaaattttatcaaatgtataaaacctctgccagagttcatagactatattcacattaaacacactgatatacaactttttcattgtagattagttatcatttgtattattcagtgttgaagtagctttttgtaacacatgaaatacaggagaaaagacctaagatcaaaaatatttttatcacattctgtggacagtttatcatttcacaaaagcatttgcaatttactgtttcacttatgatgtaattaaaagtgtctttttcaagggaagcatatgctggttttctttggtttcttttttataatccctttggaggactgattaatgtctgataatatgtaaagtgaaaatggcaagccatagcaagagattactcatctgacctgttatatataaccagagaaaaaacggggctaatgaaagtttcattacaatttgtcattatctttacagattttccttcctctttctccagctgaatcttaattcaattcttatcttcatataatggatgttagtatattttttgagatacctataattagctcaactgatattttggagagacagtttttattaaaagttaacatttcctaaaggtgatatgttgtcccattcataggtgactgataacaaatatttaaaagaattatagcattatcaaatcaaaaccacaatgagataccatctcacaccagttagaatggtgatcattaaaaaatcaggaaacaacaggtgctggagaggatgtggagaaataggaacacttttacactgttggtgggactgtaaaccacttcaaccattgtggaagtcagtgtggcgattcctcagggatctagaagtagaaataccatttgactcaaccatcccattactgggtatatacccaaaggattataaaacatgctgctctaaagacatatacacacgttatgtttattgaggcactattcacaatagcaaagacttggaaccaagccaaatgtccaacaatgatagactggattaagaaaatgtggcacatataaaccatggaatactatgcagccataaaaagtatgagttcatgtcctttgtaaggacatggatgaagctggaagccatcattctcagcaaactatcacaaggacaaaaaacgaaacatcgcatgttctcactcataggtgggaattgaacaatgagaacacatggacacaggaaggggaacatcacacaccggggcctgttgtggggtggggggagaggggagggatagcattaggagatatacctaatattaaatgacgagttactgggtgcagcacaccaacatggcacatgtatacatatgtaacaaacctgcacgttgtgcacatgtaccctaaaacttaaagtataataataataaaaaaagaattgtagcattatatcatgtggtgtaataggaaagtatttaatcaaataattttattgattaaaaacattgtaaaccaagagtatcataatagctctagatttttaaatgctaatttcaaagctgaattagtcactttgaaaactcaaatcttttctgctgtgagttcttattcttgttacctaattttagtgaatgtcagtgtcctaatcataaatggacataataagccctcccatatctgtttacaagttgatcacagacccacaagtttacatttgccaataaaataccaaaaaccttcatttttctatggcttttctgtcaaggtaccattcaacactcacatttttattttaagaactattattaagaatcttatttgctctagagtgtgttatggtagccattctgtgcagacaaatgactatgtattagagaatgctaatttaatttttttctcaaaacatgtgtaagaactgctttttctattcttcctcagaaactggtctttaataagatgtccttattgaagattattttaaaattcctaaaattagtgtggtttaacttccaaacattgaattgcttttgtcctggtatagtttttaaaactttagaatcaatcacattgactttgatttgccaactctattaaatatatgactgcagtgaattttttacttgcttttcacatagaaaaacaggaattagtatctacttccaggaagcctggcatagagtaggtatgttagtagctagtgtaactattttcattcatttccttttctctcttttctcttttctaaacatttagaaggtcaaaaatagtttgtgaatgaagtttgactaatttttattatagggtatttgcatggaatgcaaaaaaatttacagtgacctgaataatcctgatgatagtaacaggaacaatgaatacagccaatggaagacttcaatatgcaatcactttgcaagtgaggcagcaaataccaagtcagtattacaaaacttgtccgttgtttttacagaagtcatagaaattaaagttgaaggcctctcatgttgagaagccagctcagttccttaatctttcatataatatatatgacactcaaatgtaattaatgaaactttataaaatttgtctctgacacttagtctaatataatttgccttttcaatggtctttttgtaaaaagtcaaaatctcaattttataaaaaattttaaaatttgcattaaatcgtatctgtgttcacagcacttttagagaattaattgagaatccttggagcactgatagtctaaaactcattagggccacctacaggataaatgtatagccacgaatacctcagtattggcactccattcctcttcctttttccaaacacacctcctataagctcaacattgccacttattcagaacagacttaagactgggaaacataagtccaggagacaaatcaaccacagcgttttacttctaattgtatagcttttattctcctgtcttgagccttttcctcactcctccccaataactaaaccaagctattatatttaacatacgtaagatacaagatcagtgtccagaatctcttatgtactatctcttttgatagtttcaggtactctatttccctccaacactttaaaataatgctttttagggaataatttttgaaatatttttcaggtgtttgtgtgtgggtacatatagctcacattctacctactcaacatgtctcaggaggttaaaaaaaaaaaaaagaaaaataactttctgagtagtttgccaagtttctctgccaactctattaccacgtgttatctttatgaagtctatgaagtctttcaggagaaatccccttaggattgggtatatctctaccttgttttggctcctcttaagtttagagtcaaatttgtagccaacttccaataatttacaacaatatatagtgtatattcctaaatacttgttttgccctgcagccttctcaccatgcttattttgtcttcacctagaattcctcaactattgttttatttgtttacttattattattgaggcagatacatattttaagctacctcaaatactttgtggaacaatacagggatgaaaagagtaactgaagaatgtcaagaaggaaggaagacaaggcaaaaaggaagaggaagaggaaggaagggagggaaagggaagaaaaaaggaaggaaataaaggaaaaatctaaagtctgtgtgtatgtgtgttcatgtattaatagctcccatttagagaaatagtgtgaagtgctacatggtaaatgttcatggtatgtttttggtcactcatgagtgtggctgtgacaagctgagctttgaggatttgggcttatatacctatttggtgacccagactcctgtgagctatgaaaagttggcccaagtaggtatgattaattcatttatatatgtatatcctttacagtttttctgcataaccagtacctaacacagtttttaatatatagtatgcattgaataaatatttgttaaataaattcataaaatggttcattttacatctgatcaatatggctcaaatctcatatcccaagtctacactccatcatctaaagctcttaataacatctattattgtatgtttttcatagttttttttttttttcgtagttcttctaggatgaataggtgcagtaattctccaagctacagttctagttacagctcttcttttaaaccctgtgtgagcttcttaactcagaaaaagaaaggtcagagcaaagacaaagtctagggccctgtgacttttgatcacaaaatttctcatcttgtttcttaagttgagtatttgtaaatgtgccttatagtaagtccagaaagatatttatttcagtgtgtaatttgaacctgaattttagagtcttcgtattgtgatttttatttttactcccttttattcctgtaaaggtataaaatagaacacacgaacatgtatttttgaccttgtgtaattgcaataaaacaattcaagccaatatctataaaagcacttggtcttttttccatttatcttcttggtacatgtaacgtgtcatctattaaaataacatgatagacactgaacctgcacatacatccaccgaagtatttcaaagttctctgattaaatacctccaaagaaattaactcctttctcttcttagtgagagatgaacaaacagttaaattttcactcaggctattcagtctaaccaccatccccatcaaccaagaatttttttacataaaccattctgccttagatcaaccatcatcttgcttggtacagggaccacttttacattgtagataataatgtttcacttttctttatggtaggaaagagttaagtgagaaatgtacataccccatgaaagtacagacttctttttagtatttatatgtcttcaagaaagaaaaaaaaaatctactcacaatataaaaaaatctatttatctttgggcttctggtgctaaagttcccaggaaataatgacacagagacaattctatgaggaaatgttgaattttgcttgtattaaaagctggtacaaaataaagcaattggagtgaagtatcatcttttgggtcattgggatctcaaaacacaatttaggtcatagttattctataattttcttttctttgtgtgtttaatttctagggcatgcctgtacttcaattcctcagaaataggcattaatttaggactgttttctattaatcttgtaaatacaataggttgatttgaaatgtcacaaaaataagcataatataaacttgtagtaaatggattgaaatggatatttatgttttagagaccattttaaaaattcagttaaaataaattgatatcccaatgaccttccagaatttgtagattcgatgaagatgaaaagaggaaagtgaaaccacataatccctagagatattaaaatcaagcatggtggctttcccctataatcccagtactttgggaaacagaggccagaggattgcttgagaccagtgttggcaacatagcgagactctgtctctacgaagaatttgaaaaattagctgagtatattggcatgtatctgtagtcccagctactcgggaggctgagactggaggatttcttgaccccaggatttacagactgcagtgagttatgatcacatcctgcactccagcctgggcaacagagggaggaggctctcaaaatatacattaaagtcctgccacaaccactgcctaactatcttgtattgtatttctaggagtaaagtaaaaggaagtcaaattagaaatcttgccatgctttgatttcatattaagatcattttttggaaaaaaaagcctctaagaatcagtccttttgagtttaaagccatgatttgcatatatttgtttgtttgttacagacaatcatgtgtatgttgtattatctcatacatatgaaattcaaaaagagacaagcataatatttggtaatagaaatcagagcagtaaccttgtaggtacatatatttgaaaatgactgccttgatttttactgctactgaagttagtgtatatatttttaaagtaacaatcccccagaaaagtagaactagaattgctctttttcttttgtcctgctactttatgaaaagcttaactgtttataaagaaacattgaattttgtataaaatcttaaacacattctgcaataatgaatacttctctgtttctttatttggtgtcatgtcttcactacttattagacccccatgattttggatgtgtttaagaagatttggttatacattcagcaaaataattagtaaattcttacccatctcaaaaatataatgtatagaatttttcttagattgttatagactagtaatttatctccttcatatccactagtgtattttcttgagtgttcagtttatttgtcaaattaatattaaatttgaagctctaccttgtattgctacaaagcatattattttagcatgaaataattaaaatatattttaaaaatctattttacaatttgtgcctaatggaagaaatggcagaacatttctaagaagcatttcttatcatggaaacatgatttacagacccagaattctgggacagtttatttataaaaatattgaactcctaccatttgcaataaagtagtctaaaagttgtcttattgatcaacctatcccaggaaaaaggaaaggagcgtaagtactgagatataaatagtttaataagcaataatagaattacaatttaaattacacatcattcccttttggaccattttctttttaggaaaatcttttcaaattgtgtaaatgcaacatagtttaagggaaggccattgatctccaatactataatcccttttacatagaagtgaatatttcgttaactaatactcccagactaatcaaaatggatgagagtagttaattcacagagcccattctaggctttcataaaatgaaagtcacataactttcttattcacatttatagaaaaagaatgctttttctatttttactatattttgttagagcatacaagcctctctaatttggcatgctcatgcttggttttacacatcattcttagcctgacatataatgaagaagccggtgggacaccaagtcctctaaccagttctgtttctcttttcactatgagagaatgggcgttattggtagtagaaatatcactacgtaggaaatattataaaaaatgactctttgtgttaaaaatgctatactccctagcatctatactggcaacttgaatggactgtaaataaaaataaagagtgtggtttttctatgggtggtatagatttatttccattgtggtatttaaaattagatgatgtagatatatgttaaagccttcttgtcactgattaacaaacaaaagacaccttgtgaagataacgatagaaagtaagtacaagttacaatcatagcaattctttacattcttttctgccttggatctaaatgttttattatgttgacagatctgggaaattttagtggccggacaagaagtgcagtctctgtgagggaaggccagggtgtcgttctgatgtgctctcctccgccacattcaccaggtacagtaggatctcattctttgctgctgctgctgctctcttttgctatgtgttcattcttttagacagtatattgatgggagaacatttcaggtgaaatgtgcatggttttcttgacatctatcagagtgccagatgagtaattcaagatcacgtactctaaatatcattagacaggatactgaactccaataagattgttttattgccattctaactgttaactgtcactgttatgcctctgtcttccatcagtgaagaatatattgcctagagcacaaaggaagcgataaactgagagaatgaaaacttttcaaaatagtttggagtatcagagttgagttaactgaataccaatatgcgtcttgtttcaaaagataaactggatacttagttgtttatggtgctctttgccacactggaattagaacttctaagaaatgctttttttgagtttcaaacaaaactgcaatttagttagtactttttggctctttgaggtcttgtttgtaaaagtcatggtgagtactttatgtggcttgaggaagcagaaaactaagctctgctcagattaattatacgtccttttgcaagcttacacctaattatatctattttgtttgagtttcataatttgagatgagtactcctttggaacttagtatagctttactataagttaagagtgaccagcatcagttaaagagagagagaaagagaaagagcacaaggaagaaccaaggaatgaaggccttaattaacaactggtaacagaattgaaggtcttggtatgtcagtaattttttcttctttaattagagtgatggccatatttgtttctaggttatattatcagggtagtaatggagcacaatttggctctactgtacatatttttttaataacaaaatggcctacattgattttcttaagacttctttatctttatctgatcccccttctatatttttaatcgaaagtatgctgcatatcaacagggacatatttttgaaaacacttttatttgaaactcagataataattacaattagggtaattattgtttgagttgtacccctccaattgttgagttgtaccactccaattcctgtacaccagtccagttattctaatctttctgtgaaaggtttgggaagtttacattaaacatatctattcttgcctgcatctaaatccagatttaggttctttcaagacaacatctgttttaatttttttaatggataagacaaaaatttttattacatttagggaaagtgtatagcattaatataagtcatgtctcatattggttattaaacagatttcatccaagggggttattagttgaataattgttagagattgcagaaaaggggaaaagaaggggaaggagaaagagaatataacaggctttatagaggatgactgatccatcactagactgacaggagttaacaacataaagtgacccctgtgggaaaataagcaagattttctgagatatgatctttattttaaggctggggaacgtgtatttttaaacaaagtgaaatggaagaggataatatagaagtcaaaacttcgggattacacataaattatccaattggcagagaaaactgtatacagatttctggtgggagaatatagtacaatgaattgcatatatggtaagataaacataagataagaataggcactaataactgattaagtaataatgtgatctctgattgagatcaatatatgtaaattaaatgactgttcagtaatcgtgttttacatccgaactcatctgcttgaccaaggccaacttgatatgttattaccacagctgcagtctctcaattgccatatttacaagcttcttattttctgaacagcatccactgtcttctactcacccctttagtaccctgattgcaggagtcctttcatgtcatggaaatctacaaatcattgatcctaccctattttcattctactccacctcctttgattcttacttttctccttcagttattatcatattcttttatacagcttcaattttgtcatctctcttttgctttcgcacactgacattccagtttgcaaaaccctaatcacaatatagatccaactcttagcctacttcacatatgaatctattcagtttaatattactgttaaacaatcccaaaaaccaaagcacacatacaaaacaaatgaacaaaaaaccagttatacagactgctgtcaatttaaaataaaaatgatgaactttacatcttaatgttaactagaatttttttaaaaacctattatttttactatacttttgtcaaatgttttatgtgtcttccccagtctcactctcaggtgataaacatgcatcctattacgttgtgaaagagaaagcaattagaaaataacctccacaagctctcatcaccaagtcacacaccaattagcatttgtagccatacactctgacttcccagtttttagtatatattatagtatatagtacagtatatggtacagtatagcatagtgtactatagtagagtataagtcagatacaaaagaatttccttttcaaaggtttggcttattcagcatccctgttcttcgtcccctacttccaaggccacactaacttccttatcctttgttcctccctattttaatttcagtaaacaactttcccaacagtccttatttacagagcccacatttgctacccactctgtaaattacccctcccatcgcaacagcttttcctgctgaaaccgcccttcctgccagtgtaaccacattcctgcacctttcaagttagccagccaggttcagcttagattgtgcagtccaactccagccagtggaggcaggacacagtagcagggataagctgcattaaggataaaaaccccttcctgcctttgtttggtgtgctctcatgaccagacttgggagcagcattcttctgcagaagcaaattttgccttgctgagaaatcctgtctttacgtgctctttttcttgcgactccaagctttacttccaacggtatagtatagcatatgcatttgttgcagttctaagactaatctctcaacttgtgtggcgctgtagttcatctttttttgcctactttaagaaattgtttcagcagtaccccttcttctgcatttttatcagagtttgattcctcttctggagcagtccatcaacatggaaacctgctattctttcctccatataaaaataaaacaaaggaaaactccatcggccaatgccctcttcattcagctactacatgatttttggtttccctttacagtaaaacttcaaaaactttgtctttatatactctatccaattctattcctctcagtcagtctgtgtgtttctctctcttccccctatttttgtctctactctctttctaacagatttattgacatgcaatttttatcccataaaattcacgcattttaagtgtacagttcaatgagttttggtacatttatataattgtgccttcatcaccacaacttgaaagatacttccatcatttcaaaaagtcattcaatccctctcctactcatgtccctaggcaatttttgctatgctttctgtctctatagttttgacttttctagaatatttattttattttattttattttattttattttatttaagacatgtttttgccatgttactcaggctgttcttgaactcctaggcttaagtgatccgctcacctataatcccaaagtgctgggattataggcatgagccactgggtccagccagaaatttcattttaatgcaatcatacaatctgcaatctatgtatgtgcacgtctgtgggtgtttggtttcttttactgggcagaatctgagattcatctgtatcatggcatgtatcaatagtttgttgctttatattgctgagtagtatttcattttaaggacacattccattttgtttatccatttggattattttcagttctcatgtgggttatttctttctccataaaacactattttcacttagcttaaaagattcctcactcttgatattcctccactctttcttcttaatctcctttgctgatttgtctcatctcctcaaactcttaattttatagtcccccaagtgtcagtactataacttcttatctccttaataaactcacactttgttagttttcacctgataataaagctttaaatatctaaatatctaaaatctccctaacatacatctctaacccagactctggcttgtatgtatatccaactgcctatcagtatttggctaataggcacttcaatcttaaccatgtctaaatctgaactcctggttatttcttccccaaaccttctctagctacagtcttttccacctctattaatagaaatttcattctgtacatcaggcctcagagccattcttcacttctcactttctctacaccctacatacaaaccatcagtaattttactggtgtcagcccactttctggtccatagacaacttcttgctgtgtactcacatggtggaaggggccagacagctctcttgggccttacttataagtacactaatctcattcatgagagcttcactctcatgacttgatcacttaccaaaacacttgccaactaataccagcacattggcagttaggatttcaacatactacttttgaggggatataaacattcagaccatagaaggtggtatttggagatggggcttttttttagttttatatgaggccttgagggttgggcctttatgataagattaatgactttattagaagagacaccagagagctctctttctctactgaatgtgagaaaacaaagaaggtgtccatctgcaaaccagaaagaaagccctcatcagaaaccaaccatgctgtcacctaatcccagacttccagcctccataactgtgggaaaataaatttctgttgtttaagtcatccagtctgtggcacgttgttatggcaacttgagcacactcatgcaccatctcattcagcttaatatcaaagccaaagtccctaccatcgcttggagaaccctcgccatttgcctccaattgatctgtctgaactcagctactgctttccctcctactctctttcttgtagttattgtcatttccttgatgtctcaaacaaccagacaagctcctaccttaaggcctttgcagtcgctattccctaggcctggatcatgtatatcccaggtatatgaatggctcactccctcacatccatatctttctttaaatatcaccttagtaaaaccttttacaatcttcctcttttgatttctactccacaattcgtttctccatctttgctttatttttctccgtagtactcacagcattacatatactgccttaatttttctccataatgctcctagcattccatatactgcacgcatttacttacttcgttgttcatagtttgtctccttcggttacaatgcaaattctactaagacataaattctgcaggttttgttcactgttattaccccattgcctaggacagagtatgagctcaaaaatatttattgaatgaatctatgtataatattcagaaatatatgaaatgagcccaggttttaataaatatcagaaactttgatggaaaagtcataaataagaataggaaaaaaacagatcagctatgtaacaagaaaacctttcttaaaatttacctttttctcataattatattgtgaaatggtgcattaattttaatgtcttgcttatttgcttaaaagaagaactttgaaactctcttgggaaaatatagtcaaaaaagcttgctgaagaaacagaatatattagtccattttcgtattgctgtgaagaaatacctgataccgggtaatttataaagaaaaagaggtttaatggactcacagtttcacctggctggagggcctcacaattatggcagaaagtgaaggaggggcaaaggtgcgtcttacgtggtggcaggcaagagagcatgtgcaagggaactgccctttctaaagccaccagatcttgtgagacttattcaccatcatgagaacacaatgggaaaaattcacccccatgattcagttacctctcactggatccatcccacaacacgtagggattatgaaagctacaagtcaagatgagatttgagtggggacacaccaaaccaaattacagaggaagtgagaaaagaataatccagggtgaagtttctgatctgacatttattagcaatgacttcaacaactgcctttgtttgggtggaatgagattgatattatgaaattagtaaataacctgatacgtgctagaaatcttagacccaagtttctgtttcatccaaatagtcatgtagattatcatagcatacttgttcaactgatgcttgattgcattttgtttcccaatcttgttttacttccgtttttcaaatcataattagtttgttattttatctattggaacaatacaatgtaaagtgtcaggagtcaaattttattatttttatctttccaagtagattatatgttctttcagtatatgaagcttaccaccttccacttcatattcccaatacgtagcacagtgtctgatccttactaggtgttcattaaacgcatgttaaataactgagtgaaatgcagattctaacagttgagttttgcaaggttttagacagtttctgtcagccttctggtattagctcattgtatcctatattcatgacagatatttgggtcacttaatatcacattcatgtattgctatttcaaattgtagcagctactatgattcagtggaagctgtatgaaatgataaaacagtttacacatcagagaatattaaaaattattcagaaacagcccacagatccattttcttattacctcaaatagatgtgcaatgcccatttttcttcaaataaaagcaaaagcttgaattgacttgatagctaaatttctcagttttcttcccaagagatcaatattaatctctgtcagcaacatatgtacatgaaaataccttgtttggatactgaggtggttattcatctataagacaataaatatatatatttaaaatgttaagcacacctagcccaaatgagttttgattgccaaaaaacgtgtttttcagtttagtaattttgaaattgagggttatattgtaaaggaaggctttgtgaaaatgtagaaatagcctcataaaacctataaacctatataaagttattttactatttagaagctatcatttatagatactttctacataaataagtcatttattactattttacttacatatttgactttattatgtacagaaatattcaaaagcttacgttgaagtggtttatttactttggggtatatacccagtaatgggattgctaggttgaatggtaatctagttttagttctttgagaaatgtccaaactgctttccacagagactgagctaatttgcattcccatgaaaaatgtagaagtattcccttttcactgtaacctcaccaatatctgtctatctaatctatctgtctgtctatctatctatctatctatctatctatctatctatctatctatctatctgacagagtcttgctctgttgccaggctggagagcagtggcatgatctcagctcactgcaacctccacctcctggcttcaagcgattcccctgcctcagccttccaagtagctggtaggtactacaggcgcacaccaccacacccagctaattttttgtgttttagtagagacagggtttcaccatgttggccacgatggcctcaatctcctgacctcatggtccgccggcttctgcgtcccaaagtgctgggattacagacgtgagccgccacacccggcatctattatttttgttttactttttattaatagccattctggctggtataagatggtatctcattgcggttttcatttgcatctctctgataattagtgatgctgaacatttttacatggttgctggctgcttgtatgttttcttttgagaagtgtctgttcatatcctttgcttactttttggttttgttgcatttgcttttgagaacttagtcatattttttttgcctaggccaatgtctagagagtgtttcttaggttttcttctaggatttttatagtttgaggtcttatatttaagtatgtaatccatcttgagttaatttttgtgtatgatcagagatagggatccaacttaattctgcatatggttagccagttttcccagaaccatttagtgaatagggtatcctttccctattgtttatttttgtcattttttttgaagatcaattggttgtgggtatgcagctttaattcaggggcctctattctgttccattggtctatgtgtaccagtactatactgttttggttactgtagccttgtagtatagtttgaagtggttatcatgctttttctgtggtttatttgccctctttttactttcacctatttttattaatatgtttttaaattgtaattttccttctattcatttcaaaatttaatattttatatgctgttttcaaaattatatgtaaaatcttaatatagctatttaacattatttttgaacagtttcaatgcagttgtttttggtgattaatgaatctgttcattcaaacagaatttgaagaagtaagggtgtgtaaatttctggctctatgaaatacagtacctaagaaatggagaatttggtttaggataggaaaagattagttgagttgtgaatacatgaagtcttatatatctataggtagctcagaaaactggatataaatctccagttcttgatacacctgactcccataaagtgcaaaaccatagacaggtatatctcacttaaatatgctctccaaacaatcagtttctctactatcactcctccagttataggtggaattgtggtggtatgcatatccatcagggggaatactagtgttgtatgtacattggatctcagagggaaggaaaataaaatcataataatcagttaagtaggaagcgccaaggcaactggagtaagtgcataaagtgagtatttgcagactaaacttattttatttctgcatataagctttaagccatcatagaaaatagctgaatttataaagtaatgagctatatagcgaagcttaatcctgagcactcagcaaacatagtgtataatgcatttggttgtccttttaacactccttcattgtaaacactctaacatatagtatatccagtttggaaataatagtcaaaatgcaatggacactgaaggactaaagatgctgacacctttctagctgctaaatctaagcaacccctcattccccttggccttgagactccttggaagtattggttagagtagagcaaagaggtcttcagtttttgtgtatgagctgtaacacttcagctggggcatttcctattaaagaaagaaagaaacaaaagagataatttttgttttgtgggttttttttttcttttggattctaaatacttcttcttcaacctagtttaagacaggcagacaggttcaccattctcaaaaccgttgtaaagacagataagatataagtaaacaaatccagagaatataagaggtagtcccaagaacactatgatgaaggaataccagatattctctgcttctaaatagctatattgtaccatcatatttcacctgggatttggtctcagacatccagggattctcatcctggctctgacatttaccattggtctgtctgttaaattaagctttaccttgcctgtagcgaaggaataataaaagctacctcacagcattgttgtcagaattaagaggtagtttatgtaagataattagctcaatggttggaggacagtgagcattaaattaactttgtcttgataatctgtcttcaaaaaccctctttaaaatgcaaatgcttttgagaaaggggttgccttaaatcattatctgctaacattaattaacagttggcagagattagttgacatcaagctgacaaggcaactagaagatgaatggcacttggaaatgggaatctcagagtttaagaaggggaagggatcaagaaaaggaaaaatgaatcctgacagttaagtgaaagggcatcaagtatcattgctatcttcaggagacctctttatcctaaaataataaataaataccagaaattgttcctttaaagctatataaaatggcaaccaaaatttcacagaggtaaaaacaaaatatttttgatggtagttttatttaaaatgagattttacattatacaatgtaaatcataatttaaaatgatgtaattacaacaagtacaagaaaaatggacaagacttttttggcatctttaatcttacaaaatagtaagataccatgatactccttgcttcaaaattaacttttataccacaaacacaaaaagtaattgttccaaaaatatttaaggatttccacaaatttctaaagatttcttagttgttttatttcaaatcactatatattaaattacataagatctttattctgtgagagtttatcacacagactttcattttttgataattttgctttattgattgaagctgttttccaaatgtgtctttgttaaattaatgaaacccacaacttttacaagatttacagttttactttgaaatacgttaatgttgtattcttacattttataaataacttatgcaaaagatattggcaagatggaaatacatagattctaggaagtgtaattgagtgagactaattttaaaagtaatcaattagtcattattatgtgattatgacttcttttcctaaaaggagcttgtaattagggttacttgagttatattatttggacacagagagctctatttttaagttttgcctagaattagccatctctttggataaatggaagcaaagaaaatcagtattttacattttatgtatcctattctatctttatccctgttttataagtaagttattgttaccaccacattgcaaatggtaatattgaagctcagagagcaagttgcctaaaatcccatggctaataaataaaaacacagagatccaggtctgtgaattcaaaccctatgtccttttgactatatcatatggtccttacacattcagtatattgtattgtattagtgcattatcccgctgctatgaagaaatacctgagactgggtaatttagaaaggaaagacgtttaattgactcacagttctgcagggctgggggcctcaggaaacttaaagtcatggcaaaagggaaagcaaatacatcctttttcacatggtggcagcaagaagaattgccaagcaaaaggcggaaaagccccttacaaaaccttcagatctctggagaacttgctcactgtcatgagaacagcatgaggataactgctctcatgattaaattacctctcaccaggtccctcccacaacatgtgaggattatgggagcttcaattcaaaatgagatttgtatggagacacagccaaatcatattattccacctctggcccctctcaaatctcatgtcctcacatttcaaaacacagtcatgcccttctaacagtccccaaaaatcttaactaattctggcattaactcaaaagtccaagtcaagtcttatctgagacaaggcaagttccatcctggtatgagcctctaacatcaaaagcaagttagttacttcctacatactatgggggtacaggcattggataattacacccattccaaatgggagaaattggccaaaatgaaggagttagaggccccatgcaagtcctaaatccagtgggacagtcaaatcttaaaggttcaaaatgatttcctttgactacatgtccaacatccaggtcacactgatggaggaggtgggctcccatggccttgggcaactccgccccttacagatttgcagggtacagccccctctcagctgccttcatgggctggcattgtttgtagcttttcaaggctcacattgccagctgtcagtggacctactattctggggtctggaggacaatggccctcttctcacagctacactaggcaatgcccaagtggggactctgtgtgggggctccaatcccacatttgccttccacactgcctcagcagaggttctccacgagggctctgtccctgcagcaagcttctgcctggacattcaggcactcccatattctgaaatctagccagaggttcccaaacctcaattcttgacctctgtgtacctccaggctcaacaccacatggaagatgccaaagtgtggggcttgcaccctccgaagccatggcttgaactttaccttggccccttttagccacagctgggatgcagggcaccaagtcttgagtctgcacaaagcagcagggccctgggcctggcccacaaaaccattttctcatcctaggcctgtgggcctgtgatggaaggggctgctatgaagacttctcacacgctctggagacattttcctgattgtcttggtgattaacatttggctcctcattacctatgcatatttctgcagctggcttgaattcctcctcagaaaatgggtttttgtttcacattatcaggctgcaaattttctgaacttctatgctctgtttcccttttaaatgtaagttccaactccaaaccttatctttatgaatgcataaaaccaaatgcttttaagagcacccaagtcatatcttgaatgctttgctgcttagaaatttcttctgccaggtgccctaaatcatctctctcacgtttaaagttccacagatccccagggtgggggcaaaatgctgccagtctctttgctaaaacatagcaagagtcacctttattccagttcccaacaagttcctcatctccatcggagaccacctcagcctggacttcattgtccatatcactgtcagcattttggtcaaagccattcaacaagtatctaggaggttccaaactttcccccatctttctgtcttctgagccctctaagtctctaggacattccaaacattcctacatttttctgtcttcttttcagcccttggaactgttccaacctctgcctgttacccagttgcaaatttgcttccacatttttgggtatcctttcagcagtgccccactctccgtggtgccagtttactgtaatagtccattctcatgctgctgtgacaaaatacctgagactgagtaattgataaaggaaaaacgtttaattggttgacagttctgcagggctggggaggcctccggaaacttacagtcatggtggaaggggaaggaaacatgtccttcttcacattacagcagcaaggaaaagtgctgggcaaaaggagggaaaagccccttataaaaccatcagatcttgtgagaacttactgacttcatgagaacagcatgagggtaactgcccccgtgattaaattatcctccactggttccctcctaagacatgtggagattatgggagctacaatttaagatgatatttgggtggggacacagtcaaaccatatcacctattgttactggtggcaagtctgaacagggtccttggtcctcgattcttgtcctgttggaagaaagaatttggccaagaagaggtagtagatttaaggcagaaatgagagtttattgaaacaaagaaaagtccatttggaaggacccaagttggaaactcaaaagattgactgcctcgcctgatccttagctcagtgctcttatagacttattatttcctgctttttatcctggtcttttccccttgtccttcctgttgggcaggatgttggctaatcgcagtatgtagagtgacttgccagtgtctgggaggggccacatgcatcatttggtggttgaggttatctgcgtgctctcttagagcagttttcccttgccaatctagctcccccagaggaaggtcatatactgatcaaactgccattttgctccttactgcatatgcctgaatatattctcagaaaaaggtcacaatctgccattttgtctcttactgtgcatccctgaacatgtcccaagaggaagatcaaattccaccattttgacccttactgtgtatgcctggatgtgtttgttcaattcctaggatcttactgggagtttgttgcccaaaagctcaaggtgtttcctatgtgttaggaaatgttccttcccctcgtgccagtcttgaccactcatttctgaggagaccgcctgacaattgcctgacagtcacctgacagttgcctgatattctttggggccctattctgccctgttcatatctgcctatctacctactctaacaacatggtctgaaattttactaaaaatgtttattttgtgtatacgtaggccacttgttaacatgtttgttatgccaattcaaataaacaagagatttcatcaattattttgattgacttaactaaattgttgtctgaattaaacatttaatgcttcccaaatcaaggatataaacagtagataaaaataaacacatacacacaaacacacacacacacacacacacattttagtatttttaccaagtaaaataatgcagtgcttaagtgtctattttagcagttatttagaagccaggcaacatagacaatacaaggatattgaaggaaatgcttgagaaataaaggaattatttatttttattatatcatgtctgttttcctttgtgagtaaaaaatgtataaattatatactctcaaattaatcagaaaaagactgcttcaacctaaactgtgttgtccattgaagcatttgtaacaagtgctttaactagttacttaataatatctgaatgtagtgcttatcaacagatacattttgacattattttaaaatctgcagagatcattttaaaaatattttactttaaaatatttcaatagaaaaatgttttgttcttttcattgcttttcctgtacttaattgtaatatattttccagatatcactagaaaggaaaactcaatgtgtttcagagtctttagttttttaaactatctgacaaaacttacacatggaaaactaaactatcacaaagcaaacacttcaatatggagtttgttttagaatatttagacacagcataaggaaaaagacttagaacactgcaataaccttggttttttttacttagattggttagggattttgacatcaagcagctctagtttacctaattatttttgattgtttaattggatttgaccacatagtaaaaggatttgacccaagtccttaaaatagcctatttttgtttcatctttatagtctacacagaaaaatgtaaaaaataatggatcaagaaagcaagcaactcactcctttgataactggttcccattagtgggaataactagtgtttccatgttacgttcatttggtttggccaaagtggtcaaccagtcaaattagtatgttaaatgcagacaagttagtgtgcaatatttgctagtagtgcttgctctaaaactgaaggcaggaagaaagaaatggggtaacttatgtatgggttgagcatgaaaaatgtggatgtgtcagaatgtctggaaagttacgatatccttctaattccagagagtatctaagctagtcctccctatctgtcatatgatgatatatttttcatatgaatttatcaccatagaaacctccaatatctccccatcacctgtaaattaactttaagttccttaacctggcactcgatccttttttgagtctcctgtatagtttgccatttgactatgaagcacctaagcttctgtttatcttactcactgtattcatttttttcagcttccttgcctttgatcatgtcatttccagtgccagaaatgcttacccatctcccttatgcacttttgttgaaacgtgtattttattttattttatttttttgagacggagtctcgctgttgtcagcccgggctggagttcaatgggtcgatctcggctcactgcaaccttcgcctcccgggttccagcaattctcctgcctcagccttctgagtagctgagattgcaggcacccaccaccacgcctggctaatttttgtatttttagtagagacggggtttctccatgttggccagggtggtcttgaactcctgacctcaggtgatcgacccacctcagcctcccaaagtgctgggattacaggcatgagccactgcacccagtcaacttgtatcattttttaaagtacataccttaaaataactatagtatatgtatacatatttcttgggctctagggtcagaaggattcaattttgtcacttatcagcaatgtgactttggggaagaaatataacatgttcttaccataattcctcattttcaaaattttacatgtatatgctgaaagatttaatgagatgatatatgtaaagtattttacccagtgcctgcttcttggtaaatactctataacttagtgatgatgatgatgatgatgccctcttcattttatccgtttatggttaacaaagtaacaaaggatttattcttctctcctggccccctgcttcctcattagcattcctaagtgcctatgaacaagttttcttctcttgtctaaatcttgtcacatccttcactgcacaacagtcatttatgacatcttatttttcctactcgatgtaggctactgaggcagtcccagtatctttgtatcttttatagatttgctgacatagccctggatgttatcaggtacttgataactactgtttattaattgttctaaagcaaataatgaggcctgagtaccccactttaaatagttaattttgtatatttcaaaagataatgttacctttctttatattttttcaataaagaaatatagtgatgtagttatttgatcacatataatataaatcttactctagagaaatagaaacaaatagaaaatgttatcttcatttaggaatttcaattaatgttctcagttggcaaattaatatttgagtcaacccttttctctttgttttatgtcacttattaaatatggatcatttttaattagttttattgaggtatattaacatataatgaacatcagcaacttttaagtgtataattcagtgaattaagataaaagaagtcatgtaaccactaccataatcatggcatagaacatttccatcaccacaagaagttccccagtgctcttccctttccaatcaatttttcccccaattctcatccctgatattcattgatgtgatttctgtccctatattttgttttgtccagaaattgtttttgaagaaattctacagtatgctcctctcacttggcataattttgagattcaggcatgttgctgaggcagttagttgggtttttcttaaataattgctgaatatttcattgttgcaatatattaggttggtgcaaacgtaattgtcgtttttgccattaaaactaatgatagaaccacagttatgtctgcaccaaacctaatgcttcaggtgtttatccatttatcagttgatgtacatttcagctgttttcaatttttgactattatgaataaagctgctatgggattagtatataaatcttcaagtgaagaggtatatgtctttgtgtgattttatgttttcatattataggtgcttacttcattttctccatgaaagtaacttgctttcagcatttatatctgtggagctataggaaaatcttgttattaccctttatgttgctatcattctatgtttgaaaatttatacataattttgatgatagtatatattgtttgcagcattttggaatgaaatatatgtttttcttctgtgtgaatttggggactttatagcacatgtattttcctcctttcctagttagcattctttccatttctgtctgaagaaatcaaatattagtcatacagatgccattacaatgaaagtgcaaacagctgtggttatatttacttgctttttctttctcttagttgaagaatctttttcttaacccagagttcagctatatctttacagtttctagacagaagcattagaaattgtaaccagccacatatattaatacacatatttttgagtttaaataacaattgacagttgttttaaaaatctcaatttatattggaggtccacgtgcacgtgataaaagcaatcaatatatatataattgctatatttgtctcatataaacattttctaaattattcgtatcccccaccacctccatttctttcaaagaagtagaaaaaatagtttaatacgtacaacgattctataatgaaattgaaaatcaaaatatgggcggggcatggtttctcatgcctgtaatcccagcacaaggccatggtgggtggatcccctgaggtcaggagttcaaggccagcctggccagcatggtgaaactctgtgtctactaaaaatacaaaaattagctgggtgtggtggtatgcacctgtagtcaggaggctgaggcaggagaatcccttgaacatgggaggcagagattgcagtgagctgagatcgcaccactgcactccagcctgggcaacagagtgagactcagtctgtgtgtgtgtgtgtgtgtgtgtgtgtatatatatatatatatatatatatatatatatatatatatatatatatacacacacatatatatggtgattagtcctaaaacaatacaaattacaaatgtttatagtgaaaaagtactaatatctagaaaatggaaatacatctccagcatatatcttcacatagaaatatatcttcacatagatgtatatctatatcaatataattaaattttatacgatataaaaatattaataaattagcaaacacctgctattgttcagattctatgaatatatgacctagaatagtgtattgaagctagccattgtcaaccagggttccaaaagaaaattgagccctatagaaaatgatatgattgactgttttcttagttcccccaagaatggtacgtaactaaaatcattctaaataaatagaagataagttagtttattacatataatacatgccttaggaccttagagattaggtttttttcaccgagcattatattataaacatcattccatgttaaaaattatttaatccccaatttttaatggctgtatgtattccagaaagattatttaatctctaatctgatactagaaatttgagggcattttcaaaaatatttcttattgtaaattgctttgcaatgaacattaatagagaaccgtgtgtgtgtgtatgtatgtatatatatgtgtgtgtgttgtgtatatattatatacatatatgtaattattttttgataccaaatttctagtggtggaatttccttgtgagagaatcagtattaagtttgttgataagtattgtcaaactgtctttcaaaaagagtgtaacaatataagttagcctcacctagtcatttgtgcactagttttgaatctcttttctcagcctgctggtaatctttactattaccctttgctcaaaccaatgaactttaagttgccagactactagttagtcttctgtagaggaggttgtgtgtagagcaaagagaacaagtatatttcctagcctttcttttatcctaccatgctggaattcagttcacttttagttttatagagggcattcattgccattctctcacgtatgttttgattcttcctgtctacttttacgttgtatttccaccaggaataatgaatcctatcccttccatcaaatctatttcaagaaagacactttgcaaagcagaagggctccaagagcacagctctagtctctcttcaatgtttataaggcacagtcattatttttacccactgctgaaaacatttgcaggggttattaaaaaaattttttacctaaagatactaaatagcaggggttgcagacataagcatccacctgttcactggcttattcacttaaaatataacaagcatgttgcctaagcaaatgtccagtaagttttctttctgttgtttgcgtttagtaaagttctaaaactatacaattttctctttctttccttcagactataataggaactgggtgaatattatccaattaattctgttacacaaagggccttatcttttttcttatccttattttcaaaaggacactgcctgctacgtgcttagcaacaagtagtcttttttttgaacaagatgagaagaaatccagactatcctataacagtggaagagttgtatgtaaaccttattaaaaagtccaaacaatatcaaatagtataggcttatttctctctagcttgctgcaaggttgacatcccagagaggatcagggcatatggggagtaatagtcctgcagatcaagcagccagatgtgactaagaaaatgatgaaagtgaaatctgaagcactactgtcattgttgtctcatcatatttataaacaaaacattcctggttgagatggaagtcttttgtgttaaatgtagggttctccttaaatattaacaacaggcaaggcagggatatgttataagagttaaatgtaaggttcctcttaaatattaaccacaggcaaggcagggatatgttatagaaatgtacatttcattagcaaggaaacaaccatgatatcgatggagttcttaccacatgagacgcacagggatgattaagtgtatgtaatacagtacatataaggtaggtctccatattttattctcctgctaaaaacactaaaggaaaaagaaaaaaaataaaacaggatcttgagctagatctatgatctttctaaattaatttagttaagatagctttttcaaatggattccttttacaaaacatgttgttaagcagagttctttagagcataaaatatagtaagcggtgtaactgtaattagaatatgcccatgtatgatggggagacgaaagtcagcacctaagagctgcagttctgagatctctctgcaaagctggtctggaggatagccatataaatgcgttctcttatgctgttcttacacattgcaaaaaggcatgaagctaacaagcatcgaaaatgagtgccgttagacatggtggatcattcactggaaccgttcttcccctcagggagaatgaaagtctggagagagaaaactggctgacctcgctcaatcagcacagtctgaatgcaggcagaatggccagcggtgacagggctgtgcttcggagatgtgtgtgctcaggctgcggttcaggttatgtcaacaaggatcactctgggtgccattttagtggctccatgttgtacataagagaaagacggaaggagaaaagggaaaactgtgggccactttaaatgtacttgagaactttgcttttcacttaggacatgaactctctctcagcctgtaagcagctgcagctcgaagcttgacaaacaggccaggaagatgggaaagtactctagtagcagcattgcttctccagtggaaaaccgagagtcctaaatgttacagtgcttcagcctgaggtttaactgatagaatgccttgatcttgaaactgaaccaggcatcagtaaactgtagaagtttagcctgttgtgcatagaagatacaactttgcattttataccttttactgtgtttaacaaaagaaacaaaacattccaaaaacctcttattaaatacatatcctgctttctgttttggaagtagtgtttgtatcatgcgaataggctctaaagcttttaaaatatatattctctattctaagaatggatctaacaaaataaatcaaaaggaattttatttttaaaggatttgatggaggaaagggtgagatctgtgatacttatagcttccaaatctgtaggttcataggacaagtgactccctatgcttggaaagtcttcactattttaattacattctaggattctagttataaaccatacccatgtcttgtacaggaaacaaaatacataatttcatcaatccttcgtttcaatagaataaaatgaagataaacaataatattattgcaaataatagagactgcttagcaaaatatctgacacatagtaagttcttattatatacataggtactaaaacggttactatgtaatatttgagagacagatttattcttggagcaatcagctcttagatctatctacccagggaatcatggcacataatgggaagtacaagaagccggtaatagttctgaattattttaagccatggtaaatgggagaaaatagagtattaattcaataccagttgaattagaataaccttgaaatttttgtcctgatatatagaattgttctgtctcaaaaatcttctttatctaaaagatattctaaactaataacataatcaatttagtaaatgcttgcttgctagacaccaagccgcaatctacatactttacttaaatcatttctatgtaatagttacaaaataataagaaaaatatatctctacttctcaaatagggcaacaaagactgaggaacatttagtaaatagtctaggtgatagaaataataaatggtaaaggaaggatttgaaaaattttaaactggaaatttgctttagaaaatctaattgccttatatctgaattagtatttgtatgatttgactcattctaaattatgaggtcttacaatttattactctttgtaaacactgaaacttgtataggtttgcccacagtagactgactaccttttattgagctgatttatcaaccctccggtgtttctaatttctgtattctaaaaaaaatttaaaaagatgaactcataagtcaacaaaataccttaaaatggtgatttaataatctgaacatttctctaacaatgtaagaaattgatttctttcttttctatttagttcagatcacaagtaccttaaatactcgtgcaaattgcttcttcctcctttattatgtttactataaatttgcgtttttcccattatcttgaagtaatttatattagcttcattttttagcgcaaccaaataagttctagaaatacatattttgttattttaaaaacgtgaaaaaataaaattaacctcaaaatgattgagtaaaaagaagtcagtttaatgcattgattcagaattcttcacattatttgcaagtctgtatctctacaaggtaaattatttatgcagaatcaaacaactgaaaaactcttttaatgcaaacttttttctacaatgtgtaagattttataaaaagaaggaaaaatgacaatctaatagtgtccatgtgccactgtatcaatagtcaaccaaatatttatttttttaattattttgatatttaatagaaaaaaatagggcccaaatcactaccaaaacatgatctgaatcattaccaaaatattaagctatattttgacccattagatcaaaggtaaataagtcccttatcattctgtgctgtgaatatgattgagtcctaatttgaattcagtttaggaaacggtactgagaacctcctctatatgtttgtgttatggaagtaaaatcatgaaggaggtattgtgttctgctcttaaaaataaaatgaaaactcaaagcagttagcttttatctgttgatctatctatttttaaaatgaaataatcaccaaataacccaaatggttggcaaccagaatatttcacttctggattagttctcaaccaggaatgattttaccgtcaggatacatttggaaatgtctagaggcatttttaatttctttaataggagcagggggaggagcagcaggatgctatcagcatctagtgggtgaaggtcagtgacgctaatacacatctgcaatgcagaggacagtctctcatgacaaagaattatcagcccccaatgtcaagggtgctgagattgagaaaacttgatctagatcatatggaggttatgcattaagatgatattttacatcaacattaaatttatgtaatttgtgctctttagcttttagatcctccaaatattagtattagtagagattgctgactctttgaaataaagagacaataaactaatgaactaaagtaaaactggaaagaaggcatagaccatgagcctttccaagaggagtatagtatttcaaagttattaacatttaaatggccacataaaggctagtacctagtgttctcataaagatactcctacatcatttaatcataaagtgtttatttaggtacagtattacaacgacatcaacattattagtatccccttagtcaccttctacatatgcattttcatctcttccttgataaaattattgatgaaagtattggtgtatgagacagttcttgtccactttaaaatacagttatgttgtgttttaaaattttggcagtcttagctgagaacttcattagagagttcataaaatcaatgatgtgtgcttaccattccaccacaaagatctaccactggaaaatatggtatttttctgcagatagattaaagcatacattttgatggaatttccttgtaattaaaggaaagactcaggctaagttaaaagtaatgcaaaactgtacaaggaagcaaaatctcaaaatggtagtcttgatagaaaaataattaatgaaaaaacaaggatggcatgttttgtattaagaaatattcaccctaaactgaatcagtttgaaaaaggtagggaaaaacattgggacatagaaatgtgcttacaggtcttccagttcatttaaaaattttatacgtttcattaattttctctcccacttccaacatttgtgaaagcaattaataatcatattgttgcctctataaattttatttatgtcaatctaacgggacctatacaatttagctagaatactggaattggttcaagtctcatgtccttatctcaacatatctacctatatattaggatacatgcattcccagggtttctagaaaaacttccagacaaatcattttaattattttatttatcatcttataaagaggtaaactttacccaatataatagtttttaaaataattattttatggcacatggtagggaaacattttactgtctgcatttattttattttttattcattcaaaaattatttattgtgtaccagccactttttacactactgaggaggtatggtaatggacaaagcagataaaacatagtcaagatttcttccctaagaaaacacttactgccacgcaagagataagtaatagaggtaaatacataagacaaacacacacacacacaaagagaaagagagatagatagagattgattagattgattattgatagttctagttaaggtcagcaaatccataaagacctcccacagggagtcatttgagcagagacctaaaagaagttaagtaatgagccatgcaggtaactggggaatgcgtgtttgaggttaaggtaaaaattattgcacgtgtcctaagttggaaactaacagcagggccagtgtggctagggtggattgaagaaataaaagacagtgttgtagttaaaaagagtcaggcaaaatcatgtcagtcctaatagagtttataagtagaacttataaatttagtctattaccaagggttgaaataggatgaaaagaaaacacctgatttcactaaacttaaaataaccaaacactgcattcatcatcagaaagggcttcataaactacttactggatactctagtgagttgaaaactgtttttgaaaattagagtaataatacccattagcaatttggggcaactcaagatagctccaactatctttactggtaacataacactcttttcaaaatttctaaaattaaattaatttaaataagtttatttttcacctgtatgccacgtttgcacagtaagtgtatgacagagttcctgctctagatgagtatgtgatctggtagggaagatgatgcatccagagaactatgggagaacataggaccactacaagaggaatgtgttgtgtggatgatggaaagggcgtagggagaccatataatatatataaataatatccaaactggatcatttttgagaatgaaaagggggaatattaatattctttctgggaaaactggtgtaaattggcagtgttgtaagcaaactggtgcacgagttaatgatgtatctacaaaatttcagaaaagaagggtgaattgtaaattaatgtgactttttaaatctttaagttctgggatacatgtgcagaatgtgcaggtttgttacataggtaatgtgccatggtggtttgctgcacctataacccataatctaggttttaagccccacatgcattagatatttgtcctaatgctctcccttcccttctcctccacaaccccgacaggccccggtgtatggtgtccccctccctatgtccatgtgttctcattgttcaagtcccacttaggagtgagaacatgtggtttttggttttctgttcctgtgttagaatgctgagaatgatgaattccagcttcatccatgtccctacaaaggacatgaactcattcttttttatggctgcatagtattccatatgtaccacatatggaatatgtggtgtatatgtaccacattttctttatccagtctatcattgataagtatttgggttggttccaagtctttgctattgtaaacagtgctccaataaacatacatgtgcatgtgtctttatagtagaatgatttataaatccagtaatgggattgctgggtcaaattgagtatctggttctagatgcttgaggaatcatcacactgtcttccacaatggttgaactaatttacattccctccagtaggttaaaagcgtttctatttctccacatctttgtcagcatctgttgcttcctgactttttaatgatcgccattctaagtggcatgagatggtgtctcattgtggttttgatttgcccttgtctgataaccagtgatgataggctttttttcatatgtttgttggccgcataaatgtcttcttctgagaagtgtttgttcatatcccttgcccactttttgatggggttgtgttttttcttgtaaatttgtttaagttccttgtagattctggatattagacctttgcaagatggatagattgcaaaaattttctcccgttctatatgttgcttgttcactgtgatgatagtttcttttgctgtgtagcagctctttagtttaattagatcccatttgtcagtgttcgctttcgttgccattgcttttgatgtttcagtcatgaagtctttgcccatgcctatgtcctgaatgatattgcctaggttttcttctagggtttttatggtttaaggttttatgtttaagtctttaatccatcttgagttaatttatgtacaaggtgtaaggaaggggtccagtttctgttttctgcatatcgctacccagttttcccaccatcatctattaaacagggaatcctttccccattgcttgttttcgtcaggtttgtcaaaaatcagctggttgtagatgtgtggtgttatttctgaggcctctgttctgttccattggtctatatatctgttttggtaccattaccatactgttttggttactgtagccttgtagcatagtttgaagtcaggtagcattatgcctccagctttgttgtttttgcttaggattgtcttggctataggggctcttctttggttccatataaaatttaaagtagtttttttttttctagctctttgaagaaagtcaatgatagcttgatgggaaaagtattcagtctatgaattacttcaggcagtatggtcattttcataatattcatctctgggacacagctaaagcagtgttaagagggaaatttatagcactaaatgcccatatgagaaagcaggaaagatctaaaatcaacaccctaacatcacaattaaaagaactagagaagcaagagcaaacaaattcaaaagctagcaggagacaagaaataactaagatcagagcagaactgaaggagatagttaagaacgtatctcaaaataataagagctatttatgacaaacctatagccaatatcataccgaatgggcaaaagctggaagcattctccttgaaaaccagcacaggacaaagatgccctctttcaccacttctattcaatgtagtattggaagttctggccagggcaatcaggcaagagaaagaaataaagagtattcaaataggaagagagaaagtcaaattgtctctatttgcagatgacatgattgtatatttagaaaacctcattgtctcagcccaaaaactccttaagctgataaacaacttcagctaagtctcaggatacaaaatcaatgtgcaaaaatcgcaagcattcttatacaccaataatagacaagcagagagccaaatcatgagtgaactcccattcacaattgctacaaagagaatacatacctaggaatacaacttacaagggacatgaagggacctcttcaagaactacaaactactgctcaagggaataagagaggacacaaataaatggaaataatgtgactcttaaaaccttctttgaggcagtagtacttgtacttggattgtgtccaagtgtgcaactgggcagaggaaggtgggagtgcattctagtctagggaaataacatgatgaaagacacatggatttgagaatcgcccaatgtaaaatgaagcattgatgatagtgaagagtgggtgatagtatcggatggttaagaaagagatgggtacaggtatgacagcaaaccagactatcatagattttaaattccatgacagagttccatatcagagagccatttaaggtctgttagtaggcctgtgacctgtataaagagtaaaactactcctaaactgcaatttgatatgagattggaatactgcagagcaacatatactataaaatttacagatattttagttctgcataatggataatttttgcatggtaaattggaacaagaatagaatatgggtgtatgactgtcctgcaaagtcaaatgcctcttttatgtatatatgtagttttaggtaagaggctatgttttatgaagtttttttagaatgactgctaggatgattctgcatagaaggtaaacatagcaaaaaataaaacctctgtgcgtgtgtgtgtgtgtgtgtgtgtgtgtgtataggctagaattttcaataataatgacattttgagcacttactatatacctgaaataatgatgttaacacttttttttctgaaatttcccacaaaatcctacccgctcagtgttattatcatttcatagatgaagaaacagaactgaagaggccctataaacaagctcaagactgcaaagctgctaggtgatggtgcaaatattcaagcacgtttttgcattggtataaaggcatctttttctatggtgccacattaccttacacgctcatcgagttgagccccctgtgtctcagttcttccccagaggtctcagctggaatacgaatctaggcacttaatacacatttcatgtcactctactataatataaattgtgttactaacaccagtgtttaagctttttattttttcactacaaagaaggcataagtacaagcatgaaaaaaaaaatctattttcttaccctgttcgttgtttgacataaagtatctagatttttcttgatttccagtttaacagtttgtgtgcagtcacaatttctttgggtgatccccaccaatcagtatctctcgatctcatctttaacggtcatctcctaaatcagtgttttgtgaataaatttattcacctaacaactggtttgtattcttgaaattttcagtaatccctacagatatacagttctcctatttccacaactataatattgtgtaactctcctgggttccaagaaaattatagtatttttatttaagctataatagtttctagtcttgagatttgggaaaatatcaccgagtcaatcaccagaattattaattaacctacaaactaggaacagaggcttagtgggaaaaatatattacagagcccacacttgtggagaatacacaaaacacatctgagtgatcgatactcaacaaagaagtctgaacacgtttagattttaaatagtcaatctctgctgtatcttggaattagaaaaactgataaagactgacagtatgggaactgaccaagggaaagccagtttagaacaccaaatcctagaaaactactgggcaaaaaagtaagagaaaggggaaaaataacttagggagaatcaacaatttattattccatgaaaacctttcatccatgtatccatagtatgtatattacatatatctctgatagaacatgaatgttaggttcaaaacagtggccactcaattactttaaatatgacaattttttccaagatatactttcttttttatgtgttctttaattgtttaaatcccctattagtactagaccttattattttacagctatgcaaatatcaaaatacatttgcaaaaaaaattgtctagtaagatatgatgatgtctactttgcaaatatattttgatgataatttgatgaaattaactacatcaatttcaagattatgaaattaatgtagatataaacgtaattataaaaattaatatataagcatgattctacatgattatgaaaatgagtatgttttacattataaatgtgattatgatataaacaaaattagaaaaaatataaacatgattataaaaattaaaaactatgtgattttacagagaaaccccttgtagaataagaaagaaaatgcattcttaatagtttttgtactatttatattactagcataacttgtaccaatttttctacttttgaaaaagaactcaactaaaaaaaaccccagccaaaactttcatgttatgtgcatatgaattaatagtaatttaagatttattacagtgattacatatcaacagagataaatatgtgttttatgattaggttttttttttttttaaacaggtgagcaatagggacaaattcttgatgtagaaaataaaccatttcagtgcctgttgataaatagacagtatccactatttcttcatggtgcatggcaacgtgacaaataaattaccttcattaaagatttgcatgaaggattaatgagcattagttaagccataaaagcacaaaaaacatttttgaaaaattacattgaatataagaataagttgaggggcagacaatctcgttataataatttatcttgcctgaagattctctgctgcacctatgtgataaatgaagcccaaaagcaactcaagttccacatttaacatagaaaatttaggcagttcacaactctagagggttttgtcctctgtgactcacctacctataagggggacaatttataaaacacttatttgtttctgttagtattcagactgcaataaatcttcaaattttcaccataaaatctgcataacatgaaattaaaagaagttaagcatttttaaaaattcatagtgaaaaaatgttgagtgttttaaatacctgccttatgaattttcttttgcttttaattcatagagctaagttaaaatttaattattcgtgttatgtataaatgacaattatcctttggataaaaggtaatattttactaagtaaaacacaggaatataagaaaactttattttgctaaccgaggtcttaattttccttcatttggaatactgtccaagattaaacctttctacgcatcaaacactgtcatcttgtggactgccattgatttcagaaaatacaggctaatttaaaaattattatctgtgcgacttttcatggtaaaatatttggacaactctgtaaatcttaatgtaagtggagatgaggaatagtatccttgtttgtaactgtgcaataatgaagcttttacatttatgaacatctgtatttcaggtccccgtgctggtattttatagtaggtctctacccagcaggccacatccttactgtttgatatggttaagacttgcatggcattgtgaccatggtttaattacagtgtgacttaatggttaatagaaataatcaccagcctgcttttgttctggtctggtgagtgaaatctagacaccgctctaattagtcactatttcaaacatctaacttttatttgcaaaattacatcccatgcatataaacctcaatctagtaaacatttgaaaccactattcaccaggtttccttttctcttttcaaataaagatcgatgctttgtaataattcttaagttattggcaactctatgtcttagttttcccatttgtaaaataaggttacctattcctatgagaattaaatgaattaatatacatagagcacactgcctggcacattctaagtgtggtacacatttactagattgtattggtgctccatccagaccttcacccgatgcgtgcgcacatccagcagctgctatgaagattggctgcttcctcttctccagaaaatttgccacacctggaaaatcgtgcttcctgccctcattgcattccacctgccccagccagcagctaataacttatggatacaggggagagggtgcaaatagcctttgctgatactctttgccttcttttgcctcacttaccagtgctgcagtgaaagttgtgtttgagaaccccaagtgggatcaatcttaagctaatctccaacagggaccacatccctggttagctttatttttttctccctcatcttacctcgcttctcttagtttttcctcctggaaaaatgttgtcaaatcatatctgagagtcctcttcactgactctatttctataaacccaatgaaagacaataagtatctactcttgttgttgtcgttatgcccactggtgtcttgatttaatgaagggtaaatgctgagattacctttgtcatgtccaaagttgaacggagtccatggaacgactccacagcctttcagtagttctccatatatatctttttttaagctaacattttcacaaatttgataagcacattaaggtcatagtccctggcaagattctggggcacaaatagactgttgttggttaaggcagggatttgggggctttatcagtgaattatgggaaacctggagtgaatgctttttaatgcaaagtttggaacctaggttgagatcgttccgctgactcttgcacactgttgagtaaacactggccctagacctgctaagagcttacaattcaatacaacgtaaattaaaaaccccttagcaaagcaagaaatttaggccgccttttgaaaagggttagcaatgacctttatatctagacacagggctcctgggataaaaatgtcctccacactgtgaagtattccacagagaaaagaaaaatagttgctgtcacccagttggtataatcacttgaactctagaacttggaattcactagctcagacctgcttaagttgtggatcatgagatgacgccagtttagtactgttcttattatacatattattttatttatcttatgtttttctaaaggtgttttgaattaaatgtgcataaaatattttcctgtcttggtgacataattatgaagaactctgcttcttttgactttaggtaacaaacataatgaaaatacttgtctccaaagcataaaaaagagaaaattattactttgttttgttcaaccaagataactaaaatttaatgtaataatacagcctactttgttttaaagtaatttcatttttcaaacatatgacaagtattctcttttgcattcttcacaacatctttaaaaatatcttgattctgaggctgggcacagtggctcacgcctgtaatcccagcattttggaaggccgaggcgggtggatcacgaggtcaggagatcgagaccatcctggctaacacagtgaaaccccatctctactaaaaatacaaaaaaaaattagccaggtgtggtggtgggcgcctgtagtcccagctactcaggaggctgaggcaggagaatggcgtgaacctggtaggcggagcttgcaatgagccaagattgtgctactgcactccagcctgggtgacagagcgagactccgtctcaagtaaaaaaaataaagtaaaaaatcttgattctttctcttggtactaaccaagagtcagacagctttattctattgtaactttcaggatcttcgtctctggttgtgtttttatagatgaaacttttgacacttggaaattaaatccaattgtacgaggtacaagatgaatttatattctacaaaattgtgctttatgctagatagtttatcctgagccaatagctcccctattgagcagtttcttcatgttgaacactcatttaagtggcttgtgtaattctcagcattactaccacgtagacattattgtcccattttatggatagtgaaactaaagtttaggaaaattaaattacaataatgaaagaagattaatataatgataaaatataggcttagagtgagaagagaagttttaattttccctctgactctaatcagctgtaattttccactggttctttcacctatttgagcctcagacctttgatgttgaagatgattaaaataataataactatatttctgtagaactaattttacatgaaatattgcatttaaccttccctttcttccatcagttttagtttacagatgagaagattaatgcttgagcaaaattaaatagctttcctaaaggtcatgtagttagtaggtcatgcagccatctttgaatgcctggtctctgtgattttgaagtccatggtcttactcaaaatgctaatttctaatgtgtctgtgtgtaatagggaaagtggggcgcacagaccaagggaagaactaggtaaaaaaaaaaaaacatgaaaagtatgtgactcacggtaaactcttatgctaattttttcccagctctatctgatattttcataatatcctcaactgtgctttgcatatttcactactacttgttgatatcccagttgccttgatctcagttcccaccccaaatctaggagccaaaatgatttttctatatgatccattaaataacttgagctgccaatcagcttcttcaacagaatattaataagcatgctcaagcagaggcaaataattggtcatccatgaggctattaacctctgatagggattggactacctaaaatttaatatcccttatctctaatatttcatctaacttacctagtagaataaatcatgaagttatttgatagtacctttgtaaaaatgatctttttctcttttgctcattcacagtacattccagattgttaaaactgtctatattactataataaatagagactcagtgtctctatttagcccaacaacaagcatcctctctgactcatattctcaaagccagaacaagccaattttgatcttagaaaatttgtaatgaagtttaatatgtgaaaataaatccactcttgttcttaaaatttagggaggtttgtataaatagattatagatacatttctatctcaaatatgcatttattcaccaaatatttatggagcaactacacaccaagtatcttgttgagttttaaaggtatgatggtgaagaaggtagattcaatctctgctcttcggagagtaattgacatggctaatagtgactttttctgtttcaatcaaggtacacatcagcattgtaaaatatatttcccaccaatttcaggttgtccctcatgctcagtagtaatgaataattaagcggacaattctctacaatttctatcataatgtcactaattcagagatccaaagtggtaggattgggtacaaactttcaaaaaagaaaataattgtagtgaaaatttttaaaaccctatttttctccaggaacttactaagttatcctatttaagtgtcttcacttcaattaagtcatcatgaaagagaggagatgagtcataatggatgatggaattatgaaaataaatgtgattaaaagacaatttgtaaatattaaaatgctcctgacatatactctcctaagcagcatcagtaaaaattaatacaagcatatagaaaataaataaatgcaaaacttgaactatttaaaaaacaaactaaaagttatttattttttatttttttgatttggggtctaactctatcatccaggctggagcgcagtggcacagtcacagcttatggcaactttgaactcctggcctcaagctaccctctcacctcagcctcccaaagtgcggggattacaggcttgggctgctgtgcctggacaaaagttatattttcataataaagaacaaattataaatatgatttttggcaaatgaaacattaaatctcatattacagaaataacaaaaaaatagggattttggtaaataaggcctgttaactgagaatcttaccataaagttgagcattttataaaaatagagaagcttctgatttttaagtttttctttctgtacttacagggataaagaaaataggctccctgggacagtttcgttattaattgagtcattcaacaactcagatgctatatccattgtgttctctccaaattctttgacccaaagcctctgatgtgtacacacactattagaaagaagaatggttatttcccaacatgtagttatattaaagaatgttgaatcactgtgattactcattgaacttgttttcaaagacttcagagagtccagtatgcagtttcattccccattctcacactttttttttgttaatggcactgcagttaagagaaatgagcatcattgtccacatgtgtactcctgtttttgtatactctgtagatgtggaaatgcgtcacttaaataatcatctttttaggggagcaaagagaagatcttctgtttattgacactgaatcagttgcagcaattgcatagaaagtctgcaatatttgaatccctaaaatctggacattcaattagggcaggagacagctaacctggaaatgttctcactaccaaaatttagaaatgatgactgaaataaagcagcgaaaattccaatatgtagctgatctcacaagaaagaaaaggaaatcccgaagtatcagaaacaaataagaactaaaatccaaagtatactctctggtgttaaccctgaggagatcttggaagcaaggtacattttttatatgttacagaagtagaccctaaagtctaaaacctagaggatgaatgatcatgccaagggcaaaggacaagtccttgggcctgcctaagaatggaagttgaatagcagtgtctgcccaagtcagactccagatggaatgacctgctggttcagagtagaagacaaaaattccccaatgagaaaccaaaagcctatgcagcacatgtatttgtggcccaaatgcgtattaccacatagtatcaaaaatatgcgattgaaatttaacataaacattgatccttttgttgcaattgcttttggtgttttagtcatgacttcttttcccgtgcctatgtcctggatgatattgcctagattttcttctagggtttttatggctttaggtcttatgtttaagtctttaatccatcttgagttaatttttcataaggtgtaagcaaggggtccaggttcagctttctgcatttggctagccggttttcccaacaccattttgtatacctgtgtaacaaacctgcatgttctgcacatttatcccagaacttaaaggataataataaaaaaagaaagtaaactacatagaaaaatggggaaaaaaattgatcctaagtagggttcatgcaaaagcattctcgaggaagactttcataacgtagatgcacagtatatctcaaagtggtcattgtctgctgaaatagggactactcactgaagaatcagaccaagaacttctaaaacattttagttgctttagataaccatactgttaaaaaaaaaccttaaaaagtgggaaaatcatagttgaccaactaatctcaatatcttctgaaatgaatgctactactactaaatgtttaccaccgaataagatcggcatgcattcaattatttttaagggccaggtgcagtttgtatggaagaaagtggtgtatgaagctaaaggctgtggcaccacagctaaccatactatttccctgaaatattttatagttctcaggttacaatgtaatactaaaaataattatagatttatagtttttttatgattactttgaaggcaatattaaataaatgtgaatagataattgaaaaccttataggaggaagtaaacaggaatattaaaagatgtttagctcagtccaatattttcatttttggcactggcagaaaatccactgcaaactcaggttgtcagctcttctattgcgtactatttctactttttatacttcttggaattatgaaatgcttcactacatgaaactgaaaacttacttgaagaactaaataagcatttttgagtccccaaatacttacccatgtgtaatatctgagaaaataccaattttgtgtaaatgtttttctcctattctaaaaatacaaaacattaactcaacaaatatcatctgtgtaacagaaacagtatttttaaatttaatgaatgatgtcctgtaattgttagttgctttcttttctctgtaactttaatataaaccaaaagctaagaaaacccttattttatattagattttagtaaaataataaaaaaatttgattttagtaaattatctaaaataaatatatattaaaaaatatatgaattatgtgtgaatgacaagtaacacttccattatagcaattaaagggattcacattgttaaatgtgagaaagccttgaatttagagtctacttgagctgtataagaacaagttgaagtatttcaattatactttatggagttccttcattcctttgagtaaagtcatgtggatattttaaataaattattaataaaatattaaatgtactgaaggctgtcaactgggtgatggtaacagtaaaaaacacttttctttataaaacaattgttaaaatatttgaaagttttggattttgtatctgtatattgtaattatgcattaatgcaatacaacatttcaaaattctcaggcttctgctaaatatgtaatttcccctttttttttgagacagagtcttgctctgttgcccaggctggagtgcagcggcatgacctcggctcactgcaagctccgcctctcagttcaagccattctcctgcctcagcctcccaagtagctaggactactggtgcccaccaccaggcccggctaatttttttttttttaatttttagtagagacggggtttcaccatgttagccaggatagtctcgatctcctaacctcatgatccgcccgcctcggcctcctaaagtgccaggagtacgggcgttagcccccgtgtgcagcctatatcatttattttaataataaatattagcgaaatcttgcttagaatcaatgttcaactcgtcattgaaatttttctgtggaaaacagacctgaaaatatttaagtatccattattccttcagacttgttttatatcctctttactgtttttcttatatttaaatggtgcaggtagaaggagctcctaacataataatgtttagttaggctgggatgataacagaaatgttacttttcatattttatgaatgcatattattcattaagttcttaggtacgttgtcttggtggaagcttatgaagtacgtaatattctaattatatgaattttaaaaatgaacctcaaaaagttagttaaatactggctcagtttaaaccatcatactgtctctgaaagtcccaatgaacttaaacttaatttagaagttaaactaagttacaaaatgggatgtgtgtagagaacatttggacagaagacatgtagtttgcctttctttgataagtttaattgcttaagtgtccctgtctcacaccttctttacaataaggtctatatctgtatcttcttattctacattgtttcataggtttgggtaaattttcttcattaaattgatctttgagaatggaaaattgtctcttacctttctattttcagtgttatcatagttctgagtacctaaaacatgttcagtacacattggaattgaaagaataaataaacgagtcaaggtcagacatcgtaagaaatatttcagatctcaccgtagtcattaacaataatcctttgaatataaaatactaaattatatagatacatggatcaaatatgtatgaccttgcaatatatctaatgctttctaaaggctttgttgtttgagctttgtctgttaatgaaaaaatcaaagtctttcgttgaccaaattttgtgtattttcagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtaagttgcttggcccgttaaaatggtcagccaactctaatttggaaaataaagatgtattagtgtgtgttttttttttaagacctggaacttacaaataaaataaaaaggcatttgccatatttagacactacatttttaggccaggattttgcatgccttagaataaaagtttagacataagaaattgatgatccatggttgagaaatattcaccataatgctactctaatgccagaaagggagaaagaatctgataaaaagaaccataataaatactccacagttctttcctttgctcttcagtgcctctatataacatatgtgtatgaattgcaagcattttatgggttcacttttcattacatttttattttagctgccttcaaattgaatgctcaggttttaatacttcatggtatagttataattgtgattattacttttccaataataggagcagttggaactgtaacttttaggtgcaaatcaggcagaagtgatgattctataattatagtattgccatctatccaaagtatcttcaaatttaaacacctcatttgtatttatagacatgtacagttaagcattgcattaaagaattcaagtgctatattaccattgatatatgatgtgtagtttgctctgtcatgcagcaaaaaatctatgaaggcgttattaagaagcatgagaatcctggttgattgtgaaacttaaaaaataatctatttaagtgctgttttttcatatgcttggttttagaatatatgctgctggaatgtatgaccagagctatatcacaagatttttgcttactacttagtttatatagactttgttgtttgcgtgtgtgtgtgtgtgtgtatatatgtttatatgtatatatataaacatttaaatatgtgtatttatgtaaacaagtctatgaaacttcataaactgtgaagtatgtattatatatacatatatagatagagatacacagtattatataaaatatatataatagtaacaacaccatcaggtaaagggtaaaaatgtaatattcattttaaagagaagaaagccagtattaaagaaatgatgaaaattgctaaaggcctcacagttaggtaacggcatggagaaaccagtagaaaaaagaatgctgacttggaaaccaattcaggggctacaaaaactaatccgccaagaggcgataaatgactgaacaaaagcagtgatggtagcactggaggacaggaaacattaactgggatattaagaaggtaggattaccagcatttgataattaatgaattacaggctttggagtaggtggaggctagcatacacaaatatttcaaggctttagcagagttcattgaatgggcgatgattctcctcatcagaaaagaacacagctgaagaagtagagaagtagttaaaaatgaggaattcagttttgaatatgagatacagggtacatgggaaatccatgtgaaaattgggaataggtaatcagatacatattcctaatacccataagagagagctgggctactgaaagagatttaaaagtcatcattgtgtattacatcaccatagaataatgtgtatatattatgccaacttcaagattgtgtaagagtgtctatagatggaaaataaagaaatgcagttttacagtttatctaattaaaagctttgaattaattctctataagctatttctccaaaacttctgagcccctttctccctgatttcttaagacgttattgcattcttatctgaaaattataacttttttggctaacaattaattccattttcactatccatctgtataataatactttatatttgaatagtgcctgaggttgaggaggctcttccaccttcttttcacaccagagacctctttctacacattgccgatcacaagggagagtagcacatgtgtaagacagtgtccatgtgcaagagtgttttgcacttttggttcatggcccagatatatcacttatctttacgttctaccttccatgggcacacatttcatgaataatcattcgctgatatttaaatccctttgcctctgtgtcttctgttgcccttgtttggcaaaaccccaactccagtgaactcaattatactcttaccctgtgactgccttgagattctgaaagctacctgaaatgtttacacccaccaggggttcatgatcatcaatttcaagtgggctctcaacattgccattcaatcccaagtttctgtggacagcttaatttgctactctcccctaaatttttggaaacttctgtgctttccttagactggattgcctcacgaccaccacttcacaaaaactgtgtaccttatcaaatcatcttcctactaataaaatttaaatcttaactgcatctccatctgcattgttatctcccatcctatttcaatagagatagtatactgtccatcctcctgttacaaccaattcctccatcctgtactattgagaatcattccctccagcctttcagaaaattacactataagtcattgcttcttatataacagaattctaggtcactaaactaatactgttttggtcattatgttaattgaactgactgtagcagttgacgttgttgacacttttttcttttacaaacgtctatattttcaaaaagtcattatttgagaagtactatataaaaggctcaataaagcaagtataaatcaataaaacaaaactgttattttaaggttgacatttaacaaaaacaaaaaaaccaggtaggaagcatctgctaaatttctgttacatcgttcagtaacagtcttattttttaccagagaagctacaaaatttacatttgtttttttctgtaacttacctaaggctattgctttctcggcttttatttgtccattttttttttaaatccacattgaatgaatgtagtgacatagaaaaacaaaacaaaacaaaaacccacaaaatcctactcacctctccctgccactaaatctcacgctggagagccaaacttctaacttcccttttttgttgttgttgttccataaggttctcataaaatgctagaaaatatctgcacgtcttggttactcaagcttaaacaataactgtttattccttcatttgataagtgtgcataagtttcttccttccattttaatatgcatttttaagtttactgttgcttatcctttaaactttaataatatactgaaatttctactgctcttttaactcgagtctaattcatagctttttatgtcatgaaatgaggatcattttattcctcctttttccttcatctttcctaagctacttttatgttttttttcttctacttgtattttggcaattctgtgcagcaaatacaatcttatcttctatacttcttcttagactaactctataaactggaaaatcaataaatatctacagattattaatatataattatgacttaatatgatatttttccaggtttttaagccacttcctagacatgtatactatactggatgtgtttttcatactaactgaaactttgaattaaatataacctaaagaaaaataaggctaataacattaataagaatgcagtatagtttggatgtagtgtttcttaaagttctgctgtacaaaaacaattagtagtttggataacagtgttcagaaaggaacatgagtcactacagtgaaaatcgtaatgaaggcattggtgtggttaagaaatcacggggagagagtatgaaatgagaagagaagtgactgtaaggtcaagcctgaactaatctacattacattaggagggtaaataatgaaaatcccacaaaaaataatgaggagaaggtagagagataataagataataggaaaaacagtagaacaggccaggcaccgtggctcatgcctgtaatcctagcattttgggaggccgtggcgagcggatcacctgagatcaggagttcaagaccaacccaaccaacatggagaaaacctgtctctactgaaaaactgcaaaaattagccgggcatggtggtgcatgcctgtagtccccactacccgggaggctgagacaggagaatctctggaacccgggaggcggatgctgcagtgagccaagatcacgccactgcactccagcctgggccatagagtgagactccgtctcagaaaaaaaaaaaaaaaaaaacagtagaatatagtgtcaaggaagccaaggggaaataagggtttccataagaagtgggcatgtagttaaacatggtggactggatgcatgcatttgctacctgtcgcccttctcagatcctacaaaactaaatctatattattaatgagaatgctgaaggagaggaagagcatcaccaagtgagacatttccatatatttctgaaagaatgaggaaggattgagttaaagtattaaagaagtggagaaaactaaaacacagaataaagtgtaaggggtctaaagaaagggttgaggaccatatgcccaatggaagcttgaggacattctgaaatcaaagttagcactaagaagggatgtaagaaatgggattcaataaaggggattgaagacataacacactgaacaactatttcaataaaatgttgaacaccttttccttctctatcgctatatgcaaaaagtccaaagactcatctcttaataatatgaatgagctttccgtggaaagatgaagttttaaatgtcaacagtggcactctagtgcaaaactcttattctagcattcgtatgccagcagcctgagagccagctccctgtcctcacaccaaagcagagcctggtcatccacacaccccattcagtcatgacccccacacacctcagtagagaaccaattcttcagacacagcatcaggggaactcacaccaacttgcaaaattttcgatatatacgtagagagacatatagatagatatagttatatatacatatacacacacacatatatgcaattctaagttaatagttactgttgaaaattcttgtgcttatagagtgattacaaaattcatactaagataatatgaaaaaacttgaaacataaaattactctaaggaagacgtagattagaatggaattatttttattcaaaaactgtttttattataccttaagttttagagtacacgtgcacaacatgcaggttagttacatatgtatacatgtgccatgttggtgtgctgcacccattaactcgtcgtttaacattaggtatatctcctaatgctatccctccccctccccccaccccacaacaagccccggtgtgagatgtaccccgtcctgtgtccatgtgttctcattgttcaattcccacctatgagtgagaagatgcagtgtttggttttttgtccttgcgatagtttgctgagaatgatggtttccagcttcattcatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttggttatatacccagtaatgggatggctgggtcaaatggtatttctagttctagatccctgaggaatcgccacactgacttccacaatggttgaagtagtttacattcccaccaacagtgtaaaagtgttcctatttctccacatcatctgcagcacctgttgtttcctgactttttaatgatcgccattctaactggtgtgagatgatatctcattgtggttttgatttgcatttctctgatggccagtgatgatgagcattttttcatgtgttttttggctgtataaatgtcttcttttgagaagtgtctgttcatatccttcgcccactttttgatggggttgtttgtttatttcttgtaaatttgtttgagttcattgtagattctggatattagccctttgtcagatgagtagattgcaaaaattttctcccattctgtaggttgcctgttcaatctgatggtagtttcttttgctgtgcaggagctctttagtttaattagatcccatttgtcaattttggcttttgttgccattgcttttggtgttttagacatgaagtccttgcccatgcctgtgtcctgaatggtattgcctaggttttcttctagggtttttatggttttaggtctaacatgtaagtctttgctccatcttgaattattttttgtataaggtgtaaggaggggatccagtttcagctttctacatatggctagccagttttcccagcaccatttattaaatagggaatcctttccccatttctttttttgtcaggtttgtcaaagatcagatgattatagatatgcagcattatttctgagggctctgttctgttctgttggtctatatctctgttttgatactagtaccatgctgttttggttactgtaaccttgtggtatagtttgaggtcaggtagtgtgatgcctccagctttgttcttttggcttaggattgacttggcgatgcgggctcttttttggttccatatgaactttaaagtagttttttccaattctgtgaagaaagtaattagtagcttgatggggatggcattgaatctataaattaccttgggcaatatggccattttcacaatattgattcttcctacccatgagcatggaatgttcttccatttgtttgtatcctcttttgtttcattgagcagtggtttgtagttctccttgaagaggtccttcacatcccttgtaagttggattcctaagtattttattctctttgaagcaattgtgaatgggagttcactcatgatttggctctctgtttgtctgttattggtgtataagaatgcttctgatttttgcacactgattttgtatgccgagactttgctgaagttgcttatcagcttaaggagattttggggtgagacaatggggttttctagatatacaatcatgtcatctgcaaacagggacaatttgacaattcctcttttcctaattgaataccctttatttccttctcctgcctgattgccctggccagaacttccaacactatgttgaataggagtggtgagagagggcatccctgtcttgtgcccgttttcaaagggaatgcttccagtttttgcccattcagtatggtattggctgtgggtttgtcatagatagcttttattttgagatacgtcccatcaatacctaatttattgagagtttttagcatgaagattgttgaattttgtcaaaggcctttttctgcatctattgtgataatcatgtggtttttgccgttggttctgtttatatgctggattacatttattgatttgcgtatattgaaccagccttgcatcccagggatgaagcccacttgatagtggtggataagctttttgatgtgctgccggattcagtttgccagtattttattgaggatttttgcatcaatgttcatcagggattttggtctaaaattctcttttttttgttgtgtctctgccaggctttggtatcaggatgatgctggcctcataaaatgagttagggaggattccctctttttctattgattggaatagtttcagaaggcatggtaccagctccttcttgtacctctggtagaattcagctgtgaatccatctggtcctggacttttttttggttggtaagctattaattattgcctcaatttcagagcctgttattggtctattcagagattcaacttcttcctggtttagtcttgggagggtgtatgtgttgaggaatttatccatttcttctagattttctagtttatttgcgtagagatgtttacagtattctctgatggtagtttgtatttctgtgggatcggtggtgatatcccctttatcattttttattgcgtctatttgattcttctctgttttcttctttattagtcttgctagcggtctattaattttgttgatcttttcaaaaaaccagctcctggattcattgattttttgaacggttttttgtgtctttatttcctttaattctgctctgatcttagttatttcttgccttctgctagcttttgaatgtgtttgctcttgcttttctagttcttttaattgtgatgttagggtgccaattttagatgtttcctgctttctcttttggtcatttagtgctataaatttccctatacacactgctttgaatatgtcccagagattctggtatttgtgtctttgttctcgttggtttcaaagaacgtctttatttctgccttcatttcgttatgtacccagtagtcattcaggagcaggttgttcagtttccatgtagttgagcggttttgagtgaatttcttaatcctgagttctagtttgattgcactgtagtctgagagacagtttgttataatttctgttcttttgcatttgctgaggagtgctttacttccaactatgtggtcagttttggaacaggtgtggtgtggtgctgagaagaatgtatattttgttgatttggggtggagagttctgtagatgtctattaggtctgcttggtgcagagctgagttcaattcctggatatccttgttaactttctgtctcgttgatctgtctaatgttgacagtggggtgttaaagtctcccactattgtgtgggagtctaagtctctttctaggtctctaaggacttgctattcaaaaactttcacatcactatttgatctctcttcaaaaaatatgattgaaaagtacgttcataagaaggacactttcctgaatgttttcctaagtagatggcacatattaaacacttgttctgaaaataaaaatagaatatatattgcaccacggtcagctgaaattcctgctgggttttagaaacctctcaatgcagagataggcattacaatgaatgtttctgcaaatgtggcaaatgcctctgtaggggtttgaatataaaaattatctttaatctgctgtgaccatagagctggctaaaaaaaatcatttcaagaacattgtgtttttacacttctctgaaaaaatgtagacctttctaaaaataataagggacatatgcaaaggcagtatttttcctttcaagtagaaattgaattttacttaataactctctcttataaaatgtattatcttagctttggttcccctaaagcaaagctgggaacaaaaattgcttgtaggtagtttatttcaaatttatccccagagagcaggattaagagatgtgatggcattgataggtgaagccagaggagagatgcattacagagatgaccgcttctacaggcatcttgagcttgagcccacaggaccagagccttacaaaatgcactcagaatggtcaccttggagggtgtattgatggactttcatctcccattcccagagtgtaattctcttagcacttaactctcttgttctttgaggttgccctcaagttgcagctttgtgaaactggttgcacctacatgaacctggttgcagtagcatttgtaggagtaaaacatctggtcaagatatgttgaactagcacacaagaagtatctgaaacatagatggtagtgagcgtagatcattttcacagccctagcacacatttcttagagaaagtgactccttctaatacttacataaattcaaatatcctaatgttgaacaaaaaaagttgactttctgttatttattcagtttatatgttgcttccattttgcatttggtgacatatatatgaatatgtatctgtggtagggaggggctttagaggggcttgtggactagtgagaaagattattactgtacaaaatgctgtgatagattgatagatatatgttactttggtaacccctaatagaaacatccaacccagatgatacataagagaatgcttcctggaagaggtgatatctgagtttagttttgaagtaatttggtattaggtgactaaataaagagaggatatttgactatccatcaagtacaagtatagaatacacagactataataaaattgcacttcagtccagattaactaaaatgcaaggctatacgaaggaacagaatgtcataccatgaaatgctttgttgaccatattaccaaagcagtggtgaaggtttggaagatttgaagtgcgtagaaacacaatcattttcccttactgacatggtgaaaaattattctcatgcattcacaaatgtgtattgtctgcctattatgtatcaggtattttgttaggtacaggggatacaatggagggtgaagcaaacgtaactatccttgtgtagcttccaatccaatatgaggtaggatattcccataaaaactgacacagattctgtctgtaaccgcgcactctgggatttgcctgtccttgttcagcatcctgatgaggccaagctcactattattgcactaaaaacaagaccaactccaaaaggatttatgagtaatacagatgtttattaatgtcttggagggtaatgtatgaggcgcttgcgttccacaaaacagcagaatttattgaacactccccattaaccacatctaatttttccgagccgtaattcctcaacagctataatttcttcctcaaacacctgtgcctctccctgtaacagtgttgcttccagtctcccttcagggtcttactacctctgtcttacttggcaattttgtaccttcatttttccactcatttgagttcccagcacagttgttaattactttctaaaaacttatttttatttaatctacacttatgttttctgcatgggaagcactgttttaaaaatggtacaagtattaaagtaaaaatgatggaaaataaatgccaacaaatattaactaaaaagaagttgaggttgctatattaatatcctgtattaagcaaagatatagcaaagctgtacacatcttcgcaaaattcaccatgtacacaaccaggcttctcacctttctttcagtccatgtgggatctttccctacaagatctcactacttcctaaggcaacattttcccatccgtctctggagttagatagtgtagtagagagatttcaattagtaacttaagaaagtgagtggaaatagattgagaatgcgtgttgaaagattactgtttattaggaaattcatcagttgtcacagtgggggaaaaatgtagaaaggctacacatgtagataatctactatttggtggtggggagtctatgattttcatttttaattaatgaactacaggcaaactaatcagctgagaatgtatgtgtagataacatgtttattttaaggaaagaattgtgtcaacatggaaattctgaccatgattacctaattacattaggtaatttgtctgagacaaagcacagagagaatggatctcatgttgtcctctgtgatccctgagatttggtttggtactcaacaatggaatgtagcaaagccactgttatttcctgattagtctgtttatcataaaggaatatggtaattggaatagctttgggtacttttttttttttttttttttttttttttttgtatttcccttctaagtgctgctcctcgggtactgaatattctatcctaaatccaggagactttttctttctctaatcttggttcagaattttcaattatggatagttctaaggggactgggaaagttttgacaggaacactcctattgggatacatttatctctgctaaggaagctgaataatataaaaagtttgtatcaaactctgcaggaatatagaaaatttggcttttgttaatcttttatttatttttctatgtgtctctctggaaagcttataatcttgatataaaaatttaaattaaaacatcaaaaaaattttggacgatttttgaataagatgaatacttcatttgctcacatgtccttggcaatcagtcattccatacaatccaatttcttcctaagcatacttaaaaaacaacttgaatttctgtctataaagagaattttttatcagataaaacagtgtgcagcattttatgaactctctcaatttgtcttgaaaccttgggagaattacttaatacgtggtaacaaataacaagatgaatttgctaaatatatatctaacttagtctttttcttgatttcctatatgattgcctgtcattgtaattcagaaataaatttctgaaagacataaacttttgataactggcattgtaactatgaacacatctttcttcatgaaagaaaggaatgtgaactttgagttgacttttgcagtggtggcaaagatatattcacttacgtttatctaactttttttaatattcagatttcttgagaaactacttgacactcaattctgctgctgctatgcctcttcttccatttaataatctctaattgggcatggggcctcaccatacaactcacagaattttctctaaactagtcaggttacttttaatcaaaggtgtcagcattgtctcagccttcattattctgaccgctctgtagtccatgtacaaagctgcaaatattttcttttcatctttcctggcagtttgttctcccaaactctttcatttgtacctttcactgtctcttctcaatctacccccaaatcagtcattccatgtacttatccatttatatgtctgtccacccagtgtgtcttatttgcacttggcctttgttccatgaagaatttaaggaggcttatcttcttaaatgtaggtgttctttcaaaactccactcctcacccccatgatatttttaaatatttttttctttagtgaatacttctatctctgttttgaatttagaatatcccacaaactaacttctgcagctgacatttgtgctattaattacattacctttctcctagtcatcaaacataaacatttctgggtcaattagactcctaatctcatgatcacttatgccataggttctgcaagcactgtggattctacatctgcaatgtcattcttagccattcctttcttcccacttctaattccaacactcctttacctgacacccatatcagtggctttgaactccttctttctgtagctcacttaagatgaatagtattcctatccaaaacacactgtcaaaaacattgccatattctagattgtagcaaagaagtgaggccataagtataatatcataaaactaattgtaacgccacttattgaatgcaaattcacaagagtgacatgattacacaaatttaaactacaatctatttgcctaatttggtttaaaatacattggtcacaaacttgagtttaatttattatctacttaatcttagacaaccgactttacctgtttatgtctcaataatgaacatggggataatattggtacttatctgatagggttcctgtgaggatgaaatacatgaatacatccaaagcacttagaaaagtgcctgttatttaacaaactttagtaaaggttagctattaacacagtacttatcctataattcccacagcattttacttgtgcatgtgttgcgggggaggtgcgggggtattgcagtcagaaactacttttctagatgattggtaatattgtagtttttgtcattgctgttgttgtttattgtaaaaacgtaaactcccctgtcaagaattgagattttaatagagataaaggggatggatgggcggtaacattgggaggagctttatagtccattacttgccttcaatagtttttcactccaagccttcctcacagttttctgactccataatttttctttctgttctgtcttcatgaagtaccctcttaactcctagctctgtctccaagaatgcaaatgatttgccaaagatcatgaaattagttacttacaataaactggaataaagcctaccatataataagcatagtttagattttattctaaaagcttttccttatgcttgtccatattgaaattcatctgccactttcataataccacccacacagccttatgatatctccatgcaaatcgtatttaccagcttgacatttcactcactacccagtagagctcagtattacctgagatgttgagaattttattcaccctttctcatgttaagatactttacaagaccgggcatggtggttcacgcctgtaatcccagcactttgggaggccagggcaggtggatcatgaggtcaggagatcgtgaccatcctggccaacacggtgaaaccccatctctactaaaaatacaaaaattagctgggcgtggtggtgcgcgcctgtagtcacaactactggggaggctgaggcaggaaaatcgcttgaacccgagaggcggaggttgcagtgagctgagatcgtgccactgcactccagcctggtgacagagtgacactccgtcacacacattaaaaacaaaaaacaaacaaacaaaaaactctacaaaataatcaacaaatgccagccctaactcgatctctaaagactatgtcattttgccaacacatagcttcccgtatctaaggtatttcgctacccatgagaaaacattattctcccacagattgaaattatataaatcgaaattatggtcaaagaataatgttttgttatggctaaagtttataactcactaaagactaagataatcattagcattatttagcaataaacatttttaaattataatatttaattttaaaaaaatttatcaaaagattttaaaagtctgcataaattatatctagcaggccagcactcaataatgtgatccccaaacatttgtatcaggataattgacaatgcttaagaaaaaaaaacaaaaaaaacgggtgggagcggtggctcacgcctgtaatcccagcactttgggaggctgaggcaggtggatcatgaggtcaggagattgagaccatcctggctaacacggtgaaaacttatctctattaaaaaaaaaaaaaaaaaaaaaaaaaattagccgggcgtggtggcgggtgcctgtagtcccagctactcaggaggctgaggcaggagaatggcgtgaacccgggaggcggagcttgccgtgagccgagattgcgccactgcactccagcctgggcgacagggcgagactctgtttcaaaaaataagtaaataaataaataaaaataaaaaaatgtaaaaatattgggtcatacttcagatctgcccagagtttctggggcagtcctagaaagcagccttttttcactccagaattgtgtaaggtgaataaatcagcaagaagcactttgtttggaaatacaaggcgtgtccctgcgcctcaaccttaccaggatacaagagcagccctctcccagctgaaagtactaggaatagttaaatccacatgctctctctttctaaagttgagaagcacttccatttccactgagttgtcaggtcttcccagaaccacacccagctagcagactatgcaatgtctcttagagtgttcagtgaccttgaaaagcagagtccttcagaaaatttccgaagagaatgaaatcttgaacctactctttccctgggaggcctgaggagaaccagggttttcaaatgcaccatctggacatacctagagagggccatcttgtttgtggtatttcctcagagagaggattggaagaggattggaagaacgagaccagttatgatctgtatacaaattatcctcaccccatatatcttaggaatctgcattttccacagtactcccagatatttcacatatattcagtatattttaattgtgtgtacagtaaaatgtactgagtgtttccgtacatttccatggtgagaactaatcattacttgcgacatgtttttttaaaaagatacatatttctttatattttgaaatctcacttttatactagatagggttgcctaaaaaaaggtgaatgaaaggcgataacaaaatcgtgttggagggaatctcactaaaaatacagattcctggttctcccttagatattctgatgcagtcagtctgaagtggagaatgcaggtaattctgacaagcatcactaggaatttttatattcagtcagattatgaaacgtctgacattttatctcaattagtaactgtggctctctggggattttcaggtggtcgcagtatttctgcagttggtcacttgtcatgtatttaattcctagtttttgtgggcctttaaggtaattatagaaatttagattaaaatgtttatttgggaggggtattctcataattgagctgccataggtgatagttgttctttccactttgcttcgacagtctttcttttgttaataagagagcctattttcctatggttttcagttttccttatcatgccttgcattgccattcttaatatgctctacctgatttttctctgaatatccagtaaggtatttaaaaataaccttaaggcttcctgtgaatcattttaaatgatttccttccatttttttctctctgcactaattctcacgttttgtctcagttaatttgtctaaaattgagtaatgtatggtggatattttatttccattatcctgcaaggattctggatttattattttgtgatcatttttattatccagtattaaaaatcacgtacaggatattgaggattctaaaactacttctggaaagtaatttgtaatatttagaagtgtttcttccagagttcactccaatgagatattttgcacatttaccataaaataacaagacatttatttcttaacaaatgtactgagcctcatatattcaaatgagtgttgtgtcttcaaagtagacatactgagaggtaattcagttataccaatataatcctgccattattcaaaatattttaaaactcagtgattcatcttgctattttataacgctcatctttggagctgtagaggagagatagcaagctgcctaagtggaaggcttgataatgattaacattcttcctttgcaccagccactatgctaaaagcatttcatacattctttcatttagtcatcacagcaaaacagcattttgagcttatcttttttttctaggtaaagaacctgtgatttagacaggcagcaagtcctattgctcatgcttgtctgactgcaaagagtacacgcctaatctttatactttattgctcagttaacatcagttaagggacaggcacaaggtcatagttggtgagaggtctcgagctacagatctaactcacggtgattgttttatctactgtatcatcctgcctcccttaggatatcagtgctacattgggatattggattaatttcatcaatattaccagaaatcaaatttaaagggtgtggttagagatgatccttacagaagtaatcagtattagttcctgcccagtttcattggaataaatgtcatgaaggatattcttctcacttctgcaagaaggaaagaatccatcaaatttatgaaactaggaagactatatggagcaacccacataagtaaaattggggttatggtgatctgtcggaatgacagaattcatctatagggaatgtaaggttgcctgctacatagtgtgttaattatctgtcaaattatctatcaagagaatgcagagactaattttcttaataattagtagagtctacttaatattatagcatgcttttttctttaaatgtaggttttccttcacagtgtcagagtgttaaaaatattggttataaaggaaaaaaaatatgctgaatccagaattttaaagaatatttacatcatccacttgtttaataaataaatgaaagccaacataaatattttactgtcatcctaacatcatggtgatcaaataacttgtagtacaaattttacagatgggcaacttgcaaatgattcatatgtataaatagctgcccttccacaagtcggccattgccgcaggcccttctgattttgcctttgtttaaataaaagacatagcctcaagaagcttttagagaattggaaatttagaggcaaaggaggaaaagttttttttttacaaaaaacataagaacagttttggcgctttaaggtttaatgggagtccaccccttgcagcagcatgctctggatgtgagacatggagtcattggagattattttggagcttacgttttaatgactgcctggctcgttttcggacttgcatgaggcctgtagccccttggttttgaccaatttctcccttttggaaagggagcatttacccagtgcctgtacccatattgtgagctctaagcttagaaatggattttaaggtagttttggcaaaatgcggcagacccattgtattagcccattctcacactgctataaagaagtacctgagacagggtaatttataaagaaaagaggtttaattgactcacagatccacgtggctggggatgcctcaaaaaacttacagttatggcagaaggtgaaggaaaagtaaggcatatcttacgtggcagcaggagagagagatcgcgagttgggaaaagccacacctttgaaatatcagatctcatgagaactctaccacccccctgatccaatcacctcccactaggccctaccttcaacatatggggattacaatttgagatgagatttggatggggacacagagccaaaccatatcattctaccgcggcccctcccaaatctcatgtccttccacatttcaaaaccaatcttgctttcttaacccatcatgcttttcccaaagtcttaacttattccagcattactcaaaagtccaatccaaagtctcatctgagacaaggcacgtcctttccacctaggagcccgtgaaataaaaaaacaagttagttacttacaagttacaatgtgggtataggcactgggtaaatgctcccataccaaaagggagaaactggtcataaccaaggggctacaggccccatacaagtccataaaccatccagagagtcattaaatcttaaagctccaaaataatctccattgactccacgtctcacatccagggagtgctgatgcaaggggtggaggcccaaggcctttggcaactctgtccctttgtctctgcaggatacagccctcttggctgctttcacaggctggcattaagtacttgcagcttttctaagcacatggtgcaaactgttggtggatctagcattctggggtctggaggatgatgggcctcatctcaaagctccactgggcagcatcccagtggggactcttgagtggggcctccaaccctacatttcccctttgcattgcccagtagagatgttctatgaggtctccacccctgcgtcagacatctgcttggacttccaggcatttctaagcctcctctgaaatctaggcagaggttcacaaacctcagctgttgtattctgcagacctacaggctcaatgccacgtggaaaccaccaaggcttggggctttcactctctgaagcaatggcttgagctgtatcttagcccgttttagccatggctggagctggaacagctgggatgcagagtgccatgtcccgaggctgcacagtgcaactggccaccaggcatggcctgtgaaactatttttccttcttagccctgttatgggacaggctgctgcaaagacctctaacatgccctggaaacactttccacattgtcttggctattaacatatagctcctacttaagcaaatttctgcagctggcttgaagttcttcccagaaaatgggtttttcttttttatctcatggtcaggctacaaattttccaagcgtttattttctgctttccttttaaacataagcttgaatttcagaccatttctttgtaaactcatatgactggccacttttaaaaacagccaggtcacatcttgaaagctttgctgcatagaaatttcttccaccaggtattctaaataattgctctcaagttcatagttccacagatatctaggtcagaggcaaaataccaccagtctccttgctaaaatatagcatgagttacctttgcaccagttctcaataagttcctcaactctatctgagaaacctcagctttgactttattgtccatatcactatcagcattttggccaaaaccattcatcaagtctccaggaagttttaaactttctcacatcttcctgtcttcttttgagccctccaaactgttccaacatctgcccattactcagttccaaagtcacttccacgttttcaggtgtctttacagcaatatcttactcctggtagcaatttttatattagttcattttcacaccgctatgaagagctacctgagacttggtaatttataaataaaagaggtttaattgactgatggttctgcatggctgagaaggcctcaggaaacttacaatcatggcagaatgcagacagacaagaagcaaggcatgtcttacatggtggcaggggagagagagagtgaaggtggaaatgccacacctttaaaccatcaaatcttgttagaactctcatgagacagcactagggggatggtgctaaaccatgagaaaccaccaccatgatctagttacctctcatgaggccccgccttcaacatatggggattataattcaacataagatttaggtgggggcacagagcaaaaccttatcacacattgtcaaagatctcttgctccccatgacataacaaatacactagtcaggctaaaattccactaaattgttgtttaggtgaataagaattatgttattaaaaataaggttcaacaatgagaatttcagtgcagtaatttcactttactgtattttggttgaattacagtcatgtgctgcatagcaatgtttcagtcagtgatggaccacatatatgacagtggtctcatgacattataatggaactgagaattccagtcgcctagtgactttcagtgtaacctgtgtaggctaggctaatttgtgtgttgtgtctttatttttaacaaaagaattgcaaaagataataaaaattttaaagatagaaaaaagcttatagaataaagatctaaagaaagaaaacatttttacagctgtacaatatgtttgtcttttaagctgtgtcataatgaaagagtcaaaaagttaaaaataagtttataaagtaaaaatgttacagtaaactaaggttcatttattattaaagaacaaaatatatttgtgattaacttaatatatcttaagtgtgccgtgtttataaagtcaacagtaatgtacagtagtgtcctaggcttcacatccgctcaccactcactcactggctcacccagagcaacgtctggtcctgcaagtgctatttgtagtaaatgccctgtacaggtgtaccattgttatttatatcatattttatcataccttttttatgtttaggcacaaaaatacttaccattgtattacaattgtctacagtattcagtagagtaacatgctgtgcaggtttgcagcctaggaacaatagggtataccatatagccgaggtatgaagcaagctatatcatctaggtttttgtaagtgccctctgatgttttaacagcaacgaaattgcctaatgtcgcattaatcctcatcactaagtgacgcatgactgcttattttatgacatttaacattgtactgagacagcttcccaaagaggaaaggaagttggtttatatgggaagagaggtaggatagaattgtgatgatcatcatcagagggctttggcatcatttaaagaaatctatttgtgtttttctataaggtcaggcagagagcttttgaggtaggcttaattaggttgctatcccagttctgccccgctttaactatgtgacccactctctctaaactttagattcttgattcacgtaacactgtttctctctccttttgaaattgatgtaaagattagaataattataagtgtaaagaatctggcatgcacagatttttgtttcatttcgttttcttttttcttttggtgctggggattcaagaatggcatgccctttgactctcgaagaactcatgatctagtagaggagatagacaagttaatgatcctgtcaaaagaagtcatgccacaatgtgtgaagagtaaagaggtatcatatttcagaggtacaaataggacaggaactgaactccacagggcccttagaagcatttgcacagaggagttgacatttgagtacagtgctgatgaaagaaaaagagtttgtgaattgccccaattctgggctggcattgcagacagagggaaaaacatacaaaggcactggggaagaaaagtaaatgaagaagaagtagaacatccccaaaccaaaaaacaaacccaccttcatcttttatgtttttgtgtgaggcaggcttctatgaaggatacatgtatatggaggggaggtagtttactttttcttctcttctttaccataagatccttgctcctatgtcctagtacccaaaataactatgttagtggtatgaactgagttcttcatagtacaagctcatagttcataacttagttgttatgaactaagttgtattttgtgtgttaaatagcaacccaaccactatttacaatattctgtagaaaaatgtctttggatccaaagcactgatatactgcagaatacatggaatacaattcattcattattcatcattgtggagaagagcatggactctgaagccggacttcctgaattcaagtcctggctctggcatttaagagccatgtgactttaggtaacttttcaacttccatgagtcaaaccaattcaaagggttatgaggagtagagttgttatagctaaaggagttacaagggtacctaacacatagtaaaccccatataagtattgggtattattcatcattagtcttgtaacaatgattagtgcataacctgaaaggtaatgctagacctctagctgtcattttaggtattaatttctctctggaacttaagaaagtttttgaaaagatgactttaatgtaagggagaagtggattccagccaacaaaaatcaaattaccagctatttaaaaatccaattaccagctatattttaaaaatcataatacaactagaagcaacaagacttcatagattatatgtgaatgtataatgaaattgcttgcttcctcaaaccttgatgttactaaacttatttaagcctgtgaaaccagcaaatttgttgagctgagataggacaatttgtacctcaagcaaatagatttccaaagacttttcagggttagattcaatatttgtgtaaccggtgtattagcaatgaatacttactgtgggtacagccctgcttctgagatgcttctgaaagcatttgatcgcgcacaaacagaactaggacgatttgcaaaggagggtcccttccactataaatattctgattacttcttttttgaagaagaaaaagtacgtattttgcagtccattaaatagcagttcccagttgctgctgccttttaatatgaatatagtcaataatttatttgatggtaagattctttttgttttttatttcagcttaatacctgataatatgttcagcctaaaaggataataaggaaactgattaatttagtcctcttattatatattgccaagacaaaattgattcttttatgaaagtgaaaacaagtactttgtgatttcttcatcctcattaacaggcttaagatagaatttcattttatcaatgtcaaagagctaaaatacctttaatgattgaagtataaacagaaaagcaatatattaaagggttaatctattttaaaagtaactttttttcatatacacatgaatacaaccatatataatcaaaaattgataattcaatctacctgtattagttagggttttatagagagaaagagccaataggatatatatatatatatatatatatatacacacacacacacatatatgaaagagaattgattagggaaattgattcatgtgatgatggaagctgagaagtcccatggcaaaccatctgcaagctaaagaccctggaatgctcatagtgtggctcgatccaagtccaaaggcctcagaacccaggaagctgatggtgtaactcctggtctgagaccacaggcctgataacccagggggaccactggtgtaagccatggagtccgaaggccaggaggcctggagctctggtgtccaaaggcagtagaggagaagtgtatctcatttccaggaaatagacacatgcctttcctctgttattgttctgtctgagtcccaagccaattgaatggtgcctgcctacactgagggtggatctttcccacctagtccactcagattcacatgctagtttcatctggaaacaccctcacaaacacaccccaaaataatgctttaccacgtttcttggtattgcttaacgtatccagtcaagttgacacaattaaaattaaccatcacactctccaaatgatactgaaatctgaaagttcttatgaggaattggtgaaaatcctagaagttttgtgatgtcttcctggtcctgagtaattataaattctttaatgtatttgaggattggtcatcattctatgccataagtataatcaatgtttaaaactagctcttatcactatgcttgtagcagagtagaattatctatatgcaaataacttaccataatcagagcccatatcagccaaaactaagtgtgagatgaggctctagttaacaataaattatctcattagagaaacaaaattgcagtcatacaactttactaagtagataggaaaagtgtaaatagtaaatgcctaggagtttgtaggatggatccatcgatgtaattatatacagctaaacataattactgtggttatagaaaatattcttgaggaaaaggaatgttatctagccttgttaatggagaatacttgagtgcatatataagctgataacttcagtgaatgactaatgaacttcaaacgaatgactaaagctatttagaagatagtctgaacagagccggggctatggtagtcaagtggaaactaaggttgaagaattagcattggggcaggttttcaaagatttgcatacaaaaataaagagcttgaatttcatcataaggcaacagggaaccactgatgttacaagaaagaaaaataaatgataaaaatgctattttagaaagataaatatgaagtcaaagtatagaatggattggggtaaaaagacagctggcaggaggctgaatacaccatgataaaggcaaaggtagtgaaggttttaattagaattatgtctgtggaaagaaaaaagaagcaacacagagaagaaatactgaaaagaatacaggtattatgaaatcacagtttgctcttgaaacagactcaaacttaaaactaaggaaaatctgttctgatcagaaaagatccaagacaggtcaaatttatttattttttatgtatttgtgtatttttttgagatggagtctggctctgtcacccaggctggagtgcagtggggcgatcttggctcactgcaagttcatcctcccgggttcacgccattctcctgcctctgcctcccgagtaggtgggactataggtgcctgccaccacgcccagttaatttttttgtatttttagtagatacggggtttcaccgtattagccaggatggtctcgatctcctgacctcatgatccgcccacctcggcctcccaaagtgctgggattgcaggcatgaaaattttaatagagaaatgaagtcacatagtcaatgagagaaacctgtggaccatggagggcccaaagagtaacaggtagccagatagaagttaataaatccatgatcagtcacatcaggtgcaaagaataaacttcatttcttcactgctggaaactacagtgcagtgaaagagatagacaagtaaacaacattaaaatgcaatgagacatgtactaagataatgatttgaactttgtactgtgaaaacaaagaatagagtgaatataattattctaaagatggagagatgaatttgagtatggttttaaaagctgaattatagtttattaaacagagataaggtttaaaaattacagggaaaggcaaaaatatgtggctgtaaagtgtcatggttagtttatggagtggagaaaagtgttgtgtagctaaggtgtgagatttgtgaggagaggtatcagtaagtataggactgacaagagaagtaaaatccaaatttggatgggctcgaatgcaatactaggggattcaaattttgccttaaaacattattgagtagacagagtcctttaattagtattgaaaaggtttgttatttttgttgtttgctgtccctttttgcttgcttacttgctttcagcacaaaaactctagtagtagtaggaggagaacagatgaacagattaaagggttgatctagagccctgaaaggacttttggagaaagacattgattgacaatatgctaccatttcattctgttgagtaatgaaagccaaatagatatgattttggaaaagcagttttattatgatgagtgggtagggttaagaagaatacagttgtacaataagatgtgtttgcatatattggcctgggggttcaaaggataaattaggaaggcatcagaaacaaagaaaaactaaagggaaatttgcagtagagtgggttagataggagcattcagatttgatgatgatggttttgaccagtaagataatttaaataactgtatcataaggcagaacatgattggtatcataagaaataaacaattatgggcagctgggcatagtggcgacacctgttaccccagcactttgggaggctgaggcaggcagatcacttgaggtcaggagtttgagaccagcccggccaacatgatgaaaccccatttctactaaaaatacacacaaaaaattttttagctgggcatggtggtacatgcctgtagtcccagctacttggaagtctgagtcgagagaatcgcttgaaccaaggaggtggaggctgcagtgagccaagattgtgccacagcactcccacctgggtgtcagctagactccatcacaaaaaaagagagaaagaaaagaatgggaaagagagaaagggaagggagaagaggaagggagaaaagaaaatgagaaaaggaaaaggaaaggaaaggaagaaaagaaagaaaagaaaaaagaaaagaaagagaaaccacgatggggaatctgcagtaaggcacaagatttcttgcgggaggaattagagaaggttgttttctgttgtggtgatggtgatgatttttttgtttttgtttttgttttcattttggtggggttttgaggggtgggggttggcttctggtttttaatgaaggccctatttttgtgttccttttaaatgtttttataagatacaatttgaagtgaaacataaactgaattttagtatgcatatgatcttattgagatatttttagacaaggaccaatagcatgtatacaggctcataatacatttagaatacagcatatttggaaaatagcaagcactcctattacatggaatgttgcatgcataaatgggaagaatttgaggcaaaatatggaaagataacttaggactagaacattggagctgatgcagaatatttcatgaccgctttgtcagacttgcaacaggggcgccccgtttactcggcccactgtgctcaaccccttacagaagggagcatgtgagtaagtgagtgtggaatccttccagccactgctccaggtgctggcaggagcgagctccatttactatcctgcggcagtgcccaggtgagggtgcctgcaacggtgaagctcaagaaggggtgttacaatgacttcttcgctccactacccatagagtgcagtgtattatcagcttacttagccccttgcctcatcacatgggatggcttccctctgctggcaagggcaaagggtcagtgtgatggccatttttgggtccctgtactcggtggttcctgagctcttgtccagcatccaagaagaataaggtcacacagacacttgaaggatggcaaaagtggataattttatttagcaatggaaatggttctcagcagacaggggagcaggagaggggacaggacaggcaggcagtctccccacaaagtccagctggatcttccctgaagtcaagttgtctctgctctgaagtccagctgtctctctgaagtcaagtcacctctctatcctctactgactgtgtctggggtctttataggcacaggatgatgggtagggtgggctataggtagttttggaaaaggcaacattcagttggtaagaaggcgtttttcagaaagaaccaattgggaaagagagggcagacaggaatagaagttttcactttgggccatgggtttcaggcttttcagcttgaaggtggagtttcaccagggacctatccctgtctgcctcctgcctctatcaaagccttcaagtggaagactaaaacatttagacattagtgagtaaagcattcatgacatccttttttagccattgtaatcatccgtcttttaataacccctcatcttcctggcacggtcttcctcatttattttattcagtcaatgtcttggtgataaccatatatacatcaatgatccatccaatattatgacttctcagtttctttacctccaagcttcccatgaacttgtactccatcccatcttagccaccctttcctgtggtaatagcctgaatcttgtgattatcaattattctaccttcatcacaatctcaatttcaagtaagccattttctgctgaaagcctcttttccattcaaataattatgtttactacttccacttaaacaatcatttggccccttcagacctctcattccttttatcagttcaccacttcactgtccatcataccctcacatcctcaagtgccttccctttctaggtgagattacatagtcacttattgtaaactttctcctctgtcagctctcaactctctatcccatcaatctcttgatcatgtaatactcacttggcaaacctcttacctcaacctcagcctatgccccattcatttcatgattatatccatatagctgagtatagatagaaaaaaatacataattttgaacaccgattttgccttaactttatattcttatttacctttcagtgacaaatataaggtcttccctatgtctttatctgtatgactgctacaccactaattacaaataataaactgttcttgacagttttgtgccctagactccatctcttcttacctacatcaagaagttgtcatctgcaattatttaccctctcttgcaaacatcacatttccctccatcctgaatcattctcatcagtaaacatgctagaatatttattatactgaaattaaccattttatgatttcatagctccctccaacttccatcctttttttctctgctctccttgatagcaagacttcgtccaagagttgtttaaacccatctcaaatttctattttatgttttcttatacctaatcctatgaagctttaataaccaccattattgcaaatgtcaccaaggatcttcacattgccaaagctaatgggatagatgaaagggaatccaaaataaagtaatggcaattagaataaaaataagggaatgaaaaagagagatgtaataggaatcaaattgacagaacttgataattgactgattgcggagaaatggagagaacatcagcttattcattcacaaaatgtgttttattttttaaaatatcccaataatttaaaacaaaatatagattttttcataattccagattagaaaattattttaagtatcccacaaaacaaaaaagaacacaaacattgaaatacaaaaaatgaaatattccctagctcctatgccacctgtcacccacatatatagttgataacaagtagattcactaattgtcatcaaatattcttgaccattaactttgtaccagggactgtgtgaggatccaaagggaacaaaatgatgtggttcctgtcctggtttagtttacagctaaaagtgaaaacagatatggaacaaatgggtagaaatgccattagattgaataattgattgagtctgattggttttaccaaaaaaagaaaagaaaaataatgaacaatgctatttctctttatatatatacacacacagtattcatatatacataatatatgcacatatatattttatatatatttctttctccatatgtgtatatatttacattatatatacttgcattatgtatttatgaatatatatatatatatatacacatacacacacacacatacatatatgcacagagagagaggaaagagattaacttggtgagagaagtggggtggtagagaggaaagactttactgaaaaagtaatatttaaagtagaacttaattgactacaaaattgggaatgggtaaataaattcttccttgcaaacaatatgaatgtttcctggggagcagaataaaatattgaggaaaagtggcttcagacttaataaagtcctagcatttgaactccttgccttttatttaatagctcactgatttggagggggttacataatttttaaaatagttttctattatttaaaatagggactatcgtatctaccttactgtgttttgtaagttttaaatgacagtttacttatatacatttcacaaagcaccaggcttgtagcagatgttcagttaatgtttattcccatccactttacatctagagtctttaatgcacaaaaatccctgtgatgaagctatgataatcagcattccccctctgaaaacatttctcctttgaaccatatcatacacagaggctttgaaatccacaagagtttgtaaaatgaaatatgttgtgaattgtctacagagcaaatcaggagctgccacatcttgtatctcaaatatgagtggtaacagcaggaatgctggcattctccacaagaagactacagtgagaaaacaatctgtgcagattaaagtgtgaaaataaactattaacaatggtttaaaacaactcatttgtcacgttttttgcccagagttatgcaaccaggcagctgatcaactgtgctggcagaactaattcctccaggatattttaggtccctttatttcttggtaattactgtgtagattggtagccagctatgagtaagaaactctttggagggaacattccttctgaagaatgataaaactttacaaataaaaagtaatgtgagtgagtgttcttgatagttgcaaggaagaggagctcactcaagtgaacctaagtaaggaactttctattttcaggagaaacatgacatgataagagaaatggtatagagaaatccaagattaaggtctgtaatacagcttgattttgtggggactaagacaggaagggaccgagtccaaatcgttctaagaatgttagcagcaggagttcatgactattctctttatgaattccccaccagtgtggctgagctattacatgtagcttttccactcttcaattgtcttagccttatcctccactttgaaaatattctccctaccttccagatggggtgtgtgtgtgtttgtgtgtgtgtgtgtgtgtgtgtgtgtaaaaacaacttcctcataacttaggtttgccttaagtcaccttaatattatttgtgcctcactgcctcctttcagttttttgtttgtttgtttgtttttgcagaaaggactgtggataaggtgatttatgattaatttgtctaatacattgagtaaagtccaccatatctgtgagacatatttctttgttttatcatggaaaacttaatctgctagacttaaatgttagagtgaactgtatagaaatcacaatttctagttaaatcacaattgaaaagagccaactctgattggggtgcaagagtcccatagaagtattcagagatcttcaaataatttaattgctgaatatttaattgttgaattgtgtcatttggaattgctatatttttattttgatttaatttcctttttagtcagtagagccattcttccatcattactgggcccactttgctttcaaagaagtgttattggctgttggaagcagaatcctaatttgttgaatatttgatttgtcattctaaaccatattcacacacgtcttggtggcaggtcataaaaatcaaagtaccaactttttttttctttttctaattattcaaaaggctccaattcttacacaaatagatagacacatacacacacacttcaccaagtcaaattaaccttaaattgtaaaaaaccacccaaaagcattttaaattatgaacttattgtaaaatatttgtttctgattacatgcatgtaattacagagaattttctatcattttatgcgtggaaatttatgaaaataataaacatctacttttctttaaaaaaaacttcatctcacttaaagtaaatatttaaccctttgttataaaattttaaaagtttgctctatctttttttgtgtgtgagagaactgagtctcattccactgccaaggctggagtacagtggcacgatctgggctcactgcaacctccgcctcctgggttcaagcaattctcctgcctcagcctcccgagtagctgggactacaggtgcatgccaccatgcacagctacttttttgtatttttagtagagacggggtttcaccgtgttagccaagatggtctcagtctcctgacctcatgatatgcccgcctcagcctcccaaagtcctggggttacaggcgtgagccactgcacctggtctctaacatatttcttaatgccagagaaaactttcatgtttggtaaatatatatagttgctttcttcaggccttacatttctaagatctatttctaagttattgatgcacatggaaggagccctcaaatgatggtggaaagacatgaatatatttctctaaatcatagtggcaagaacaggataagaaaataagtcttaaaatttagtaatcagaagaaagtgattatagtgtaagccagccccttgatcaatttattcctgatgcttggaaagggaaaataaatttattggcttcccttatttttagaatgtatttattggctattttccaaaaaaaaatatttttagaataaatttattggcttcccttatttttagaatatatatatatacacacacacacacacacacacacacacatacatactagtgatgaaaaacattttctcctaatgataaaactctctaggttttttcaatcatcctacataaataatactcataatggtgcatttatttgttggtaacataagccatttatgtcagaacattcttcagtcctttatttacatagcaatcactcaccttaagaaactatgattcaggatgatatacactttttgaggtgagaaaaaactttgtacttctcagtggttctttaaggaattgaaaataaggcatctggacatgtttctaaatgattagaatttccaaatactataacatatttatttgaatacagttacctacaaagatatatgttgataaataatatataatctaacgtactactagatttctaaaccctcaagaacatcagctctctcattatgtatgagacaactggaacccagagaaattctgattgcttcagtgttgcaacagagctagggctggaggagggaattgtgtcacttaactatgcatcacaggtagatatttaatatgccctgaaaggataagtacaatgacatatctcacacatagcacaatatcttttgccctgtctagtgttatgaatgtgacagaatccagataggttatgagctagaacctgatattgtgtcaccattggttatgcttggcacaatgacgtaacagtcaaaactcttctggttacaggccaggcgtggtggctcacgcctgtaatcccagcactttgggaggccaaggcaggtggatcacaaggccaggagatcgagaccatcctgactaacacggtgaaaccccgtctctactaaaagtacaaaaaattagccaggcgtggtggtgggtccctgtagttccagctactcgggaggctgaggcaggagaatggcctgaacccgggaggcagagcttgcagtgagccgagattgcaccactgcactccagcctgggcaacagagtgagactctgtctcaaaacaaacaaacaaacaaacaaacaaaagacaaaaaaataactcttctggttgcaactgagaaacccaacttgaaataaccaaaatagggaattcatttaatttcatgagagaatggcaagatgctaaatcccagatagagctgacatgcaaccaacactgttttttcatctctcctctatctgtattgacttaattctgtcttaattggctgcctttcaatagcaaactacttccctccatgtagtggaagctccagtgactgtcagacatgcaggtttgtttgtttgtttgtttgtttccactcaaatactcaagcaagtattgagactcagacttcctggtctctgattgaaaagtttcaacctcagctgcccattcatgaatcactgtgaacaggacaaaggggtaatcaaactggccaaggttgggtcaggtgtccataccaagttaataaccacagccaggaagataaaacctattcaggaatacagtggctcctattcaactcacatcgtcattgaatatagaagaaacatgtctcaaacgaagcaatgaaaaaatagttgctattttttagaagacaagaaacagatatgaagtatggttggcaaagatgttgaaggcaaaaatgacaatacccattatttagacatacgaaaatgatcagctaaacctttccaactcattagtccagccaaattctcaaggtttactggacaggagttcttaactccagcaatgattattactaaaagtgtcagacagaatggccatttgaaatatgcaacaacaggtatttcatagacattggcctatcagaacaagaccttcagccaatgaggaaaaacactcagctctgctgggagtaccagcacatacaggttgaatataatttgccttaatgttagggcaagttgccactgaatactgtatgtttgacagcatgactctctgcatgccgtttttcagacattttagtcagttatactctaatcctcagaaggacaagtcacatgagaaaaatcagagtaaagaaaggtccattcttgaatttttttaatgttcataaaatctgctaaggaaactatcaaaatatgaagttcatagccctaccttcaaaaaatattcatcatcaggcttagagttgaactctgttgcctgaaattttaataagttgtccaggtttttctggtgttttggctctctgttctgtaaggtgcttggagaaacactgctctaaattacgtgccacttagggaaaagtatcctagctcttcaaaagtaattggaataaataagaaaatcaacaaccataaagacaaagaaggagagtaatgtgctttcagctggaaggcttctgtttatgagaaattagggtaatttaaggtcatcttctaatggcacgtaattctaaactagggcagccacataagccaggatagacaggtctggggaaagaaacggagacacacattgagtgtttcttgagctatatattcagctccatactaggggcaatcaaaagatcaaagagctaccttgactgaagagacaagcctgatattttgatctttgactgtgtgtcttatgggactgtctcccttccctttcagcatcaaactctgcctaacaaaaggaatttgaagctaaactgcacaagatttgagatactaaaacttgcaactgaaataaaccatgtagccaagtcagacagtcagtgattaatgtagtacatatagtatgcctggactattatactctgtgattgaagtttctcaacacagtgatctcaagaaaatagctctgcacataaggtccgaaaatccctaattttgcaacacttttatcagcaactttcagtaggaccttgggccagttacttgacctctttgactctcagttacctcatttctaaaagaagaagggtaaattatatcagctaaggcagtgggtggttcccaaccattttggcaccagggatcaacttcatggaggacaattttttcacagacacagagggatggtttcaggatgaaacttttccacctcagaccatcaggctttagattctcataaggattatgcagcctagctcccttgcatgcacagttcacaacagggtgcaaactcctgtgagaatctaatgctgccactgatctgacaagaggtggaagtcaggcagtaatgctcacttaccggcctctcacttcctgctgtgcagcctggttcctaacaggccacagaccactgcaggtctgtggcctggaggggtggggaaccctgagctaggctcaactttagctgtaacacaataatcccatgaaatgtaaagcaaaacgtaaccactgaatattatcatttgttaaatggcaagatgtctaaaaagctttctaatatgtccttatatcatcactcttagtgtgatgagaaaattttaaaaaccagttataatttcttgcagtatagcccaaattaggtaaaataatttgaagcctcttattcaactctttttgttttatttttaatatatagttcagatattagcaacctcttggggccagaagtgaggcttaagaatgcctttggccataatggaaattatttgaggaactccagaaggctgtatctgggcaaaattaccccccaaatactatcagaagtacccatcctttgggtcatttttaacgacaatggcaacaaaagaatgtcttctttgcaatttataaatgtaatctggaagagaagagagactatatggatctgatctgactcatatcagtcaatagtgtcattaactctttggtattattcacaggcagatgtagattctgaagagcctaaaatgtcgtacaaccttggtaccttacttaataaaaagaatactaaagaattaatataaaagtgggttctacaaatagtattatacttagaaagagaaaaaaatcaaaatgaattaccgtagctttggaggttgaagtccctttctcctaagatctctttagacaatttactagaaataattatatagaaatattttccaaatttgaccttccactccaacaccctatgacactgagtaaatgccagcactcacagggactcatgcatataagaggcttaggtttaataagcatcatgataaatcaggtgttattgtgtcatcagattaacaggtagaaaagtaacaacaataccaaatcaattttaagaataggcagggaaatcggaaattaagtttgaggactgcttcacaagagcattcataggtagcttctaaacaggatgcctggagtcttcctatggggcttacaagtaagagagcattaaagataaacttcacatcattagaaacattcggctgagtttataggtatcaccagcagaccacatcctgctattcaagtagctagtagagacaccatggggaaaaatgctgacatgaagaggaagtaaaagaaaggaacctggcaggtatagtatggaggggcatggggaaatatttaagaagaagcagatgaagcaaacattattgataaagagagaagaagtcgttaaacatttgtttttggtgacataatagtgctaaccactcagttcacttgctatttatcaggctcttgatgtgcagcaaattttagactggaaagtaattgagggagttagccttttagagtaggacattatattggtgataattcccttctatgtcctcagtaaactgattagaaaaatgaaacccagagttttctgatctgtcagagatggtacagactagacattcagtgaagccaggtctagaagccaaatctttgtgataaaaactttagtgacatttttttctcctttgccaaaaaattaaaaaaaaaaacaataaataccacaaagagcaaagataacctttctgtcttatgtgagattaaacattttccatctaaacttatccatatgctttcttcaaaacttatttcaaaacctacataacaaataaatagataaatattaaacacataaaatggttttctcgccaaaggtagccctttttttccctttgcatgtccagtgtatatgaccttcatatcttaaagaatttatcttactctatttggatttcttcttctttcctctcattccacatacatatgcaaaataattgtacagagaactacatatgcacaaagatgcatccatgctcatatggccacaaacatagacacccccaaacacatgcacagtctcctcagagaagcatctgtgccaaatcatggctgttttctatgtggtattttacacatagggggcttctaaaaattaattttaggagaaaatttgctccaaggctatctgatggcactagcaccaaaatccaccaggcctcagctattgcattgttttctaataggtgaaagacctatccagtctcactgcttcatctaccacctctaaatgactgtaggtgttctcccctgtctagaactcatcctgagcgtcattctctcatttttactgtgtggtcagatactttcttctgaatatcttgtaggtacttcaaactcattacctccaaattgaagctcatcagcatttctactttaaccgtgtccttttttcttttactgacattgccaaattccccaagctgcaaattatagtgttattattgacactgcccatgcccttattcctgtacctcattgtctgccgagttttgccaattcagttattaattggtttttcccatctagtgccttttgtctgtttttattactattattacagctcaggtctttatcttgtattactgaagtaatgtcattgatttatttgtctctgctccagtttcactatatacatctcagcataatgcagcttccctattcaaaaccactgtagctccaaaacagattaaagtctaaatgttttactctgataatcaatgctctctatttttcagattccatctgttttttcattccatccatatatttccagatttatctaatatcacttcccttcacatatccagatgtcagaaaaattgatattcctatttctggtcacttcccatctctttatcatttttttatagctccatttactctctcctatcttttttccacttatccaaaccctcattattcttatgatctcctcaaatatgcatgtattagtctgttttcacactgataaagaatacttgagactgggtaacttataaagaaaacagacttaattgactcacagtttcacatggctgggaaggcctcaggaaacttacaatcatggcagaaggtgaaagggaggcaaggtacatcttacatggcagcaggagagagagagggagcatggaaaactgccactttaaaagtctcagatttcatgagaactccctcactatcatgaggacagcatgggggaaactgcccccatgattcagtcatcttccaccaggtccctcctttggcatgtggggattaccatttcagatgagattttggtggggacacagagccaaaccatatcattctaccccgacccctcccaaatctcacattctttgcacatttcaaaactaatcataccttgactcattttagcattaatccaaaactccaagtccagtttatcatttttgattgcgtctatttgattcttctctctttttttctttattagtcttgctagcggtctatcaattttgttgatcctttcaaaaaaccagctcctggattcattaactttttgaagggtttttttggtctctatttccttcagtcctgctctgattttagttatatcttgccttctgctagcttttgaatgtgtttgctcttgcttttctagttattttaattgtgatgttagggtgtcaattttggatcaactaccatcagagaatactacaaacacctctatgcaaataaactagaaaatctagaagaaatggataaattcctcgacacatacactctcccaagactaaaccaggaagaagttgaatctctgaatagaccaacaacaggagctgcaattgtggcaataatcaatagcttgccaaccaaaaagagcccaggacgagatggattcacagccgaattctaccagaggtacaaggaggaactggtaccatttcttctgaaattattccaatcaatagaaaaagagggaatcctccctaactcactttatgaggccagcatcatcctgagaccaaagccgggcagagacacaaccaacaaagacaattttagaccaatatccttgatgaacattgatgcaaaaatcctcaataaaatactggcaaaccgaatccagcagcacatcaaaaagcttatccaccatgatcaagtgggcttcatccctgggatgcaaggctgattcaatatacgcatatcaataaatgtaatccagcatataaacagaaccaaagacaaaaaccacatgattatctcaatagatacagaaaaggcctttgacaaaattcaacaatcttcatgctaaaaactctcaataaattagggattgatgggacgtatctcaaaatgataagagctatctatgacaaacccacagccaatatcatactgaatgggcaaaaactggaagcattcccattgaaaacgggcacaagacagggatgccctctctcaccactcctattcaacagagtgttggaagttctgggcagggcaatcaggcaggagaagggaataaagggtcttcaattaggaaaagaggaagtcaaattgtccctgtttgcagacgacatgattgcacatccagaaaaccccatcatctcagcccaaaacctcctcaagctgataagcaacttcagcaaagtctcaggatacaaaatcaatgtacaaaaatcacaagcattcttctacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccttgctcatgggtaggaagaatcaatatcgtgaaaatggccatactgcccaaggtaatttacagattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcacgctacctgacttcaaaatatactacaaggctacagtaaccaaaatagcctggtactggtaccaaaacagagatatagaccaatggaacagaacagagccctcagaaataatgccgcatatctacagctatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggaataaatacttaaacgttagacctaaaaccataaaaaccctagaagaaaacctaggcaataccattcaggacacaggcatgggcaaggacttcatgtctaaaacaccaaaagcaatggcaacaaaagccaaaattgacaaatgggatctaattaaactaaagagcttctgcacagcaaaagaaactaccatcagagtgaacaggcaaccaataaaatgggagaaaattttcacaacctactcatctgacaaagggctaatatccagaatctacaatgaactccaacaaatttacaagaaaaaaacaaagaaccccatcaaaaagtgggcgaaggacatgaacagacacttctcaaaagaagacatttatgcagccaaaggacacatgcaaaaatgctcatcatcactggccatcagagaaatgcaaatcaaaaccacaatgagataccatctcacaccagttagaatggcgatcattaaaaagtcaggaaacaacaggtgctggagaggatgtggagaaacaggaacacttttacactcttagtgggactgtaaactagttcaaccattgtggaagtcagtgtggcgattcctcagggatccagaactagaaataccatttgacccagccatcccattactgggtatatacccaaaggactataaatcatgctgctgtaaagacacatgcacacgtatgtttattgcagcactattcacaatagcaaagacttggaaccaacccaaatgtccaacaatgatagactggattaagaaaatgtggcacatatacaccatggaatactacgcagccataaaaaatgatgagttcatgtcctttgtagggacatggatgaaattggaaatcatcattctcagtaaactgtcgcaaggccaaaaaaccaaacactgcatgttctcactcatagataggaactgaacaatgagaacacatggacacaggaaggggaacatcacactctggggactgttgtggggtgtggggagcggggagggataacattaggagatatacctaatgctaaatgatgagttaatgggtgcagcacaccagcatggcacatgtgtacatatgtaactaacctgcacattgtgcacatgtatcctaaaacttaaagtataataataataaaaataaataaataaataaataaaaagtccaagtccaaagtctcatttgagacaagaatagtcctttccacctatgagcctgtaaaataaaaaacaagttagttacttccaagatacaggcattgggtaaatgttcccattccaaatgggagaaattggccaaaacaaagaggccacaggccacatgcacatacaaaacccagcaaggcagttattaaatcttaaagcaccaaaatagtctccttgactccatgtctcacatgtagggcatgatgatagaaggcatacgctcccaaggacttgggcagctctgcccctgtggttctgcagggcacagcacctctggctctttcatgggctgccgttgagtgcctatggcttttctgggtgctcagtgcaagctgtggatccaccattctggggtctggaggatggtggccatattcttacagctccagtaaacaataccccagtggggacactgtgtggaggctccaaccccgccattcccctctgcattgccctagtagaggttctccattagggatctttccctgcagcaaacttctgcctggacatctaggtgtttccatacacccttgaaatctaggaagaggttgccaaacctgaactcttgccttctgcacatatgtaggcccaacaccacatggaatttgccaaggcttggggcttgcacctctgaagcaatggcctgagctgtatgttgaccccttttagccatggctggagttggagcagctagaacacgagacaccatgtctcgaggctgcacggagaagtggggccccaggctggccatggaaccatttttccctcctaggcgtccaggcctgtgatgagaggggctgctatgaagatctctgaaattccatggagacatttttcccattgtcttcactattaacactcagctcctcgttacttatgcaaatttctgcagccgggtttaatttctcaacagaaaatggggtttttcttttctaccacatgaaaaggactcagaaaacttacaattatgatggaaggagaaggagaagcaaggcatgtcttacgtggtggcagaagagacgagagagaacagggaaactgccacttttaaaaccatgaaattttgtgagaactctcttactatcacgagaacagcatgggggaatctacctccatgatccagtcacctcctaccacgtgcctctcgacatacgcagattacaatttgagatgtgattttagtggggacacagagccaaaccatattggtgcataatacttaatacctcattcatggcaatgatcacttcttatctttcattacagtaatttgatagatagcttttctcccatacttgagtgtacagtatgttgtttctctctttaagaatatagttgctgagtgcttgagagcacaactgattaatcttttgttactcccacaatatttggcaaaatgccgtgcatattatagatattcaataaatatttgactttataaatgaatatttatttggcaataagaaaattttgataacttttcttatttaaaatgggaaatagtcatagtttttttagaacaattagtaactgtactactaatgttgattaacaatttcaataattattagtttaaatgataatgaacatgcatgtaatctagtcctcaggggaagactaggatttcatcaaaatgatagagcctaagtgtactacttatttcaatacatcgaaaaatttaacagtcatcaaacagacattaacaaccaaaccacagtgattttcaatgtaacatctccaggattaagaaacaaattgtaacattcatttgatgcttaaagactattctttctttctaaggtgtgatgggagaatatgagccgaaaattgaggtccattttcctttcacggttacagctgctaaaggaacaactgttaagatggaatgctttgcacttggcaagtaagtacatgttcttccataattaaacacaattttttattaaaatgtgacatatcttatttttggatcacttattttgctaggtgtcatttccccagttgttccatggtggctatttattttctaaaagaaggtcaaatggcaattgatgaagtaatcagttacagttatcttctagtcatttctatggacaacagtttctataattttgctattttaacataaaaaaacttctttaatgaataaaaagctttacatctttacctatgtatcttaaaatttaagtgtcatctttaaatttcattcagtccttatgtaaataaagaagatagaaaggcaaagtactatctgctcctcatgtataggatgtagattcttataagacataataagacagcagataaaaatcatgaggataatagttacatagtgatcctgtgtattaccttagtatctcctgaaatcataacttaatagcaccagctgtcaatatgtacaacatgtaatcatttcccaaatgagagaaagaatttatgtcacatgctaatgcctgccatatttaatgattatatttctgagggtttacagcccaggatatatagtcacttgtcaatgatgtttacagtataggtattgagatcagaggcagaagtggaattttgattatatttgattattgtattatgatttattttaaacagagtgttgttttctttttttttaggatgctaagacttcagggttctttctagacactataatttgcataaatgtatctctgtcagagttactaattacttaacttcagttgcagagagcaaactcccacaatataactataaagtactcggagataaagccagatacacaagtgtgattattaaagtaggtttagcctttgggtaaggaaaatattagtaaatatgacaaaaaatcagctagctaaggtagatttaaggaacgaacatagtaaacaccgtgttttaatatcaagaatgattaaaataagacatatatgcaattctactttaagtagaaacaacatcataatagactataagcaaaatgaattgttatgtgacccatcttttaagcaaaagatagccagaagtagaaataaatttcaaaatgtaaaatgtatctaggaggtatttgggcagatatctgaggaagcctcctaaacctaaagatgttagttaagcgcataagattgaataatagttaaaagtctggtttgtcaccatttgctgttctgtgtcaaataggtctgaaaatgtcccaagtaagaagctcaatactgacaaatgcaaaaataatatattctggcttgaagacaagggttttagtgtatcctgtagttaaataattcttcagtgccagaatttatactaaggccacaaacaaagggaggtcatattgtaaaacaaattagaaaactagacttataggaaaaaaccaatataaatatttccccaggcaagcttatttaataagttagatgtggttgcctttggaagccttgaaatatgtttagtaaattgaggcttacagtctctttcattctaggtaagacccaacagtcaaatcactaaatcacttatgttcttttaatatgttattttcttcaacctttctactccttctttgctacccaactctcaaaagtaaatacataaaagggagtgtaaagaagactgcttcactcaagaaggtctctgtttatcacttggtgtcctttctaagaaatgtcacaattatggaaaaaagaaacatcttatgaagatgtctaccctctacctaaagaccaatctgccacccttatgaaaataaacaagatcaaagaaataacatcttgacatgtgttcatccttttacagcacattgtcttgtggtgtggatcaccatttcatcccaacataatcacagcaattgcaaattaattcctgagcatccgcgtggctcccacagctcacttgagctgcttcttacttcagcaagcacatggtgctcttgtgggcctttgtctgttgcaaaaacttcagtatctgtcactggatatcgtcaggatcttaccactcaggctgttttccccctcactgtgtcctaaccaaacattccttgtagagtgttataaccaaattctggaatggagcatgtcaaactttttttttgtcttgtggcctttgcacttgctgtttcttacactgggatctctctccccctgttctttccatgggggctctcattcatcctctggcctcaatttcaatatcactcctgaaataggctatctatgaatgtacatgttatctaactcacacccattattctctgtctgtatactttttaatcccttttttacagtccttaacacaattttaaatttcccacatacgtgtttctccacttaaaacatttatctgtgtcaggatcccagatgtaatcaggatccaactcagacatttcaatagaatttagtaaagtgatgagctgaagatctgtgagcaggctaagaagaacaagaaaaaccaagacatgtataaactcctgatagcaatgactcattgtcatgtgtaatcctgaaggagcaagtgggaggagatggtgtttccagaaccagggaaaactggagatatgaagtgggccagggatcaaccaatgggagctgtaatgactgttgctgtgaagagacacagcctttatataagaacacagctgaagaaaggattaggaaatttatatcctgacttctttttcctcttgccttctcatctcctctggtggctctcatggctgaagtcaaacagaagccactctacaagcctgcggatgcaattgtcagttcacaaggcaaggcagagggtctgcagggaacaagaaggtgacaggcaagggaggaaaacagaatagccagcactttccccactcttaggctttaatccccaagaaggcaggaatcattactgtattcttcatttacttattcctagtgcctaccacagcacctggcacatagcattcaggaaataggaatgaatgaacttaaaaatattccatctacttaatccaatcaactctttattattaacagttaatcaaaaataaataagttatttatgccttatcctgtcccccccacaaatacatcatgtatactctgcacctgtatctcctgctctcccgtattctcttatttatatccaaaattacatgctatacttgcctctaccttttcctacctattcttgcctcactctatcatttatctttgttaacttagacctaccattctccaactctcttttttatttttgtggtaagaacacttatcatgacatctaccttcttaatgagcttttaagtgcacaatacaatattgctgactataggtactaggttggcaacagcaaatctctagaacttatttaatttgtataactgaaactttatttttattttattctcaaagcatattttcatgtccaagttgtacttactgtttaacatgacaaccccaaaaaactttcttgatctactgcctcttaagaaggatttgtttgttgccttttttgaggctaaggataagagagatttatcatatctatagaagctagggcaaaggatggagtgaaaaatatttatatatcacaaagtgtaatattttatataataatggtttgagggacaaacaaagaagatcataagtacaaaatcttgctattttcaactttacctgttcccagccttagcggagtaattcacatttcctaccataaatcactattttttatcatgttattcattgaaccaaatatgttcctagatatacagtcattccttggagatatttgaggttcagttccagatgccacaataaagcaaatttcacaatgaagaaagtcacatgaattttttggttttccagagcacacagaagttatgtttacattatattgtatgttattaagtaggcagtagcatttacatgcctggcttacatacatacaacaatttacacacgttgatttaaaaatattttactgctaaaaattgctcatgctgatataagtcttcagcaaattatcatctttttgctgatgactgatgctattgactgataagggtggtggctgctaaaggttggggtggctgtggcaatttattaaaagaagacaacaataaggtttgtcacattgattgactctgtagcttatgatgctgttagatagcattttacccacagtagaacttctttcaaaattggagtcaatcctctctaactctgccaccactttgtcaaccaagtagatgtaatggtccagatcctttgttgtcatttcaacaatgtccacagcatcttttccaggactacactaactcaagaaacccctttctttgctcatccataagaagcaactcttcattcaacttttatcgtgagattgcagcaattcagtcacatcttcctgttccacttctagttcttgttatcttgctgttttcatcacatctgcatttactttccccactaaagttttgaacccctccaagttatccatgagggttagaaccacttcttccaaattcctattaatattttgaccttccatgaatcacagctgttcttaatggtatatagaatggcgaatcctctctagaaggtttacaatttactttgctcagatctatcagtggaataattacctatggaatctctacccttataaaatgtattttgtaattcattcttaagtcattggatttgaaatttgaaaattactccttgatccatgggctacaaaattgattttgtgttagcaggcatgaaaataacattaatattgctcatctacatcagaactcttgggtaatgagatgcattgtcaatggacagtagtatttctcttcgctaatgagatgcattgtcaatggacagtattattttgaaaggagtctttttttctgagctgtaggtctcaacagtgggcttaaaatatttagtaaaccatgctgtaaacatgcagtgtcaccaggctttgttgttccatttcaagaacacagagtagatttaacataattcttaagggccctatgattttcaaattggtaaatgagcattggcttcagattcaacgtcaccagctgcattagcccctaacaagaaagttagcctgtcctttgaagttttgaaaccagacactgacttgtttttagctatgaaagtcctaggttgcatcttctttcaaaataaggctgttttgtctacattgaaaatctgttgtttagtgtagccatttccatcaattatcttagatagattttctgaataactagctgaagttttcacatcagcacttgctacttcaccttccactttaatgttataaagatagcttctttccttaaaccttataaaccagcctctgctaggttcaaacttttctcttgcagcttcctcacctctgtcagccttcatagaattgaagacatttagggcctttctgtgagttaggttttggcttcagggaatgttgtggctggtttgatctacccagaccattaaaactttctttctatcagcaataagcctgttttgctttcttatcatttgtgttttcactggggtagcaattttaatttccttcaaaaactttttttttttcattcacaagtcggctaactgagcacaggcctagctttcagtctgtcttggtttttgacttgccttcctcactaagcttaatttctagcctttgatttaaactgacagatgtgctgctcttcctttcacttgaacacttagaaaccattgtagggttattaattggcttaattttaatattattgtgtctcagggaataagaaatcctgaagagagggagagagatgagggagtggccagttgatggaacagtcagaacacatacatttattattttagtttgctgtcttctatgggcatagttcatggagcttcaaaacagttacaataataacattgaaagatgactaatcacagatcattataacagacataataaaaaattgagatgctccaagaatttccaaaatgggacacagtgataataagtgaaagcaggctattagaaaaattgtgccagtagatttgcttgacatagcattgccacagaccttcaatttgtgaaaaacacagtgtctgcaaaacacaataaagtgaagtgcaataaaataatgtgtgccagtaccttctgtcttaagaaaaaataattcacttattaattcagaggtgtcaaaatataagagttgggctttgtgtagctcatttcataaatatagtagactaaagtacctcaaagaacctagaaccaaatgcaggtctgcaagctctgaaagccaactatgttctagggactgtcatatcttccaggatttccatagtctctgttctcaaagaaattgcattatatcttcaaatattttgctgaatgtaatattacaccttgagtccattcttaatcattatgtaaacatacactatggaccttgaccaagctgtcctctaatagccaacctttatctccacagaaattcactattcgcctttttggttccaagtttaaactaagacttaacaacctaacagcaaattttcttcttttgaactctctttggcccttgacatgatctaatgaatcttcgataagccaaattaggaaatttctttgatttttaaagaatcatacattcaaaccgtgttagaatactggttcattgtgatttctcttggaaagtacagttacctttttatgatctgtccttaatggtgttcagtttttgttacttagagcgtgcatattagtgcagctataatgcacagataatttttccatatataagcttatatctttcccatattctttaagaaaaaagaaaacaaataattgtaggttatcaaattttactatattttgatatcacccaaatttaccaacctgcctcatttgaagttaggtaaaaagtctactaaaaagccataagctgcaagctttctcctaaagaaacctctacttaaatctgaatttagcgaaaattcagatgttttctctacaggctgctggagcagaactcaacaagagtgtactagtttactcctagaaatagctcttaaaatagaattgcacaaggttgagtacagaacttttaaagtgaccgtgacatgctatatcatgctatactgtctgtaaaggtatttccccagaaaaatgggaagtgtttcaagagaacccatagggaaacaaaggtatgtaaaggcttgggtaacacagcaaagtgtaaaaaaaaaaatggagggggattaattagttggaaagaaaagactggtttagacatatggaaggttattatcaagagattgctcacaagctgttctccagtttcaacaagggagggagtgaaattccaacagtatgggattaaactagaagaattagattgggtgtaatgtagaagttcatgaaaaaatgagttgttacagggaaactgggttatcaggagaggcagtggaagctctttgcctgaactgctgtaagaatataataatgcccatttgtcttctaatggtttagatgtaatgttccctgaaaggagagaaatgatctgggtcaggattggaaacgaaaatttaaatattttcttttgctggctgcccatccacacattctcaggctgaatattaagagtagaaggatagaatcaggcagacttaattaactgccttttggcagtgacattattacataacatttcaaaccggttggtggcatatccaggaagtagaaatgatgagtgttgacttttcttgctcagcattcaatctagggaccttaatggaaatggggttattgtggatatttccaaggtcggcttttaaacatcaggtacaatactcttgaaagggattgagagataaaggggtcaagggacaatgcaagcaaggaatcccttaggaccctaataaatatttcatttcagtggttctttctaaatgcagtatataattaaacattggtgatgttttcaactgggtgtgctcagtgtttaagtccagcccatacaagttgttaactaagtaacacagggtaaaaatgagaactttatggaaagtcagtaactacagaaagcagctaccatctctagaggtaaggggggaaaaaaagaattagaattaataaaaattagaacctcagatgtacccctaggaccaagaattctgaggaatggacgaagtgggacacaatgaagcctctcctgaaagtgttgggaaaaaacttgaactgtattttattgctgctaagggaaggattccctgctgaggtgccattcaggggctatcgagctgacaggaagcccctgggaagcccacaggaaataaacaacgatggtgttccttctggcttcttcagccttgcaatctccctacagtgccccctcctggcagtgtagaaatgtggttttcagaacccttgccccagtaccacaaagcctagtagaggatggagctgagaggtggtcatttaaacagtagcaccaattccacttgacattttcaaacccatctcttaatcaactgcaccccttactatacctcagccatcctggctttgccacatctgtggctctgtgacacagtttcctctgtctaaaatatctatcctgccccacaatcctattcagtaaggcttacgtcaaatgcccctcctccattaatcctccctgcttttcttgagctccagtctcttacctttcagtgtgaccacctacatttcactatttagcctgccccactggaacagctatagatatctgtcttctttagtgtgctgaattttgggatccctagagcattattagatgcagcaggtgctgaatatgtacactgaatgaattcaggtatgagaaatgtgattgatctttcataacaggaggtgtgttactgcctttggtttggccagacagatgtctccagatgctttcacatgttttggccttgaaaattcttaccacatttacattagctatagttttctggcaagtttcatttcaccgtgtgaccttttacagaccctagaaagagcactagatatgtcaactagcctccaacagaaacagaagtaaaatctggtcactgatgcttaaatgacccaatacacaagggcaaacagggttactctgtaataaaaaagccaaacgctacaaaacaacatcagtttatccataatgacaggcctgccagctaatagtgttacaggcagattttctctttttttctctctttttaaaaaattttacatgtttcttatcttgctcttgcagccattaacacacaatcagatctgctctgctcaaaaggccttgaacctgttactgtaataattatgtgaatgacctttgcaaactcatctgaaatcttgtggtgaggtgggagggaagaacacattcaatttcctgccctttttagttcctgcttatctctctttcagataccatttacaaatagtcttttgttacactccatcaaatgcctattagggaaccagggtattaagtatttttttctctttttatatgtttactgtaaataaaaagccactagttatcaattcataaaattatttttgctgtagtttatgttttcctttcctcaccccttagctaagctgtctcaaatggctgctcttgtgtcccattgtaactgtgagaatgacaaatattcctctgagacttcctacagtgtgcaactggcaaacgttcctggaagaacctgctctttagttacagattgatgatttattaatactgtttatttggagctgccagtcactaagggctgtaggaattaaaaatgaattggagttatgtggtatttgtctatcaaactaaaatcaaattacttaatcattaggttgacagaagatctggggataggagtcagtctctgggtgttggaatcaataaacatttaggcctcacaggaaagtggtgcattacagaatcaagaaaattgccatcatgaactattgcttgctttagtatggttgagatgaaggacacatcctcatttcagatggtacccagaggtgatggatcctaaaagaaccttaaggattgcatgacctaacaaacgtgaatttgtaaatggaaaactgagacttctcaaggaatggctagacgtgtggatgtaccgctcaggctaatgttttgatgcaacttcctgtgatgttcttgacgtgttcaacattctttcatagggcaaactttgaaggaaatatttaatttacttataggcttttacactgagaggtgttatgtgttttcagggaaacaggaccaatttattattcacatttagagtcaaagttaactggcatcatatttccagcttttccacggctgccctagaactagttaacctgcctcaggagagaaactgtatacatgtgcaaggccaaacagctaatgtgtgtggcctatagaggcagaactagataccctgatgctaattaatagtattctcagtttacagtttttcagttgctaagagtaatttttactttgtcacagcaaacattatattctgaatgccctgaagcatctcagtgagtgagaattaggaatcttaataggcaagacaagttaacaagaacatgaagcaaaagataatccccaaattgtaagatttttacttggattagtttagacttatccaacagctttcttttaagttaatctcccaggaatttccatggaaaagtttcttcctctgggatgatcgtaagatcagcaactatctggatgctgagattcaaaaacaggatgtaaagaattactttattaaaagaatgaagttatgccttttgcagcaacatgtacataactgaaagccattatcctgagtgaaacaactcagaaacaaagagaaataccacatgttctcacttacaaatgggagccaaataatgtgtacacatgggcatatgctgtggagtaatagtcaatggagactcagaagtgtgggagggtgggaaacgggtgacagatgagaaattacttaatgggtataaggtacattagtcagttaatgattacactaaaagcccagacttcaccactacacaatatagccatgtaaccaaactgcacttgtaccccataaacttatacaaataataaaaaagacttagtatatccatcagaagtttctaactttattgtatcccatacccctacaagaatcaccaggtacataatcttgacacttgaataggacatcagtggaacaaaaaaggacaattttaaccaaaaagttgtcaacaatctgagtatatgtaaaactaaacttctaccttgtcctggatggtttccatatcacactcagattccaacaacatctctgacatgttatctcactggattacaaacaggaatgaatttaggcaaattatgtatcccatttgacctgtttccttattttgaactctcacagtcttggatttctaaaagtgttatatcatcatcatccacaaattcccactgagtattctactagaaattgaaatgtttccctaacagttatctcttctaatggtgatttaacaactatattgctacttttaaagccgatttatctaacaataaacttgcttgaatatctttgtttgagatctcattctatctcatatgttttatgacaatactcaatttttaaatctatcatagtacatgtattcttaaaagtagtatgtgtcttactgaatcactgtactttgaactaagcatgctcgtcatgtgtctaatatagtcatatttgtattagttaagctaagagaacaacaaacttctccactagagaaagatcaatttagaacttcaagaaggttttcatatgcagttcttagaatgatttcatggtaacttggaaattaggtaccaagtgtcagtaatgtgcatgccattagaatttcatgcattcaaaaattttgtatttattatttcaataactttgaaaatttgaatatgtgatgatctagtgtgaattactaatgttatatataccacatttgatgcagccctctgcataacagcagtatctctaactcacctcaaaccattggcatcattatcgacctctgccaaatcttccatcccaatctgccagacatttaaaacctctcaagtcccccctctccattttattctatttttcacaaacatagttcaaatctattattattggacaaatttggctctcttacctctgctgcaaataagactagagatgttgttgtcccagctactcaggaggctgaggcaagagaatcgcttgaacctgggaggcggaggttgcagtaagccgagattgcgccactgcactccagcctgtctaaagagtgagactccgtctcaaaaaaaaataataataaattaaaaattaaaaatacatagatttttattgatgcttcattagctttgggaatttctccaagtgctgctttcataggccctgctccattcactttatctgtttggttgtctattgttccccggaccttattcctggtttccaaatcactcctatctcatatactctgatgttattttggactttttatttgattgttgactccaactgcacctcttaatttagcctatttgatgttcttcaataccttggtccacagcatgtgggatcaggctgggtttctagaactccaaaccaagcacaactctccacactcacccatcatcagcctacataaggagtttttattatcactacgggtgaccatttaggcgttttccaaaggtataaaattttaaatatctttgactctttcttcctttttatcatcatctgtttgattaccataaatgtctcttaaattgattaccactgacttggtgcataatgaacatttgttaactgaattaagtcatttatcaatgtaataggtatatatatgtactcaaggggaagcacgaataaaccaatatattaaaaaacgtataagcctgagactaaacatgtctaggcatttagattgtaaaaataaaagctcagtccgtcttagtctctatctcaaattatggcatcatcctagtagggtgttatgcagtaatatctgtgctggtatgcccaaatttcagaaacaatttttctacttgggttctagcatgttgagttgccttaccaaagtcactctaatgaaaaacaaactgtgataacttgctaataaccatcactggtggcccattcatgtaagaaatgccctcagtggaaacaggactaattaaaaatctggtggcctataagcacagagtaagagcaaagtgcacacacttccctgtggtctgtaactaacaaggtactgcaaattcatggattgcagttcttttctcaaaatattcttgtatatttagcacacatcagcaagattacaagcatctcttctctgggtggtggtacggaaaaactaattttattgttgtgattgttattattctgtactttttcaagacacttaattttaaaaaacaatacaaatattttacatgataaaattttttagtattagtttcatgaccctatattaaaatttccaaaagcataggctttttttaaaattaattacataaggtgttgatgatttcctttagattattcaataggaatcctatccttgttaggcacatacttatagtttctaatctagaattataattatatgatgtcagaaatatttctacaaatacttaattccattcattctagttcattcttgttcttcccaattcagaatttattctgacatgtacgtgatacatcatatttatttgtttttagtatcccttgccagagagttgtaatatgagaaaactttctcttatgtctctgatgcttttaacaggcagaacacagaagaccatatatacaatttatttatgttctcaccaaataagtaatcagagacaaaagtctatgtttacctttggaatatccctctcagtgcatcatacaacttgaaaacaaatgccatagatacgggagaagggagggtgaaattacagggaaaggctgttatctgaattacatttttcaaaaacatctcctatgcccatatcatacaagtaacataagttttatctatctctgtaataattttattgtaaagcaatttgctgtaaagttaaaatattgcaacttcatattctttacttttattttgtaaatatactatttaaatatgcaattaaataaatgattatacatgtgcaatgtataatcagtgtggttctgaattgtcttatagctcattcttcgttgccttagattattcatgaatcttcattatatctaggcattttctactttatatgacagtgaaataaaggttttcattattttttgatttggtgctttttacatccattgtcccaggctgtttgcttgatttttgatggtagagccgtatgtacatggtggcatttgctacaattagatttaatatatttcttgcataagtgaaacatgtaagcatgtttatgtatgcacatgtgtgtgtgtgagtggttaaatccacagaaagactattgagaatgaatatgccgagacataaactcaacatctaccaccctgttttttctttgttttttaatttacaatgtaatgtagcagcacctaccttgtgtgaccggtcactggttttgttggtagttaaatggtgcagaacaggttccatgtcaaagctttataaggatgatttttggtctgaaaaacataattctcattaatagccaatagattttaaaaagatagtcgatgagaacatatgtctgctgctgctttatggtaccaaagctaaatgataagtacttttgatcatttttattcccacttttcttttctttgggaggttgaatcaatctacattacaactttgagaatgttttatttatggcctttttctcaaagaaaggtacattatgaaatcaggtcacttgttttatatatccctacagagaaatgcagccttcacaacatttccaaaagaagaacacacatcagtatttcccgtacagacacacagaggaagaatatcttcaagcctccacttcatgtcattccattacatttagccacattctgttgagagaaagcatagatttagtagacccaatgcatactttttttgcattttaatatctctgaaatccagatgtatattgcactcaatgttgtgttgtagtttaattggcagtgttttctttcttagagatagtggtgtgtcttaaagtagtggtgtgtcttacagtcaaagactgtatcttgaatgtgataaactagagtaagatagactaaaattggcatatataaacactaacttagggatcaattaaattagaacctgagtgatgacatgtacttcctccatctatgtgcagtttaatatttaaaatctgagttaataaacaaaagatctctcatagtactggaaagattttagaataaatgattgttgactacatattttcattttataaaatcatcaagagttattgtagcgtcaacagtgtttgttactccaaccatgccatctatgggatttcacacacaaacactttttggaaagaagggttgaaatacaaaggaagctagtccaggagaatccctctgcctgcactgcctgcattatctttagtctgtgggttttattgactatgtgttacaaataaaagaaaatagaatagacaaagactgaaagagattgtgcatcaggtggttagaccatttggttattgtttgacttttgtttgggggggtaaaatgggtataatagaaataacaaatattctaatacattttccgtgacttaaatgtgtagagaaaacacaatatattaagtcaaaagtacaattaagtaaattaactgtactgctaaagtatttcttcaggcatctttttaaaagctttattgccatataattggaacacaataaaatgtttaaactgtagaatttaacacattttaacatacgtatttttaccatgaaaccatcgcacaatccacataataagcatatccagtacctacctattaacatttctacatgtacacttataatctcttcctccttcccatccacgcatcctcaaccccaggaaactgatcctgtatgttttgtcactatagactacgttaccttttctagtcatgcataactgaaatcatacaatatctactcttttgaccgagagtgggagagtttgccttttttcatttagaattattatcttaagattcatacaagttgttgaatgtgtcaatagatcattcctttatattgcacagtagtgttccattttatggctctaccaccatgcgtgcatctgtgcacctgttgatagacatttggattccatgtttcagctattaccataaatcttccatgaacatttgtttagaagtctttatatgcacataagcattgaaagtttttcttagataaatacttatgagtggaatggctaaacgatatggtaggagtatgtgtagctattgaaaatattgctaaacaatttttcaaagtagttgtactattttgcattattattagcagcagtgttggagagtccaagtacctccacgtctttgccaaaacttggttaatctgtaattatgccatttaatatgcatgtagtggtgtcacattttatgttggattccccagtgactaatgatattgactgtgttatgtgcttatttgataactgcatatttctttagttaatagcttgccaatatttttgcctgagatgttgatatttttattattaaattttgcgtgagagttgtttaaaattctggaaacaagtcctttatcatatatgtgattcgcaaatattttctcccactctgggactgtctttttattgccttactagtgtgtctcaaaaggtacaagttttaaattttgatgaagtccaaattttcaattttttgtggggattgagattttagtgccatagctaagatatatttgcctaaaccaagggcaaaaggttttctcctacattttctcctaaaagttttatagttttatgttttccatttaagtctctgctgtattttgaattaatttttgtatgatacaggtatggatcaaagttcattattttcaatgaatatcaaacttggtcatcaccattctactctccacttatatgagtttgacatttttaaattccacatataaatgagatcatgcaatattcgcgtttctatgtctggcttatttcgcttagcagaatgtcctccaggttcatccatgttgttacaaatgacaggatttccttctttttcaagggtgaataatattccattatgtatatatatcacctacttttatctgtttatttgttgatggactcttaagctgattgcgtatcttggctgttataaatatatgctgccaaaacaggaatgcagatatctttaaaatgctgatttcaattcttttggatatatactcagaagtagaattgttggatcatatagtggttttatttttagtttttgagaaatctttataatcttttccatgaaggctataccaatttacatgtccaccaccaatttataagggttccgttttctccacgtcctcgccaatacttgttatcttttgtctttttgtaaaagtcattctaagacatgtgaggtgataccacattgtggtttcatatacctgttgaccatttgtacctctttttttgagaactgtctattcaatccttggctcattttctcatgaagttatttgttttattgctactaagtttcttatatgttttggatattaaatctttatcatatatatgatttgcaaatattttctcccatctcataggttgtccttttcactctgttgattgtttgttttatcaggcagaagctttttggtttgatttgatctcatttgttcatatttgctttgttccctgtgattttagagtcatattcaaaaatctttacaaggaacaatcaagaagctttttcctctgttttctttcagcagttttacagttttaggtcttacatttaagtctttaatccattgaaaggtgatatttgtatatggggtgagacaaaggccctattttattcacctgcaagtgaatatctagtatttcctacaccatttattaaagactgtcctttcctcatggtgtgttgttagcacctttgtcaaataacagttaactgtagatgtgtcaactcgttttttgattctcaattctcttccatatgcctatatgtctgtttctgtgccagtaccatgctgttttgattgttataactttgtggtagattctgagatcaggaagtataatgcacccagtttgttctttttgctcaagcttgcattggctattgaagatcttttatggtttcatatgaattatctctgtttgcagatgacataatcttatatgcagaaaacattaaagagtccaacaaaaagctattagaaccaataaacaaattcagtaaatcgcagaatacaaaatcaacagacaaaaatgaatggtgtttctgtacactaacaacaaagtatctgaagaaattaaaaataaatccatttacaatagcatcaaaaagataaaatacttagcaataaatataaccatggaggttaaaggtttgtacactgaaaactataaaatattgatgagagaaattgaagaagaaaaaaataaatagaaagataccctctgttcatggattgaaagaattaatattgttaaaatgtccgtactgcccaaagcaatttacgaattcaatgcagtccctatcaaaattccagttctatgatttctaatttattttatgaatttttttaaaatttagttatttatgagtatgttatttagcttccaaatattttagcatttctctgtctttctgttattaatttccattttaattacattatggtcaaataacacactttttgtgatttaaactctttaaatgtattgagacttgtcttatgacaaagaatttgttgtattttggtaaatgacttatgtgcacatgggaatttacatactgctgttagtgagtggactagtctacaaatgtcaaatagcttaagttggttgaatgtgttgctcaaatcttctatatctttattgatttctgtctagttcttctgtaagttatacagaaaagagttgaaattttctaatatatttgtagatctgtctgattctccttgcatttctatcacttttgccccatatattttgaatctctattatatagtgtacatactttaggatgtttatgcttctcgataaattgtctcctttaccactataaaatattcctgtttatacatgataatattttttgctctaaaatcaactttgtctgatattaatacagatacttcagctttctctttgagggacagaactaataggatgtatgtatatatgaaagagtgtttattaagcagaaatcactcacatgatcacaaggtgaagtcccacagtaggccatctgcaagttgaggaacaaggaaaccagtccaagtcccaaagcagcaaatgtagggaagctgacagtgcagcctttagtgtgtggccaaaggcccaagagcccctggcaaaccactcgtgtaggaacaagagttaaaaagccaaagaacttggagtctgatgtttgagggcaggaagcaaccagcacaggagaaagatgaaggttggaggactcagcaagacagctttttcttctaccttcttctccctgctttttccagcctcactggcagctgattggatggtgcccaccacattgtgggtaggtcttcctgagggtgggtcttcctctcccagtccactgactcaaatgttaatctcttctggcaacacccagaaacacccagatacacccagaaacaatactttgcattcttccatttaatcaagttgacacttaatattaaccatcacagcattatttgcaaggtgtattatttaacctgctattacttttaaaccgttttgagttttcatatttaaaatagatttcttttaggcagtatgtagttgggtcttactttttaaaccaacataacagtatcttcctcttaaagtagttattgacatggtgtgtttaaatctagcatcctgctatttgctttctatctgtcccctatgttctttgtacattctattctttattctaccttcttttgtgttaatggtgtattttattctattttatctctttagttagatagtattacttctccacatattataaagcccatagtacaatgatactatttgtttgactttaaacagctggttaatctttcaaagagatataaataatgagaacattaatttatatttgtccatgtagttaccattttcaatgctttcaaattctttgtttagataactggtttaatctggcgttattttctttcggcctgttcctccaacataattgtaggtaggcctaataattatgaattatttcaacttttgtatgcctaaggaatgtctttatttcacttttgtttttaaaacatattatcactgattaaagaattacagaccaatatcttcttccttcagtacttcagatatgtttctctactattttctaacttgtataatttttgacaagaattcagctgttactcttatatctgttcctgagtatataatgtggttttttttctctgactgctttcaagattatctctttataataagttttatggaattttattatagtgtacctaatttagttttcttcatgtttcttgtgcttgtggtacattgagcttctgggagccaaaatttttgaccattgttttttcaaggaagtttttctattctcctgctccttttaatttggaagctacaattacacatataatagtctgtttgaaattacccactgttcaacgatgctgtgatcatttttcatcgcttttcttttgtctttgtatgtttcaccttttgatagattctattgctgtatcctcaaatttactaattttctttcgcaatatttgatcttctgttaatcacctccagtgtgttttatcagacagtgaaattttgattttttcaggatttttttaaaaagaactttattgtttagagcagttttaggctgaccgcaaaagtgagcaaaagtgcagacatttcctatatcctgtctgcccctacacattctcagtctcctctgttatcatcatctaccaggatggtacattttttacaactgagacacctacagtgacatattattatcacacacagaccataatttgcattagagttttcttttagtgttctaaattctatggatttgaataaatgtataacaacatatatctaccattacagtatcatacagagtagtttcaaaatccctacaaatcttctgggttccatctacccatctctctgttatccctaacctctggcaaccactgatttttacactgtctccagttttacctcttccagaatatcatatgactgaaaccataaaatatgttgccttttcaggttggcctttttaaatttagtaatgcacacttaagttttctccatgtcttttcatggcttgatagctaattttttttttaatacttcatgttgttccactgtctggatataccacagttcatttatctattcagctactaaaggactcttagctgcttccaaattttggtacttatgaataaagctgctgtaaatatccatgtgcatggttttgtgtcgatataagttttcaactccttttgttatataccaaggagggtgatacagctaggctttttatccccacccaaatctcatcttgaattgtaatccctgtaattcctataaactccacatgtcaagggagagaccaggtggaggtaactgaatcatgaaggcagtttccttcatgctgttctcatgatagtgagtgagttctcatgagatctgatggttttgtaagggtcgctttcccctttgctaggcacttctctttcctgccaccttgtgaaaaaggtgccttgcttccctttcaccttcccccatgattgtaagtttcctgaggcctccccagccatgtggaactatgagtcaattaaacctctttcctttataaattacccagtctcaggcagttcttcatagctgtatgagaactaatacaacaaattggtactgggagtggggcactgctataatgatacccaaaaatgtggaagcaactttggaactgggtaacaggcagaggttggaacagtttggagggctcaggagaagacagggagatgtgggaaagttttgaacttcccagagacttattgaatggctttgacgaaaatgctgatagtgatatggacgatgaagtccaggctgaggtggtctcagatggagatgaggaacttgttggtgactggaataaaggtgatgcttgcaaatgctttagcaaagagactagtggcattttgtccctgccctagagatctgtggaactttgaacctgagagagatgttttagagtgtctggcagaagaaatttctaagcagcacaatgttcaagaggtgacttgggtgctctgaaaaacattcagttttatgccttcacaaatagatggtttggaattggaacttatgtttaaaagggaaacagaacctaaaagtttggaaaatttgcagcctgacaatgcgatagaaaagaaagacccattttctgaggggaaattcaagcaggctgcaaaaacttttatagctaatgggaagccaaatgttaatcaccaagacaatggggaaaatgtctccagggcatgtcagaggtcttcactgcaacccttcccatctaaggcctggaggccttggaggaggaaaatggttttgtgggctgggcccagagccatgctgctttgtgctgtcttaggacttggtgccctgcatcccagctgtggctgaaagaggccaaaatacagctcagatcattgtttcagagggtgcaaaccccaagccttggtggcttacacatggttttgggcctgcaggtacacagaagtgaagaattgaggtttgggaatctctgcctagatttcagaggatttatgaaaatgcctagatgtccaggcagaggtgtgctgcagggcttgagctttcatggagaacctatgctggtgcagtgcagaagggaactgttgggttggagacaccccctgcagagtccccactggggcactgcctactgtagctgtgagaagcggttcactgtcctctagaccccagaatgatagatccactgacagcttccaccatgagcctggaaaagctgcagacactcaatgccagcccatgaaaacaactgggagggggactgtaccctgccaagccacaggggtgaagctgcccaacaccatgggaacccaccttttgcttcagcatgacctggaagtgagatacagagtcaaaggagatcatttcagagctttaagatttgactgcctcactggattttggacttgtatggtgcctgtagccccattgtttcagccaatttctcccatttgaaatggatttgtttacccaatgcctgtatccccattatatttaggaagtaactaacttgcttttgattttacaggctcatttgtagaagggacttgtcgtgtctcagatgagactttggacttggacttttgggttaatggtagaattaattaagaatttgggggactgttgtgaaggcatgactgcttttgaaatgtgaaagggatatgagatttgtttggggctaggggaagaatgatatgtttagggtttgtgtccccacccaaatctcctctttaattgtaatccccttaatccccatgtgtcaagggagagacctggtgaaggtaactgaatcattgaggaccatttccttcatgccgttctcatgatagtgagtaagttcttatgagatctgagggttttataaggggctcttcccactttgctccacacttcttcttcctgacgcctggtgaagaagatgccttgcttcttcttcactttccaccaagatagtaagtttcctgaaacctccccagctttgagtcaattaaaccactttcctttataaattgcctagtctcaggaagttctttatagcactgtgagaatggactaatacagacagcaattactagattgtatggttatagtatgtttacttttgtaagaaactggcaaactgatttccaaaatgactgtactattttgcattttcaccagcaatgaatgagagttcttcttgttctattccttgccagcatttggtgttgtccatgttctgaattttgacataaaggctgtgtagtagtgtttcattgttattttaatttgcatgtcactcataatctgtcatttggggcatgttttcatatgcctatctgccatttgtgtatattctttactgaggtctctttaaggtttttggcccatttttttagtcagattgttttcttattgtttagttttaagagtcccttttatattttggatagtagtcttttatcagatgtctttgcaaatattttcacttagtttgtggcttgtctttttattctcttgacagtgtcttttacgaagcataaaattttaattttaatgaagtccaacatatcaatttgttttttcatggattatgcctttgatagtgtatctaaaatgtcattatcaaaaccaagatcatcttgattttgttcccagacattgaagtttttatctctaaaattctgatttggatttaaaaaaaaaatctcttccatagttgtacttaacatgttaagtattttctctaggttttgaacacatgaaatgtagttataataactgttttaatgttcttgtttactaactccatcatatgtgtcatttttatgttttggtcaattgtttgttttcttcctcattatgagttacattttcctgattctttgcatacctgaaaatttgtattagatgtcagaaatttgaattttaccttgttggaaattgagcatttttgtattcttgatctttgttctgagatatggttaaattactcagaaacattttattctttcagttcctatatttatgctttttcagataggaactgagcagcatttagtattggcttaatttttccccactgttaaggttaagacctttcttagtactcgaacaaatgcctccctaattatgatattttccacatggatgttaggttaggaactattcctggcctgtataaattctgagcactggtccttctaatcctttcagtgtgtcctttcctattttaaaatagtttttccatatggatgcactagtcattactgaattgaatactcatgagggatgtcctgtagatctctaacactctttctctgcacagctgtcctctctcgtttactgtgaattctagttgctttagtttctccagactcccagatctgtcttttcaactcagaaagacagctgagctttgcctaagtctcccttgctatgctgtagagtgaaaactttgtccagggagcaagcttgggcagttgtatgatttggcatgttaatttaacatacttcaaggattactgtcctttatatgctgatgcctaatattttgcgactattctttcatgtattttgtgtagtatttagctaatttttctcatttttatttactcagtaaaaagtgaatgaaagatagaagttgacccaaacctgctctaaatgtctttatctaaccaagagaatagaaataaagttacctgcatttggaatattgcatattttacctgtccttatttgaataaattatgggaaaaaaaacagcaactgaaaggtaatagagtgattctttgacagaatcctttctcagaaagagtttaaaacagaaacagtaaaaagctacagtaaagtactaatttaacctaccattccttaaaaaaaaaatctgctggataaaattcacaaggactataactcttctgtagttgaataggttacatttttcagtgccaagtgacaagagaaaaataaaggtttaaagtacctaatttcaaatatcagttcaattatctgccacctctatgacaccaaataaattatcctctctgaactgcattttcaaaattaggaaagtaggaataacaattcctacatcatagagttactattagatttctccaagagactcaatacatgaagacctgtcattcatatgttaatttattatttcaccctagttttctagagtatttggggagcattgtttactttatgaagcatttgcctatcctctaacattctccttctttctgaaacgccatccaagacacagtccatttctcaagctttccttaatccaagtatgcttgcattctataaacctctctctgctgcccttcagcttttcatggtgtcaactgaaaatagatggtagaaaattcactctttggctttctgcttacaatatatattgtcatgtgccctagtaatccaaagaaactctgaacccacaaaaatgtttctatagatatgaaatattgggaataatttgttagttctatctttcccaaacattgtttcaggtcaaacctttctttttttcctgtgagtttaaagagtattttctaaagctgattttacttactaggtctagggtgacattttactctggctgctgttaatacttaaaatattttgtactatttctttagcatcagatttggcattcctaactaagaaaatgcccggaggccacaaaatttaaaaacttaaagaccaagagccaaatacgttagaagatagagagagagagagagaataaatattgctctaccattagtttttctgccttaacggctgttggaaaaacatacatgtgattcagatatagaaaaaaaaaaatgacaaaacaaaacaacttgaatcatgtctaagaaagtctggttttagttataatatcaactgaaatattctctgcctaaaacaggccatagtgactttaaatcactaaataagacgatttaaaaacatgctaattggccgggcgcggtggctcacgcctgtaatcccagcactttgggaggctgaggcgggtggatcatgaggtcaggagatcgagaccatcctggctaagacggtgaaaccccatctctactaaaaatacaaaaaaattagccgggcgaggtggcaggcgcctgtagtcccagctactcgggaggctgaggcaggagaatggcgtgaacccaggaggtggagcttgcagtgagccgagatggcgccactgaactccagcctgggcaacagcgagactccatctcaaaaaaaaagaaaaaacatgctaatagaatgcagatattaatataattcaagataaattatactgaaaggtaaatttgagtctgctattccttcataattgagactgactgtggagtattctaccccttacatgaaatgattaatggactattcgtacccctagcttttgtaatgattttttaagttaaaaaatcttttaataattaagtttaattttaaacagttaaagattgggaatgaatctttacagccctctcattctatctttacaccaaaataatgaccaatactgtctgttaaattttttaacctatgcttctgtcatctatttaaaaatgtagagtattaaggctagttcttgtgctttacttgaatggaaattcattaaaaacactgtgctccacaaatataaactgaataaatgtcagcattcataaactgttctgtgctctactttgaactgtagtgtggtttctttttaaccatttaccaaatagtaaagaacatggctgtaggtcaggcatggcttacacctgtaatcccagcactttgggtgactgcagtaggagaatcacttgaggcctggcgttcaagaccatcctgggcaatatagaaagaccccatctctaaaaagaaaaaaaaaaattaaagactagctatagtggaatgcatctgtagttccagctacccaggaggctgaggcatggaggattgtctgagcccagcagtttgaggctgcagtgagctattattcagtcactgcagcctgggcagcagagcaagaccttgtctatattaaataaataaatgcagtgactgtagtagacagcagaagtctctgtcttaaaaataggtgaaagccatgtcccctaattagaatagtatatcattaacatggcatttttaccacctgaccccgttaagctgtgccatagatatgcacaatccattgtgaaccaatgtcacaagtgtgccatgtattgtgtatgcctcattgtccgcttgtctctatttgactttggtgtataccctgtagaacaaaagggctgatgtacatgaatgtgtacattgaatatgtacaagaataatgacttcatagagaaatattttctctctttctagctagaagtttacttaatgtctttttcagtttacttacttataaaacacaaaagataaagcatacttcttaggcttctgtgaaaattaaatgatatatcagataaaatcctgtaaccatgttaaagctcaatgttaaagctcaattaatcatacctatatagtgatagaatctaagaatcagggatggatctagagctggaagaccacatttcccaaatacaattttttcgtgaattaaggtctaaatagatattaaataactgccataagtctcccataatgtcatagggctgggtctagaatgtccatcttagtaccattgctcccctacactttccactgcacagtctataggtgctagctttacttaaaactctagcagctgctagcatcaaatattatgtgtgtctaacttcttaacagaagaatggagattttactttctcctggtacttgatagaattcatagggtcaaccatgagcacatgaacttctatatcacacgaaactattgctacggaataaaagatgaaatgctcctgattattgtaaatacaaagttgcatgtgggattgtgtaaagacaatgccaggttggactgccagaatgagccaacagcgcatgatgtgcttccccctgcagagagcctatgagtggacgtgcagtcagggaggtttcacatcaccaagattcctgtcccagaaaagcagatgttcatacatctgggaatggaatgcgacccttgtggagagcctataaacggatgcatgaggggcgcctgtccatacagataagatagggctataaatgccctcatcttgccacagctcttctaggcctctttagggttaaggtatactcccttctgagaatttctggtctaaccagttgtctagcttcacgtcctgtttctatggattttttgtaaccagcttttgctgcaactgttactgctgattaatatcttgctaatcataggttatggaaagactgtttctgttttaaggctctgttagaaattactgatgcacatgttatattgtaaattcttatctctgtatactgtacttctacatacaggtgttatgtgaaagaattacttcatccccatatgaccatctcacctcatgatcaaatgatcctaaatccctcactaacctacccctgccctcactaaacttaataacaaatgctggtatatccagtgcattggtggcaccacgggaccagaaggtggtgacccccctggacccagctttcactgtcttgtgtgtgtctattatttctcaacctgccgatccacataggaacaaggagagagccctgttgcattgtgggctgctggccagatcccacaataaaagttctaatgcacctaaccatatactctattcaacttgaaacaatgtttcaggaacccaggggctgcaggtgagagatataactttacttttatatatttggcccatgaagattctgagaaggcagtcattctgagagtatcactatgacagtatcattagatgcagcaaattaggttatctgagtgttctagtgctttttttgctgtagtatttagttatattaatgtggattttgttctattacattaaagaattatagtttatttcactatggaatatttaaatattattatcaatttcaatcctattcttcaatcctagccaaaacaggaggtgattcaaaaaagacagttataaatttaaaaagccttgaaatgttctagagacaaaaagtggtatcttcttacatatatttgtgaatgtaattagcaaaaaataatgatatatatatatataaaataaaagtttgaggagtattaagaaagtactaactgtcaatgttttctggccagaattttataccagtgcaccaaaacataattcttgtatgactttgttatgactttgttatgcaatcgttgatgatatttatttgcctcataatgtcgtttttaaacactcaatctgttttcttattgctgcccacatttgggggaaagaaattcacaagtaactttgccaaaaaggaattttgtaatgttattcctacatagtctttgagtataaaaataggtataatcagtataaaagaatgtcatttttccagtctaatctacaaataagaatttttaatgaatgaagattttggtagatttccagcttcagttccattattttaatagaagaatacaattcttaaaattttacctagttttttgttttaataaaatgtctattaatttgcaacattataaaagactatatacttttataaaactctgtgctgatgaaaacaagttgaaaattaaatagggaggtaatatggtcacaaactttgtggtatttctgtaagaaagactctttttctatgtaatttttaatttaacatctccacttttgacagaatatagacagtttttaaagtaataaaatgtaatgagcccagacgtgcagactacagtgttccaaactataaacgtcaaattagggagaagcacgggaaactaatcagcttttctggcagaacctggaaaactacaataagaggtgagagtgaggcaggaaataaaacagagtaaaataagggagattgtttaaaaacattttattgttcagaggtacatccatatgtagaattacattgcgtctgaactaataaactcaattataaaggtttctggccttgacttttcatctttacaagtatctcactgttatttgtgacccctttcagtctgcacccatgtctatgtattcttaatccatgatgtctaatttctcccttttcactaggacccctgtcttcacctcttacccttcatgaactacagtacatggtccatcgcttattctctccaacatctttaactctcttgctacaatgctcttttattacattcactctttaaatcctcactaaatatttcattgtctatatgcctctactcaaggtgcttagcactactgaagaaagcacacaatgctacagaatggtctcactataattgtattttccctagccttacttaggccctcagtgctgcacaccagtcttctctgtcttcattgtggctaattgcgacactcaccttcacctcctgctcccacaggcaaggtcagatgctactttccagagataattgaaagtctcggacaaaagattgtttcacttgctaacttcagatctataaacttcccaccctccatacacatccttctttcctcaactcatttttagaagaaaaaaaaagacatttctatctctaatgcaaatccaccttcattctgtatcttacttcctgctttttagagactgtactctcttactgttaaccattcaagtaattccagccactcctctctactggctctttctcatttgcatctgtacatcacatttctcaaatctcagcagagctcactctcaagtttttaacttctgtatacctcatgtgtaagctggatgaaatggtaattcctgcttcatagacttgttataaaaattaattccatggattataaataccaaacactttaaaagggggtctggcccatggtagaagtccaattaatactctccattgttattatctaactgtgtaagccacaaaccaagaaactaaagttgctatctcctttttcatcattgatattctatccagtatcaagtcttgttagttctatatcttaaatatcttaaacatctacttagtacaaccccattaatttaactagaccagagtaatcatttacatgatttcttcctcagccttttacttcgtattcctacctctaaccttgcttattttcagtgcattattcttgctgcatacagagtgtcctaaaccaaagtcttacaaactgtgcaccatggactggtcacctgttttcacgaaacaggtttaactggagcacagccatgtccatttacttgtgtattattggtggttgctttcactctacaatggcagccttaggtacttgcaatagagactatctggtccacaagcttatatgtttagtgtgtctttctttaagaaaaagtttgatgacccctgtcataaactcaaatatgaacatcattcacctgcttaaaacacttcaacgttttcagtaactttcaggatatgtccaggttgatttttgtagtacttcatacttacccttgtcttcctcttcagcctcatcactaaatagtgctagtgaagcaacaaccatacaaaacttctttctgtatctttttttttaaattttattattatactttaagttttagggtacatgtgcgcaacgtgcaggtttgttacatatggatccatgtgccatgttggtgtgctgcacccattaactcgtcatttagcatgaggtatacctcctaatgctatccctccccactcctcccaccccacaacagtccccgatgtgtgatgttccccttcctgtgtccatgtgttccattgttcaattcccacctatgagtgagaacatgtgtgtttgggtttttgtccttgtgatagtttactgagaatgatgatttccaatttcatccatgtccctacaaaggacatgaactcatcatttttttatggctgcatagtattccatgatgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctggatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttttttcttgtaaatttgtttgagttcattgtagattctggatattagccctttgtcaggtgagtaggttgcaaaaattttctcccattctgtagtttgcctgttcactctgatggtagtttcttttgctgtgcagaagctctttagtttaattagatcccatatgtcaattttggcttttggtgccgttgcttttggtgtttgagacgtgaagtccttgcccatgcctatgtcatgaatggtattgcctaggttttcttctagggtttttatggtttcagctctaacatttaagtctttaatccatcttgaattattttttgtataaggtgtaaggaagggatccagtttcagctttctacatatggctagccagtttttccagcaccatttattaaatagggaatcctttccccattgcttgtttttgtcaggtttgtcaaagatcagatagctgtagatatgcggcattatttctgagggctctgttctgttccattggtctatatctctgttttggtaccagtaccaggctattttggttactgtagctttgtagtatattttgaagtcaggtagcgtgatgcctccagctttgttcttttggcttaggattgacttggcgatgcgggctcttttttggttccatatgaacttcaaagtagttttttccaattctgtgaagaaagtcattggtagcttgatggggatggcattgaatctgtaaattaccttgggcagtatggccattttcatgatattgattcttcctacccatgagcaaggaatgttcttccatttgtttgtatcctcttttatttcattgagcagtggtttgtcattctccttgaagaggtccttcacatcccttgtaagttggattcctaggtattttattctctttgaagcaattgtgaatgggagttcactcatgatttggctctctgtttgtctgttattggtgtagaagaatgcttgtgatttttgtacattgattttgtatcctgagactttgctgaagttgcttatcagcttgaggaggttttgggctgagatgatggggttttctggatgtgcattcatgtcgtctgcaaacagggacaatttgacttcctcttttcctaattgaagaccctttattcccttctcctgcctgattgccctgcccagaacttccaacactatgttgaataggagtggtgagagagggcatccctgtcttgtgcccgttttcaaagggaatgcttccagtttttgcccattcactatgatattggctgtgggtttgtcatggatagcttttattattttgagatacgttccatcaatacctaatttattaagagtttttagcatgaaggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcttggtggataagctttttgatgtgctgctggatttggtttgccagtattttattgaggatttttgcatcaatgttcatcaaggatattggtctaaaattctcttttttggttgtgtctctgcccgggtttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttgcttggtaaactattgattattgccacaatttcagctcctgttgttggtctattcagagattcaacttcttcctggtttagtcttgggaggatgtatgtgttgaggaatttatccatttcttctagattttctagtttatttgtgtagaggtgtttatagtattctctgatggtagtttgtatatctgtgggatcggtggtgatatcccctttatcattttttattgcatcaatttgattcttctctctttttttctttattagtcttgctggcggtctatcaattttgttgatcttttcaaaaaaccagctcctggattcattgattttttgaagggtttttgtgtctctatttccttcagttctgctctgatcttagttatatcttgccttctgctagcttttgaatgtgtttgctcttgcttttctagttcttttaattgtgatgttagggtgtcaattttagatctttcctgctttcttttgtgggcatttagtgctataaatttccctctacacactactttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactatggtctgagagacagtttgttatgatttctgttcttttacatttgctgaggagtgctttacttccaactatgtggtcaattttggaataggtgtggtgtggtgttgaaaagaatgtatattctgttgatttggggtggagagttctgtaaatgtctgttaggtctgcttggtgcagagctgagttcaattgctgggtatccttgttaactttctgtcttgttgatctgtctaatgttgacagtgaggtgttaaaatctcccattattattgtgtgggagtctaagtctctttgtaggtcactaaggacttgctttatgaatctgggtgctcctgtattgggtgcatatatatttaggatagttagctcttcttgtttaattgatccctttaccattatgtaatggccttctttgtctcttttgatctttgttggtttaaagtctgttttatcagagactaggattgcaacccctgcctttttttgttttccatttgcttgatacatcttcctctatccctttattttgagcctgtgtatgtgtctgcacgtgaggtgggtttcctgaatacagcacactgatgggtcttgactctttatccaatttgccagtctgtgtcttttaattggagcatttagcccatttacatttaaggttaatattgttatgtgtgaatttgatcctgtcattatggtgttagctggttattttgctcattagttgatgcagtttcttcctagccttgatggtctttacaacttggcatgtttttgcagtggctggttccggttgttcctttccatgtttagtgcttccttcagtagctcttttagggcaggcctggtagtgacaaaatctctccacatttgcttgtctgtaaagtattttatttctcctttacttatgaagcttaatttggctggatatgaaattctaggttgaaaattcttttctttaagaatgttgaatattggcccccactctcttctggcttgtagagtttctgcccagagatcagctgtttgtctgatgggcttccctttgagggtaacccgacctttctctctggttgcccttaacattttttccttcatttcaactttggtgaatctgacaaatatgtgtcttggagttgctcttctcgaggagtatctttatggcattctctgtatttcctgaatttgaatgttggcctgccttgctagattggggaagttctcctgggtagtatcctgcagagtgttttccaccttggttccattctccccgtcactttcaggtacactaatcagacatagatttggtcttttcacatagtcccatatttcttggaggctttgtttgtttctttttgttcttttttctctaaacttgtcttcttgcttcatttcattcattttgtcttccatcactgataccctttcttccagttgatggcattggctactgaggcttctgcattcgtcacgtagctctcatgccttggttttcagctccatcaggtcctttaaggacttctctgcattggttatcctggttatccattcatctaactttttttcaaagctttcaacttctttgccattggttcgaatttcctcctgtagctcggagtagtttgattgtctgaagccgtcttctctcaactcgtcaaagtcattctccatccagctttgttctgttgctggtgaggagctgcattcctttggaggaggagaggcactctgatttttagagtttctggtttttctgctctttttttttcccatctttgtggttttatctacctttggtctttgatgatggtgacgtacagatgggtttttggtgtggatgtcctttctgtttgttagttttccttctaacagacaggaccttcagctgcaggtctgttggagtttgctagaggtccactccagaccctgtttgcctgggtatcagcagtgatggctgcagaacagcagatattggagaactgcagatgctgctgcctgatcgttcctctggaagttttgtctcagaagagtacctggccgtatgaggtgtcagtccgcccctacttgggggtgcctcccagttaggctactcgggggtcatggacccacttgaggaggcattcttcccattctcagatctcaagctgcgtgctgggagaagcactgctctcttcaaagctgtcagagaagtacatttaagtctgcagaggttactgctgtctttttgtttgtctgtgccctgcccccagaggtggagcctacagaggcaggcaggcctccttgagctgtggtgggctccacccagttggagcttcctggccgctttgtttacctaatcaaacaactaactcatcaatggtgggcgcccctcccccagcctcactgccgccttgcagtttgatcttggactgctgtgctagcaatgagcgagactctgtgggcgtaggaccctcctagccaagtgcgggatataatctcctggtgtgccatttttttaagcccattggaaaagcgcagttttagggtgggagtgatccaattttccaggtgccgtctgtcacccctttctttgactaggaaagggaattccctgaccccttgtgcttcccgagtgaggtgattcctcgccctgctttggctcatgcacggtgcactgcacccactgtcctgcacctactctctggcactccccagtgagatgaacccggtacctcagttggaaatgcagaaatcacccatcttctgcgtcactcacactaggagctgtagactggagctgttcctattcggccatcttggctcctcccttttcagtatcttaaatacactctttttctctcacagctccaggagttagcatagactactgactcttcctagaatattttttatctctcttccttgtctaaataactcctaccaattatgcaagtctgaacaaaaacatttcctgactcttgccacactagattggctgtgcctatgtccatacttcctctaaatcatgtccaatattctttaagtcattacttaagtcattctatgaattccacctctatcactctccccattgtcaactccaggtctacgacaaagtctagaacatagtaagtaccttatatataattgctgagtgaacaaatgaatatacatggcgttatttcagaaatttctcttggctactttcaaacttactcttgttccttggcaaggctgctttggcatgtgattctcctgggtcctccccattttgctggatacaaggattttctctggtttggaagataagaaacacctaggcaaaaatgatatgtgagaaaggaaggcagccaattgcctatagttgggacataggctgacctcagcatttattgctttcagtgctaaataacttatttttaatgaaagaaaagattataattgttttaaaaaacaatggtaaaaacataaaggccatatcagatcataatgtcacagagactgtcaagcttctttacctaaattagattctttgcctaagataattaaaagtgatgctatatattctgaaccacatgaagtcctaagcagaactaataccaggggaaggccctgagttaatacataatcacacgttctgagtcaagaatcagaaaggagagagatctaaagcttatattcaagttagatgcagttaatttattatccctgaaggccaattattctaatcatttggagactgcgacaatgtggtcccctgcctcaagggagagattcatatactctcctctcaagaagggcccaagctttgcactcactgcccctgaaggtttccagactttttcaaagaaaaattttgccttcaaaagtttttgtgtattatgtagatagtagcaatcacccacattagtggtttagttttgttctctctcttttttttttttgagatacagaatcataaaaggaaaaaaaaagcctttgtctcaatagcttttcttatgatagctttttatgtgctttcttagagaaaagttataaaacttggttctttcagcttctatcaaagatatacaatgtttccttttttttgtgcaagtcacaaaggagccataactgtatatattttcacatcagatgtaaaattcatatctcacttgtgacttatgcaaggaaaataggaagctccattagacagacctacaatttgtctgtgaatagtgatttgcagttggggagtactttcttttgaaatcattaaatcttcacagctaagtattccttctgccttgacagattctacacattacctcatcatatgtataaaaatgatctttaaaaaatacctttaatgacttcaacaatggccaaagttcatccaacactttccatactttcaagaactacatttggaggcactttttatcctgtcactttgatggtgcataacaaaaagcttgtgtcagaatttcagtgtggcttcacatagtcttctcctgttattaagagatatttttgagccaaatgaatagcatcatcctcggtatgatattagctttaaaaaacctcctatatcttcaagttgcattgcttattgtagatgaaaatcaaatgtgtagttgaacagatataatttcaacagaactaaaataggagaaaaacagaactgtgctcttcctttccatcaaaactgacatctccattcattcttctagtgtagctaaaatcagtcctttgtttgtgcttgtgagcaataactctactctcaggttattattatagagaaatttgttttggataataccataattttaagcaaattaaaatcttactatgctctcaaatattttttaaatcttaaacacttacaaaaagaaaatgaatgaatcattcttgatttcaaatcagccatttgaaaacagcaaaattatttcattttccctaagttgttatgtactatataaatgcatatggcatattcataatgtcagtaaaaccttggcactgccagcaggctcaagaacactatttcatttaacaatagcttatgtttggaagtctttccaaacaagtttatagccactctatcaatttttacaaataattttatattccaaagctccaaataacttggaggcaaaaaatttaggagacttaaggacataggaaaggaaaatttaaataaacagcattaaactttcataatttgaagatatttttgtttttgaagggaaaacctgcactttccataaacttgcagttgctttcttatgcccatcctgcatgctttagcataccaaactatgtaaagttccactcatttgccttgctatctcatactgttctgtgtgttcatgtacatggattttcctgccaggaacattttttgcctcctgcaaaaattgccttcatccttcaagctcacctcacatgtcatcttttctgggctacattccctcaccttcctgtctaacataaatagtcttcttgactatgttctcttaatactgtctccttctgtatttggatcatttgattcagtttgttgtatttctaattaggtcataaattccttgagttattacagcattcactttgttttttatttttatataaattcaaggggtacaagtgcagttttgttacatgtatatattgtgtagtggtgaagtgtgtttagtgtaaccatcacctgaataatgtacattgtgcccgttaagtaatttcttatccctcacctttctcaccccctcccaccctcccactcttcccagtctctggtgtctattattccacagtgtatatatacacacacacacacacacgtatagacttacatgtacatgtgtatgtacacacatatatattacatatcatgtatatatatatatacgtgatatgtatatataacattttctttaatttccagtcagtcattaatggatactcaggttgattccatatctttgttattgtcaacagtcccgtgataaacatatgagtgcaggtatatttttaatatagtaatttattttcctgtaggtagatacccagcaatgaaattgctgaattgaatggtagttctttctatgtttagttatttgagaaaactccaaactgttttcgatagagaatgtgctaatttacatttctaccaactgtgtataagcattcccttttctctgcaactttgctaacatcttttttttttctttttaatagccattttgactatagtaagataatatacaattgtggttttaatttgcattgatctgatgcctagtgatgctgactaatctttcatatgcttttggccatttttgtgtctttttttttgaaaaatgtctatgcatattcttcactcactttttgttattttggaattttttgttgtttttgacttacttaagttcattgtatattctggatatcagccctctgtcagatgcatagtttgcaaatattttatcccatttttcaggttgtctgttcacgctgttgattatttcatttcgttgatcttcatttttaatacaggtccagagacctgtattatactatactgagaactcagaaaagttatactgaggagttaataaacatagtgagactgctcaccctgacaattgactacataatctctcgcattactgaaatcctcagggtttttgtttttgttttcttactattaggtctccttttttctcaggccatcaaaatgcagttttctctcctactgcaagaagtcttttaacatgccacctgtaatctcacatcgtgtatctacttacccctaacccaaagccttgtcttccatattacttttttttttctattcattctcgattcctttctctaggtgattgtacaagaagatgtaaagaaattaagactttattccagccaagtaaataaagtagcttaaaatggttaggcagaagccaggaagtcaatggatataccacagaaaattaagacattaagaatttaggtaaatggacaatagtaattttaactttagtcaccatggtttaaggttgtgtgtttctaggtaaataattaggggccaactataattacgcattgtgggctccaaaacacaaactaaggtagaaatgatccaaagattagagatagaagaaaaaaagggccaagtcagtaattttgtcttttaccatggagaaaatataaaaatctagatttaagaaagtaataacaagaagtagttatcctcatatgaaagaattaagttttcttttcagtgggacttgtctaatgctttaactatttttgcataaacaactggcaaaaatataaggctgacaaaaagaagtcattttctctccaaaatgagactggaaaccagtggtcggtgggaaaacacatactgactacctaaattcttttagatgtacatttattattaaaaaaaaaaaaaagagttctgctagaaatctactagagatgccatcacacaaacaaatggtaattataaagtctgatgatgacaaaatgaattttaaaagaaatttaaatgttaaaataagatttattcgcccaccaaaattgataattgaaaaaggatgacagttatctctgagaacacctgagcaatgaagaaagacatcaaacactttttttcctgttattaacatcttttattttattttattattattatactttaagttagggtacatgtgcacaatgtgcaggttagttacatatgtatacatgggccatgctggtgtgctgcacccattaactcactcataggtgggaattgaacaatgagaacacatggacacaggaaggggaacatcacactctggggactgttgtggagttgggggaggggggagggatagctttaggagatatacctaatgctaaatgatgagttaatgggtgcatcaaacacttttggtctatactgttttgatgtaatatctgattaatagaaaaaacaattatgaatccagcaaccaactggagaactaaaacagtaccaagagtaacaataattttgaagctcactgcatgatattctccaatcccatctgcctgtattctctcaagaggaaaccaacagcctgaaatatgtgttcataatctttgtgatttaagacaattatgttatgatgcatagatatatattttaacatacattctttatttttcttctttttttaacattgctaagattgcattatgacatatgtagttatttgtgatttgctttttttcttcaatctttgtttttaagatttctccatagtgttcaaggtaattgtaatttatttattttatctaataaataatcatctaatgtgtatacatataaaacatatgtattcattattctattatcagactttggattgttaccagattaatttttcccctattaaaacaattttggactgccactaataagcatggcagggtagtttgtaccatattaggcctcaattgtagactatgaaaaaaaatgaataaaatatatggaacagttgttgtcatatattggataacaggcattgcaggaatgtgatccctcagagaataaaaaacagtgaagttaaccattatcctagtgtttttccaggaatttttttttatcagaaactgacccagataggagaaatccaagatgatcacaagtttcatagagctgaaaggacagagagggagatcagtgaagctgaggtgactgaaatttatagggcaagtaacaggaatagaggagttacacaaagaacaacttccagacatctgcattaggatctcattgaatatatgaacaaataccaagctatgagtgtacagggcggaaaaactaagaaaaactagtagagaaggaacaaaaaaaacagaaaacctgaaaaccaacaaagagccagatattgaactgggttgggaaatcttcaaactccagttaaccacataaaacctctttgaacaccatggttcactcagtagagagtgaaaaaaagaccaggtcacaggggtagggttaatctagttctaaaataaagactatttttaactcaccctaaaaaagattacaaacaagttttacaaggattaaactaaaccacaaataaattagctgcatgccagaaaaaaatttgccaatgattaaaggacaaaaacaaaattcagagacctgataatgtgaagcctctaataaaaattggtagaaatgtgaagaaactacaacaaaaagaatatatggactataaacaggagataaatcagtcaataaaacattcccagaaatatcagaaatgttggaataaacaaagtattttgtggcagctcttaatatgtttagtcattgtgatggttaattttagatgtcaacttgattgaaatcagggatacccagatagcttataaagcataatttttgggtttctctgtgacagtgtttctagaagagattgtcacttgaatcagtagattgagtaaggaagatttaccctcatcagtgtgagaggacattatctaatccattgaggacacagatagaatttttataaagaaaaaagaggcctgaggcggtggttcacgctgtaatcccagcaatttgggaggccgaggcgggcagatcaccaagtcaggagatggagaccatcctggctaacacgatgaaactctgtctctactaaaaatacaaaaaattagcccagcgtggtggcgggcacctgtagtcccagctactgggggtgctgaggcaggagaatggcatgaatcccgagggcggagcttgcagtgagtcgagatcgcgccactgtactccagcctgggtgacagagcgagactccatctctcaaaaaaaataaaaagaaggttgaatttgcactcttttctggagctgggacatccgtcttctcctaccatcagacattagaactaaagtttcttgggcctttagacttgagggcttacatcagtggcccccaatttctcaaactttcaacttcaaataaagttacatcctcagatcccccaggttcttctttggactcagactggattacatcaaaagctttcctggttcttcagtttgaagacagcatgttgtgggacttctcaacctctataattgtgtgagccaattcccataataaatacatatatgtataaatctatctcttgttgattctgtttccctggagaactctaatacagtcatttaaaggaaaacatcaatataatcaagagagaaatagaagttatctttatgaaagttttagaataaaaaaagtgaaaaaatgtactagattggatttacagtggattagacactgcagaagaaaagatcaatgaatttgaacatagagcattacaaactgtaaaatatactagataaagagaagtaaaatggaattataggtattgctttatggaacaattagctacataacgtatatcaaggtttagtctcagaagatagggatagaacaaaaatattttgaagagtataaaaatatattatctgtattgttgtaaaacttaaccctacagatctccaacgctcaatgaaatataaacagggtaaaaacaaagaaaaatgtgggaagatacaacataaactaattgatgaaaaacaaaaataaaaggagaatcttaaatagttcacttggagttatgtatccagtgaaaatattcttcaaaaaattaaatacatttattcttttaaaaataaagacatttttagctaaaataatttgctgcaggagaaaacaccacaagaaatgttaaggaaaattatttagattgcaggaaatgtaatactgttttaaaactccacaaaaaaagagcaagaaatgtttttttaaaatatatgtgtacatataaagtatatttgctgtttttaatttctaaaattttctatttccacttgttttgtaaagaaaaaatataataatgtgttagagggtttgtaaagtatgtagaaataatgtgtatgaaaagaatggcacaaagggtaggaaggagaaccggtaagcataatattgtcagattcatatcgcaaactttaaaataatcaaacacatagcacaaaaaacaaaaggctgtattaaataaactagtataagactaaaatgaaatactaaaaactaataaaaataagacaagaggaaaaaagatatgaaaactgatgggatagacagaaaatgtatattataatgctagacttaaacccaaccacaggtaattatattaaatgtaaattcacaaactaaaccaaagaaaaacattgtcagactaggttgaaaacaccaaaagcaacggcaacaaaagccagaattgacaaatgggatctaattaaactaaagagcttctgcacagcaaaagaaactaccatcagattgaacaggcaacctacaaaatgggagaaaattttcacaacctactcacctgacaaagggctaatatccagaatctacaatgaactccaacaaatttacaagaaaaatacaaacaaccccatcaaaaagtgggcaaaggacatgaacagacacttctcaaaagaagacatttatgcagccaaaaaacacatgaaaaaatgctcaccatcactggccgtcagagaaatgcaaatcaaaaccacaatgagataccatctcacaccagttagaatggcaatcattaaaaagtcaggaaacaacaggtgctggagaggatgtggagaaacaggaacacttttacactcttagtgggactgtaaactagttcaaccattgtggaagtcagtgtggcgattcctcagggatctagaactagaaataccatttgacccagccatcccattactggctatatacccaaaggactataaatcatgctgctataaagacacatgcacacgtatgtttattgtggcactattcacaatagcaaagaattggaaccaacccaaatgtccaacagtgatagactggattaagaaaatgtggcacatatacaccatggaatacagtgcagccataaaaaatgatgagttcatgtcctttgtagggacatggatgaaattggaaatcatcattctcaataaactatcacaagaacaaaaaaccaaacaccgcatattctcactcataggtgggaattgaacaatgagaacacatggacacaggaaggggaacatcacactctggggactgttgtggggtggggagaggggggagggatagctttaggagatatacctaatgctaaatgacgagttaatgggtgcagcacaccagcatggcacatgtgtacatatgtaactaacctgcacattgtgcacttgtaccctaaaacttaaagtataataataataaaataaaaaaaagaaatgagaaaaaaaagaccttataatatactatctgcaagaaagcaactttaaaaatgattttttatatatgaagatatatatgttaaaagcagaaagattaaaaacgtgtaccatgcaaatactcatcataggaatgttgaagagagtatcttaatatcaaagtataatgtagcacagagtgttgcctaagataaggatgaacattttatgataataaaaagattaacttttcaagaagacattcaaatccaaaatgtatatgcacctagtaacagagctttacaatgtatgaagcaaaagttgacagtacttaacaggaaattgatattttactataatagttggagattttaacactcttctctagtaatttatcaattacaagaacagcaggacagaaaatcagtaaataaccttattctccagtaatttatcaattataagaagaacaagaagacagaaaatcagtaaagtacagaagacatgaacacagctattaaccaacttgacctaattgatatttaaagaactctaccaaccaacagcagaatacacttatctgcacatggaatattcaccaagataaattatgtgttgggccgtaaaacaagtcttacccctaaaaaagactaaaaacgaagagcgtatgctctctaattgcaacaaaattaaattatgtatcaataacaaaagaatactttaaaaatcaccaaatatttagaaattcaaaacacacatctaaataacaaaatgatcaagaggaaatcacaaaagaaagtagaaaatatttttaactgaataataatgaaaacacaacatgtgtgtgatatagttaaagcaatacttaatggtaaatttttgtcatttaaaagggaaaattcaaaatttaatgatctaaacttctaccttaaacaaatggaaaatgaaattaatttaagatgaaagatagtagaagaaaagaaagattaagtagtagatatcagttaaattaaaaatggacagataataaggaaaaagtaaaactcaaatctcatttttagaaaatattaataaaactgatacacatcaaaaacaagagataaaatttaaccaatatcaatcatgaaagaggaaacatcactacgtctctatcctaaaacatttaaagtacaggaaggcaatgttaactgacaacatttaattttacaactaggtcaaataaaaaagctccttaaaataaataattcttataactggcacaagtagaaacagaaaatatgaatttttccatatctatcagtgaaattaaatttgtaattaaaaacccttatactataaaaaattgagtcccagttagtttcgttgatgaattctatcaaacatgtaaagaagaaattatataacgtggccaaccaacttggatttatctcaggaatgtacagtgttttaactattaaaaagcaatttatataattagtcacatgaatgggataaaagaaaataatcttacatcatcttagtaaatacagaaaatgcatataacaaaatccattatacacgatgaaactgtcaaatatgtaggattagagggaaactttctcatctaggaaaaatacacctacaaaaagtcaatattcagcatcgtaatggtaagagactaaaatatttcccctttccttttatcaccacctctgttccacacttaacgggagacctggacagtatagtcaggcattaaaaataataattatggctttgagatggaaaaggaaggaataaacctgcctctgattggaggtggcataaatgtgtatgtgtattttcaagaatctacaacaaaaaccctaaaattaatatttagggataaactaaacaaaatacgcagaagacctgtacactgagaatttgcataacatttatgagagaaataaaagaataccaaaataaggagatataccgtgttcatggaatacaagactcaatagtgttcagaagtcaattctctcacagttgatatatgtattaaatattatccagtcaaaatcctagcctgcttctacttttgtgaaatttagcaagctacttctgaaacttacatgaaattcaaagcatatgaaatagccaaaggtagaaaaagaaacaaacttagaagacttgcactacttaatttaaagatttactcaatatttattctaaaagtaatgataatcaagaaaatgagacattggcataaagataggcttatagattaatgcaacagaagaaagctcagaaatttacctgccttctaaagtccatcaaaaaaatgccactttattcaatagggaaagggtaatattttgaataagtagtgctgaaacaaatggatatcactgttaaataagttgatcctttaaccatatcctgtaccataaacagcaaataaacttaaattggatcatagccctaaatgtaaatctctgtattctgtatagatttctacatacctaaatgtaaatctatgtattttctatgtattctacaaatacatagaacaatatctcactttttactttctggagtcagaaaatacttcttaagacagaaaacgaaaaaccactaagaaaacaataagattaaaagaacttcatcaaaattaaaacctgcttttgtcaaaagacaatggtaagaaaataaaaaggcaagctcagattggaagaaaatatgtgcaatatatatttgataaagaacttgtatccagtatgaactaataattcttacatttaatgctgggaaggaaaaaatgcaacataaaaaatgaaccaaagatttgagtatgcgaatggctaataaaaacatccaaagtagctccaagttgttagtcatcaggcaatataaattgaaaccacactttagtatcactacagtactacaaaaatgactaaaattaaatgattgacaataccaagtattttcaaagatgtagaacaactggaaatttcctacactgttggtagacatgttaaattatacaggtacaatggaaaaatagtctggtaagtacttatacagttgaacatttacttaccgtacattctagaatttctatgctttttacttaccccaaagaattaaaaatgtgtgttcacaaatacttgtataaagttttattcataatagcctaaaactgaaaaccaaatgtccaacagtcagcaggcgtctggataaacaaactgtagcatatccatatatcgatatactcctcggcgattaaaaggaattaactaccgatgtgcacaacaacttaaatgaatcttataaatcttacacagagagacagaagacatactcaaaatactacgtagtgtattattcaatttacataaaagtataaaactggtgaaagtgttcctaaattatggacatcagctcattgattgcctgggacatgggtgaaataattgggaagagatatgaggaagaacttggggtttataaaaaatgttctatatcctaattttcctgattgttctcatggtaaaggcaagggtccaagagtgagagcagcacaaaagaattaaagctacaatatagtggccaaagcaaatcataaggcaagccatactcaaagcatgggttaagagactccattttctaatggtaagatgtgcaaagttacccagtgaaggatgtgaatacaggcagtgatggagaattaagaacagtttttcaattaatctgctatactgaccaaggtcccacattttgcattctttctattttcatttattctcccaacaacctaaccagtattttcctgagctcatgtctttcttctaataattcgatgaatgtagctagtaataatcacacatttttaacgttctgtcttgtaactccttttctaggtttagaagcgtttcagattacctttctaagctctcaaggatgacagttttaccaaatgttttccgctgcatagcatgacacttcatctcctcattctccagtatgcattcgtttccatcttcatcctcactgtcatggaaattccaaatatttactgtgttgttctgtcagttacccgttttcatttttatgtattaagttctatattagtaagataatgctagaaggcataaaaaagaaaccctagaaagtctggagcttagcaaggtatacatttatatctcattcatgtaacatctgacagaatgttattagttagcattggtgaggtaacaattttgtacttttctctacacagtcgtttagaaactcagtcctgctattttcaacttgttacttacaaatttattctgggtattgatatcaaactgcccaacaaaagagtagagagtcatagatttttaaaaacaattcttctatacttgattgccagaaatcatcatagccgtagcctaaaaaaaaaaaaaaaaaaaaaaaggcaaatgtatgtccaggagaccaaaaaaacaaaaaggattttggaaagagatgaggtttccagcctttgctatatacctcatttgtttgtaaaattatactcgtcttttctactattttatgattttgtcattaatttcagtatttatttctaaagtcagaagctcatcgatatcttaaccatcttcctccccaaaatgaaagaacttcaggacacattagcttatgacttcttttttttcattacatgctctttttgatcagtattttagtactgtccctttttatacacacacattatttttattgctgttgctattactattatttgtgttttttcttaccacttcttgcatcttaaactttctttctggagtcattattctccttcttgaagtgtatatcctttagtaatggtttattggtgaaaaacttgttcaatatttgtagatttgatatctttatctcctttttcactcctaaagaaaaatttacaggatacaaaattattagtttataggtgcttttactctcttttccgctatattgaacataattgttccaacatcttttcctgcttccattgctgctgttgaaaagccagtagacatgctaatcattgttattttgtaaattatctgtctccctctctggctacttttaatatatgtcataggtgttctgtggctttagtcatgctttgtatatattgtatttcctgtgcttatggattcatgtccttcattttaggaaaattgtatgctgaatacttttcagatattacatagtcttctctctctctctcttgctctcactctctcttaactctatctctatatctattatcttagattggacttacaccctctagctttatactacatgtctactaactgatgcccatatttatgtattttctgtctcccttcctctcagtgcctcattctgtatatgaagctgtaatctatctatcacttttggaaatattctcttcaactatgtctaatttgatgtataacccagccattgagctttacgtttatgtgattatatttttgtctttaaatgtctattttatttttaatctgaatatttacttttattgtcatatcttccttgatcatttttaacccatgactatttttactccaagttttattgctgtgaacgttcaatatgaagttatgtgctgttctgtattttgtgattctgggataactgaataagaacaatttaataaattggagcaacaaaatcaaaaagtaaaattccactatcaaaatacgcagattaccaaatatagcttttaagtcaaaaattaaatctaaccatttgccatttagaggaaattagattaaaacaaagtgacataccatgaaaaaaaaaagctaaaaataataggataaatagacaatgagcgtgaggttaatggagtgtttcttaaaaggataacttaaagcaaaaattagaaagagggccattgtatttggtaaaggataattacaactctaaaaataataataacttttatgaacaggtattttcagagagaaaattcatcaaaacacaaaataaaacttatataagaagatactggtagtaatgatagtagtgggaaattaacacacctatctcagtctgacagatcagtgaagatgaaaataaagaggacatagagtagtagttttctggggagtgaggggaggagtgagcagactccaggaccctttttcctgcttcaagcagaatactttgcatctattgatatgggttattttagtgtacaaggattccataggaggtaaactgttctgaaattattaaaaacatgaaagcaatatctgaatgacaactaacaaaagctatataaaaactaatttttaaacttttatcataaataaaatatacttttttcccaataacatggaacttgtaccaaaaattaattctgtatgcaaagattctcagcaggttcctgaaagtagaaagtgtatatcactctgtgtatcaatacgtatcatatgtggccatacgtttgatgtcagcataaaagatagtcatatgattttattattaatcatgaataataattatactgatcattcagctcaaaaagttaaagtataataggaattatatataaagtataaatatatacattatatataaagtataagtatatacattataaagtataaatatataaatatatataaagtataagaggaattagtaaatttaaaaacagaaactcatgaattacaacaaaaaagtaataaaaacttaaaatgcttattttagagaccaataaaatagacaaacttctgtcatagtcaatcatttaaaacttattatatctatcatttattgggtgcttacaatatgccatgtattttactaagtaatttataataatttatctcacttaatcttcaaaatagtattttgacaatcattcattcacttatttcataagcatttattaacaatataccaaacatatgaggcactggggacatactgctttaacaaaattccactgccctaaagatatttgcattttggaggaataaacaaatatcttcattttacagatgagaaacaaaatttagagaacttaggcaaatttcccgaggtcaccatagcatctttgtgcccaaatcatattagaacccaggtttctctgaaggtccgtgctcctaaccaatatgtagtgttatttctgtgggggaaaatacagaaaacatatattcataccatataaattataaagaatatgcaaggagcatcattatattattgtaaactagggttttttgcctgctactttgtgccaggctgtttaaatctttcaagattcacaactactctctgacataagtcgtaatatttccaccatacgttacaattgagaaacctaaagaaatgaaatgttaagttacttgtagttgcagagctacctctatacccagtcagtctggctgcagaacctacacttaactactagaatatgtaaccagctgtgattaagactgttttaaactaaacaattacaatttatataacttgctgctaaaacattgaaattatagataaaatagttggttttctagtgaaatgtgaattgccaaagttggcataagcagaaatttaaacaatacaatcaaggaaaacacagtcaaaaaactaactccactgacggtggcagacccaggtaactttgtgagaatcctatcagtatatgaaggcaaatataatttccctacaatttaagttgatacagaatacagaaaataggaatattctggcttgtttaccaagcagtcactcaccattatgctactgcatctgtcaaagttatccataaacaaaccatgaactcaccaacgaataagctcacaaacaaccttaataagctacagacaatctcacctctgaatatatgcaaaaattctaggatctattaaaagaataatatgtcagactcatataaaggatattccaaaatgcaaggttcatcctttctggacattgaatacatgcacctacaccaacaagcaaaaattgccaactccttcatccagcaacttcaattttatgttttattcctaaggaataaagcagaaaggtattcgaagatacgtaaggatgtttatcataatgtcacttataatggagaacattgctatcactccttaggaaaaaataataggaaaacatcttacacttaacggttataatctatggtagactgttacaagagacataagtaagatacacaaagcattttgttatttaaaagaaaaaattctagctggctacacaaattaggactttgctgaagaggaggcatttaggacaggtctcagaggatgagtagcattttagcagatatgattggaaacacagacggatgtgtttctgggtcaggagatccagaaagaagtagtgagaaatcaaactgaaaaagtcgactgggtccaaagcatgaagtgtattaaatataaatagtactaaataaatcagtggaacagaattgagaagcctgaagcagattcacatatgtgggaacaaattatatgacaaaagcaacattttaaatattgtgggacacggagttttacttatttaatgatgctgaaataatcacttacattccctatgtcacatcaataaacaaatatagtccagttgggtgagagatccaaacattttaaaatgatacaaaatgctaccaaatacttcagaaaatacggacaaacttaggtttatagataattttctaaacacacaaaaaatcggaagtcaggaaggaaactatagacgtgttttcttctcgccaaaaatgattataaaattgtattacaggcaccatcataaactaacaatacactggggaagaatagttctatggccctaaaacacaaagaactctaagaaattaacacaaataagcgaataaagcaagcaaaataataaaaaaaacataagcaaacatttcacagaaatgcaaatgcaaatggccaataaaatcatgaaaagatgttcaacctccttagggttcaggaaaatattaagcaataaaataccattttttgccctataaatactaacaaagcttcaagcagattgatcaaatgcgatgctggcaaagatatagggaaacagtatcacatattaccaataggtagggaaactgcttgtatattattgaaaaacaatttggcagtacttattaaaatggaaaatgtgcatgtcctttgatccatcagtcctgcttttgtgaatgactgctacagaaaatagaatagtacgtgaaatatgtgcaaggttatttatagcagcattgatttttaatgattaaaaaaagaaaaatgccgggcatgctggctcatgcctgtaatcccagcactttgggaggcctaggcgggcagatcacttgaagtcaggagttcgaaaacagccttgccgacatgatgaaacaccatctctactaaaaacgcaaaaatgagccgggcatggtggcagcacacctgtaatcccagctacttgggaaactgaggcaggagaattgcttccgagaggtgcaggttgcagtgagctgagatcgtgccactgcactcgagccttggcgaaagagcaagactctgtcccaaaaaatattaaaaaaaaaaaaaaaagaaaaacctccgctgctttcaatgtttacctaaaagggggcagttgattaagctggtacatctatacaatgaaataatttgcaactattaagcagaataagtcaggctaattattgaatatgatcattaaataataaaatagcaaatatacaaaatttatatttaaaaaataacaaaacagaaatattacatgtgtgaacatatgcttcacggagatgaagtgggagattatgtgtaaactgtatttgctatttggccagaaaataagatttgcagtgttggaggcaggacaagttttaatttacttaattcctaaccctttggtttgactcattgcaataagcacatatatgttagtaattttgccaagttactgttgtcatttacaaaaacataacaattttttttcttttttttttttttttaagatggagtttggcttttgttgcccaggctggagtgcagtggcgcgatctcggctcactgcaacctccgctttccggtttcaagcgattctcctgcctcagcctccagaatagctgggattataggcgcccaccaccatgcctggctaatttttgtattttttagtagagatggggtttcaccatgttgcccaggctggtctcgaactcctgacttaaggtgatctgcccgccttggcctcccaaagtgctgggattacaggtgtgagccactgcacctggctaacaatgtttttaaaaataaatcataattggttacaacttatattgtcttttaattgctttcctgaaatatgaaagaaaaggaaattctttttataatctacttcccagacaacccacgtggaaagtgaaatatatcaaccagcacatggtccttaattgtgattacattttattgcactcagcctattaagtgcttaaattaccagataacagaatctatgttcctaacagtggagagtgtattaacagtatttttgttccctatcgtagccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacagtaagtgttttcagcaaagcatgattgctctagtcccaaaagtcaaactgaaagtggaaattaactttaactaaatattgtttgttaggtacataaaaaccaagtaataatttataatcatacttcattcgtatggtaaggcatcatgtcaaattaccctatacatagaaatgatttaaattataaatgaatggggaattatcggtgtctttgtacagcatacagaacttacgtccttaaaaatgagctatttccctggcaccagcactatactctgacaagttaaaaatcttggaaaacttattaacttattctacaacttggccagaatcagaggttccaatctagtgtccatcaacgagatcctgcccaggtgccattttttgtaaatgatgttggaacaaagtcacacccacttgtttacatatcacctgtcagtttttgcctggcaatggcagaattaaatagagacagagaccagctgacttgcaaagactgaaatatttgcttttgagcatttttcagaataagtttgctgacctgtggcctaaattaatacatctgtatgataaatagcccctacagcctgcaagtgtttatattgtccaaaaatgccagtcaaccaggttgtgtctaagaattaggaaaatctcgttcaaaagtttttacaatctcatctttacttctaaagttcaaagttgtttgtacttttcatatttgatttacagtatatatataatgggtaagttagggtattctcattttctaggtgaggacactaaaaagagaagcaataggctagagcattgaaataagcaaatatagatgctttgaatatatagttatccaaatttcatattggctgtttcctccaggaaaccatgactgtccctgtatctcaagatcagttccaaaagcttaatgccctttacaggaactcctaaagagtattttgaaatattaataactgaattcaaccagtctttcttcatctttaacaactcctttaggaatttagcattctaaccaaattgattatgcattgcacattttatccattcattcattgatacagttaatgtttgttaagtgcctcgtactgctctacatgccagcaatagagccttgaagtaactcatgatccactggactagaggaaaagcaaactccacattagagtggagcattctgtgtgcagtgataaaggcatgtgaagaggactgtgggaatgcagagtctactgcattctactcagaggagtcaggaaaagctttagagaggattggtaacttaagagctaaacaggggagagcatctggaagaaaaggacatagacatttaaatgtttctaagattgaaatattagtagtggtttgattgtttttaggccatgaatatttggatgaaatccacaaagtttataactgttcataattcataaaacaaatcattaagacaacgctctctagccatagggaaaagtttttttctgtaccccagtggagcaaagattaatgttaaaatacacgttcattttattctcacaccaacagtttgaagtattaccatccctctgtacagataaaaatctgatactgaaagacaagtgttgaaccggaactttactactgaaaatcacaaataatgtaaagcatgcctgttactctgaaggctatcagaggaaagtacgaattctctgtgttcgaagaatggcccacacctaaatagaattagattgtatgttctagggactgaggctcctacatagcatgactctacttactcctcccttaaccccagctacttaattcataggtaatgatgactgtttccagaaatgtaaaaaaaaaaattgctttcactccttattactggtgtacattctagtgagaaagtgctacttaaacaatctggggtgtcgttgtcatgcactgtaggccatctgggtaaagacaaacctacccaaagcgtgcatcactttgaatagaaaaaaaaaaaaatctagattgttccttagaaagagaaactgggctggctggctacttggcatatatttgtgacaggtgtggaatatatcttgaaagcatgtgaactctttcttcagcccatgtttagggtagctttctaccaggctccatcaggaggccatacaccttgctttgccctagaaaatcccactttacatctgctgccctatgacaattatgaagagtgtcctatttcacttctaaaagtatcttggtaactaggtgtagtggctcagacctgaaaattccaacactttgggaggccatagcagctgaacctgtctctaaaaaaaaaaaaaaaaaaaaaatacaaaaaattatctgagcatggcgttgcactcctgtggtcccaaatactcagaagcctgaggtgggagaatcacctgaacccagaaagtcaacgctgcggtgaaccattatagtgcctctgtattccagcctgggttagaccctgtcttaaaaaatattacaaataaaaaataaaagtatgtcggttatcatgtattcatccaacttttgtacttttaaaactgtcatgttagacatgagggctttcctccccatcaaactctgtaaagtgtagataggattcagtcatttccacctgactggcagtagatatggatagcatgatgaatggatgtttcactgtctcatggtttatatttagaatattctctcaatagaatgaattactgtaggaagctctgtaattgggattctatctgttagaagtacagactacccattttatccaaacagtcagtattcatgtagtactgaaaacaatggtagcacattgtttttgaaagtacaattgcaagaatacttatgcttagctattagtttcaaaaaatgaaccagggatctaaggcagcatttctagtcccttttcttggtcaaagcattataaaagtgctatatagatagtacacataagtttaagctgcagattttactgtttttaattcagtatctacattgtaaacataaaacaacaaatgatacaacatcaagaagtccatggtagttaaattaaagttaagatacacttacatgtctaatataacataaataggtcttaaaagtaatactcataaaaaagaaataaaacttggaaaaattaaaatactaagttttggaaataatttgaaccttagcataaactgcataaatattctatttggtatgcctttcttgataataggattttcatgggttaagtcatttctttggctatttctgtcccctctagtttctgacgattgatgaaaaagacctggttttaactcatcatataaaattttgtttctatagttctaatgcaagttgaactcttgcttggtaaagttctcaattaaaaggaaaagaaataaatgacaaaatgacaaaagaaatgcagaacaaagtaaggagaaaaggggtaactgaagggggaaagatggaggcaggaaggacaaacatcatttaagcagttttataaggagttctcaaaatgggaaatattttatgtacacaaaaatctcattatataaagatgtgtgatctgtgagtttaaatgtgtatcatgtgcgtcaccaactagtaacttgtcactctataaagacggtcactatgacctctagacagtttatatttactatttcaactagaattgtatcagtattaaaatattcctttatccagaacgcttaaaagttagttgtactgtactaaatatccagtaaaggaatacagtttcattttcagtgtagagtggtattatagatttccttatcttcataaaacctctggacagtatcctcacaaatgttaatcgcttctatcgtctgcaatttgattgtaagctctttcaaaatagtctactttttttttcatccagccctgtgaattctgttcagcacacagtggataatttttattatgattctatactgttataaagatgaatgcttaggtatgcacatcattttataatgtccactatgaaaaatagatgagagtcaggaaagactaaggaactaatgaagggaactaataatcaccaagagcttaccttctagacattactacgaggtgctttacatacattaactcacaataacccttaggtcttaagattcccatttgacagacaagaaactagacctcaaaatattaaggaacttattaccccaggacccattaataacaaatagtagaaccagaatccaactgaaactggcagtgacaccaggattcaaatcctacctccacccccaaggatagcatgctacttctcagtgagacactgagaacctgaactaaggcatgagatgagaatggcatcgagagcagataatttctactttctatatactatagttaacattttattaatgttacagaaaactgtatgatatattaaaatccttgccattagtttttgttcttttttcttttcttcaaaatactgtttatgtacgttaggtctgatctttaaagatgttttagctgttaaagtatattaaatatttactctaggaaatgatataaaattgttgattcctggttaataatttcatacctaaagacagttttcaatcctgttttatggagaaaaaattcttgccttgaattctactgttattatgaaagtgatgccatatgtatattcacagttgctagaaaacacatgggcaatggattggggggaaagtaaccaatatatattatcttctatcatcatggtagctcattgaaataggaattactatctacagcttacagctgagactcattacagttaaataactcattctcagcgacataatagagcaagggcatggtagcactagaatttgaacccatattcatccccaactgtataatctctccaatataacacattacctctcattggcctacagctgagagtcataatactgaaagtgatctatgcggataaaatatgttgactcctcaatacataagagtacagaagcaacaaaagaggccaataacacttagcatttatcagtagagagttacagaatttctaatgacaagagataataagcaagagttttctttatgcacatctgcttagcattttataaaatgtaacccagagactgatctgaagctgaaatgtattacataagtacggtgcatctggtgaggctttaacagctcctgggtttaaagtgccatatgtctcttcagttttccacatcctaaaataggtggcttgacaaaagctagattttaaaaagttattaggtttgttttaaatgtggcccaacctgtgatttttctttcccagacagatgaaagactttccataatgcagaccacgtcttggcatctgctcaccccatgttattattcagaagccaaagccaatgccctttagttacttgcagtcctctgccaaaaaaaaaaaaaaaaagtttaaatgtaaccttttatgtttctgattttatgttaccagtaattttgttgtttttgtaagaatcttgcaagtactgtactgtctttttcagattacagcctaagacaaattatttcaggccttaattcagtttttaatgttttattttaaaaattttaccactgccctttcacataatgttttttgcctcggaccatatagtatagacctagtggtttataaaatatcttgcaatgtaaacaagaaatctgttgtagaagtcaagctgatctagtattgaacataacctacattttccatgtattttgtgaaggatagccattcataaattcccatagccttaatgttaattaatgtttattcaattatgacattaaatttatttttctaatgtagagcttaacttcattgtaacacaatctacaacccaaattccacttgtgtgtgtgtctgtgtgcatgtttgtgtgtgtatgtttatgcgtttgtgtgcttgtgtatgtatttgtttggacttgcttgaaagcttttatatcaagtcaattaacaagcaggctatatatactaactgcatatggcatcttaagcagccaagtgacatcaccaagttatgccatttcaggattttttttttttttgctattatgcaacatagagataaagctacagaagtatagctcttacacataacaacatagtttggtacaaaagattcacacacaaggtacagtgttcaaagcaacaaaatatgaaatgacatctgtcttttatctgccaataattgacatactgatagcattttttcaattttgagggcagtgtaacaggccacttttacttgtagaattcttggtagaatgaatttgaataacattttaatggcctttcacccactagagtttgagcttacagcaaacagatatgatagcacatttatgttcgtatcttcagagtaagcattttacctataatggtatccaaaaaaaaaatctaaagaaaggaaggaaaaaattaattcatatttgtattaatgtcattaatcatatgtttgattcctatgaaaaatttgttttggaatcaggactctaaattttttcttccaatttctaatggattgttttctcagatgtcaaatctgtttttatttaaatattttaactgttctttctttcctagctcttcatttctgtaacttttaaaaatctcttttgaagttattttaaaggctacagtcatggtacatttagagatagatcaataagtctaacaaatacaatcagttattataggtaggacactgtttcgcctaacattaagtttagaatcatctctactcttaatgatctcactgtctagctgagtgtcaaattctaaccaactaaaatattaaataacaatttaagtcagcaacagaagagaggtaacaagctacgacatgaatattttccaaacgaataagaactacaggtgtccagaggaggtgcacatgactcttctttgaggctgtgattaatacctcttacttaatttagaataaacactgaatcgtgagtagaattaaaagagacagaatagaagtagaacactctatgtagagtgaacagtttaaataaaatacagtgtgtgcttgggagataacacaccagtttatctggcttacaggagtcatgcatagtgtaaagtatcctggcagattagtaaagtttacagaaaagccagatgtaaaagtagagtttaatattgtttgtgtatctcatcactcctatcagcattttagcatatatgacacataactacaaagagatgatttccgaaggcaggtacaaaaatcatgatgaatatttgaaactcactatggtaaagatttttgaatgatagcttgcaggcttagaagctgaatcacagaatgtattccaaggtctacaaatcctgactatgctatgccaaagtggggcttctaaagtctagactatattggccagaagaccagtaagctaataaaagcaaaattccctcttagaaacaagtaactaactttgtgaccttgggtaaatttctttaacctctttgagtcaaaatctgattcataaaataggacatgtttgtttgaaggatgaatgttacagggattaattgagaatttggctcagtgtctaggacatggtaatgactagcactagcatttaataaatgtgagttctttcttgctctttctcctccctgctaaactggctttggtttcggacatctgctactccgttatacccactattctgacatgcatgtgtagttttctttattttttatttttcttttttgagacaggttctcactctgtcacccaaagtggaatgcaatagcatgatcacggctcagtgcagcttcaacctcccatgatcaaacagtcctcctgcctcaaccttccaagtggctggaccgataggcatgtgccaccacacctgaataatttttttttttttatttttagtagagacaaggtctcaccatgttgcccgagctgggaactcccaggctaaagtaatccctctgccttggcctctcaaattcctgatatgacaagcatgagcaccgtcccaggtccaacgtgcagttgtttaatacatcttttttcacatgctctcctcttccttggcagtgacattagaccacctctaccgcagcaaaaactcttttagagccgctctgtttctgtattcttaatagcctctaagatcgaacaagaactatgtagcatatatgaaacaacatataaatgaatgaatgatcaaagccctcagtagcacatataaatattttacagtttttgccaaaaatgttgttagaaataataaattcagtgcaatatttttatacgtatttctttgactgttttaaacagaatatttgtaaagaaagagtcagctttattcaacatttttccttaaaaattggccaatagtggaaatgaactttaacttgtatcttaagatttcatataattacaacagtatctcattcttaataaaataaattttcctctgtaacaattttgcacaaataaaaaaattatattgcaagaatgtaaattaagaaaaattttacagtgaaatctggattcacaaatcatttttccaaagtcattcaggtgttatatatatacacagagagatagaaacaagttgagtagatacactgtatatttctacccgtgctaatgctgccccactacattgaaagagcaattgactctagtacctgacttcctattaaactggttcaggtgccttggggataactaaaccacttaaagtccaaaaaaaaaaaaaaaagaagaagaagattttgcatagttaaaatagcattttatattatcaaaatatcttcactgctattttttgggggtacaggaaatagaattttgtgtgtaacgcaatgctgtgcttcttcaaaatacctatggttgaatgaattgcttttaaaaaaatacgttgaatttttccatgtaaattttaaacttggtaaagcgtttgagaaatgaaatcatccttgtttactgcttacatacttacagcctacccacactgggtagaaaaactgaatgatactcagttagacagtgggagccctctccgatgggaatgtaaggctactggaaaacccagacccacgtatcgttggctgaagaatggagtacccctctcacctcaggtactgttgggagttattaacctgttctgctgtaattttagcgagatttcacacaggacaaactaggcttctttagtcttattgaaagccttttcctgtttctgattcgtataataggacatgtttgtgttaaggatgaatgttacggggattaactgagaatttaactcaatgtctgggatatagtagtcatatattttaatatattttgagtgagaaacataacaaatatgtaagcattttaaaattttaattacctcattacattttttggtaatacagtgtttctttaaactgttttcaatcctataaatttttatgaaactatcaatattatcatagatttatttccatttgtagctaacctttagatatcacctaaaattgctcggtatcttcgttgatagacaaagcactgccaactaagagttttttttttaatgatttgcttggcattaagtagacaagacatttggaggtttaacaacatttaaaatttaaatttgtttttgaaatatgctcttgacttgaggttaccttaatttgcacatgctcaattttttgttttttatactatcttatgatactgaagtatattgtctgaccaataattttatctagaatcgagtcacaaggcagttttctatctgtgttagttttttgggaagtgagtgaaaatggcaaactcctgattggatccatatagtaaagggattgttcttatgacctgggctatttttaaccttgatctcatgtgtctacaacctcagtcttttctactatatgaatccttctttccctttgtaaacggaatgcaaataaaagcatcacctgctgattatatttcacaagctcaactagtgtaccaaaaaagacacctcactttaaaaaccaaactgaaagtaaaacttgtcagaataactacaaaaaaattgtaatttctttttcaaccaataaataactataatttacaagtggcatgttataataaaataatgaacagtacatttacattgctaagtggccaaataatgtttaactgtattaattgcaaacttgttttttcttagtctaggagagaatacccataaaatccatgttatttgtttactttctagatctaatttttttaattccattacagagtagggttgagatggttaatggagtattgatgatccacaatgtgaatcaatcagatgctggaatgtatcagtgtttggctgaaaataagtatggagccatttacgctagtgctgagctgaagattctaggtatgcagtttctaagtgaataaattgaaaaaaaaaaccttgcttcttttcatgctctaatttttactatactgaaggtttatgatgtggttgtaaaaatctattttatggcttgaaaagaaatactatgtcttgctgattttttttaactttagtagacaggtttatgttgtgtatagttcgtcccataactttttgttcatatagtttttctaactttagttttaatcttaaaaggtttacacaatacgtctttgctatagcacttaaaaaaatcatataaagaaatacatgttaacttccaaggaagaatgccttgagggtaggagatcagaatatagaattccagcagcctgtccatgctcccatagcaatgcttaataatttcccaggcagttcctatcagtagctgtgtggctcctgcaaagcaagactccaggctaaatcactctctcctcatggggcatcaactaataccttccttacttaacagggaaaggcttcctgatgccaggcactacaatctcatagggttacacccttgataagaatgtaacccaggcactgcatttcttcactatttaaatactacaggaaacaatccatccagtgaaatagactacccagaaaaagcatatatgagccattggaatgaattttacttttcccactttgattttttcctaaactggttcagggatgtttgtaatgtaaagaaagatactcactcattgtctttccaaagcgggcagaagcccaagtgtgttttctattccccatttaaatttaaattctcaaagcataacttaagagaaacaccaaagatctcaggaatcttggagcccaccatttacatatcagctaaatgtaatacatcctaaagtgatttgttgaattatgaatatttgcagttgaaatttctccacattacaacaaatccatccaaaatagttacaggattcttcctttcaatctccttcattctaaacaatcaaatgttaatgaactttcttgtcaactcacagtataatagcactgaattaaaaggctgattcacccttcacctagttagtagccctgaaacatttctcaaacccttatcattcacaagaaatattttcaaaattactttttgtaaattctattcccaggaggcaaaaaaaaaaaaaaaaaaaaagttacttgcaactatctcctcataaatttctttagctttttaactttttttctttgagacaaaatctcactgtcgctcaggctggagtgcagtgatgccatctctgctcactgcaacctccgcctccagggttcaagcgattctcttgcctcagcgtcccaagtagctgagactacaggcacccacagccacacccagctgatttttgcattttcagtagagatggggtttcaccgtgttggccaggcttgtcttgtactcctaacctcaagtgatctgcccacctcagcctcccaaagtgctaggattacagatataagccaccaggcctggctaatttctttggttttaaaaaatctcttaacctatctcaattctatacatatctttttcaatgttgtgacatgcattatgttgctatatgatatattttatatatataatatgaaatacatataatatcagattggtaaaagtaaatgtcacagatactgtggacttgtagacatctttcaggttctcttttagattcaaaagtgttttgatctaaattatagtatacacagtatttatgaatgaatgatcaaacctaagtgaaaaattacaagtaaaattgctaattgaaattcaaataattcaattttaaaaattaatttttaaacaatgtattatataaaacatttaatgttttataatattaaagtaatatacagaataaattaagattcgtagatgggaaatggaagacacaggattgtctttttcgcaggtcacctccatcttaccaaaggaaggtcaaatggactctgtcagttagccttttgctcttttgccaaggtcattcactagtctttcataattgaagttggtaatcataattagaacatgtcattttttgaaatagcctttacctgtagatcccatattgtatgaaatcacctgctaatgtactaaggtacatattaattaataataagtaaaattttgagctactgcctttttcatgtgtagatatactatgattttatgagaaatgcctcccagaagaaaaagttacaagatcttcatgaatcacccattagagattattgtcattgcttctggtagaaactaacatttgcttttttaatagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaaggttagaatctattttataattcaagttcaacattagacttttttgaggttacaggtgacacacacaaactatgcaagaaagagtcttgcagtaccgtgagacgtattttatgaactgattgaaacatggttttgcctatatagtgattttaaaagaacccaaagtttgacttcaaaatggtcagtcttctttgactccatggggttttagcataagttggatatttcactaggttttgaagaaagtactctttaattaaactaattatttttgtttgtttttcatcttgcttctgcatttaggaggtctacaaatcatctgtgataatttttaagcattgtgttttaatttgattttaatacaaatgataaaaacatatgtgaatcttctggataatcatgacagaatactttcatgtgatatttatgccaatgcttgtctttttatccaggtcatatttaggcaaaatagtataggattatttttagtgccataggcaaatgagaagtgagcagaggaatatttaatatgtaaacatttgtctttggcaactaaagccaaaggatatcacaggagtacaaatggagaaaaaatcatgagggaatcaaatcatcacatggcaatctatttgtaccaaattcaaatgttccatgtcctactattattgatatattggtattacaaatggtgattcaactttgacaaaatagtatcctctattatgtcaaaataatattgtactgtattagattttgtttaattgatctagaagtataaggagtttatgacttgttttatgtttgtcccaatctacataaaatataattaaaataatttaagtctgcattagcggttcacttgaataatttcttaagtaacagtgaaacattttgaaaaatttttaaaaatagagtatttttgttttccatcaaatctgagggacactgatttaaatagtctatttcagattaaacaatttttggaattactggcttcagcttagacccaaagatctatgcttcttggaaagggtgatcacctgggattgggatgggtcgtcgttggcactcttacaccaaaagacctatcataagggtcaaggctgtcattcaaaacaaaagacaggctaacaagagaaaaacataacacatttatttaatcaaagttttgtgtgacacaggggccttcagaaatgaagacccaaagacttagagaaaactctttttatgcttaggttcagtgaagaatagagagccgtgtagaaatatgattggacaaaaagtatgtgatctaatggttatagactgagaggggaaatccaccaaggcctatgtgttcagattcttcttggccattttgtgtggtattcctttcctccaggtgtaggacaaatcacctgtcacatgagacaattcaagggagaagggagaaggtcaatctttctaggttttatagtttgctttgacgaagggaagttatagtttctatgatctgccttgggggagagaattctggtttctatcattctcttcagtagagaaagaggagtttgaaacggacagatgggagaagatcaaaaatatcctgcttccaaggtcctttcagtcttcttcaggtcaaggtactctgtgccatattctggggtatcatgttctgagccccaacatcgtacaacttgttttaaaaagaatttctcattcttaggttggggggcgggtagcaaatgacaaattgtgagatcattgttgcctatgacagaattgatcagatagtgattgaatattagtggatttttgctcacaacactatgatttttaaaaaactgcacaaacctaattaaagtagaagaaaattgttttgttgcatagtaagaacaaataatttacactgctaggttattttttctggacgtattaaaaagcttacagtgtcattaaaatatatatgccttatctacgcaaaacattctatctgaaatgcatgactttgttttatgtttctgggtggcatgtgagttttgtcctatttatttcagttcacaataagaatgttcttcatcaactgttgaaaaatgacacatggtgagtttaaaaaattagggtggaacctcttttaccaaagcaaaagtattgagagaagtaacaggattatgagtattctattacaacaacataagcttactaaattttttatttttcagatgttgaaaaatacagtttgtgaatttttcaactttcttgtttctcttcctttctttactgctaacccttggggttagtgagaaagatacattgacctgaaactcagatcactcaattttttctagatgtcaatacttccagtcaaagtgttgtttaggaagaaggctaaaatgtaatttttttttttaatttattcaagtaaaagcaaggctcagccacatttccttagcattctgcctaccttgatctacatgttttaggtcaataaactggctttattgaataacaaagcccagacatatattgcatttttattcttaatattgacaggcacacttacaaaataccatttttattattgaatgacttgttaccatatctggcagccctaggttttaagaagaaaaatgtagttcactacaaaaaataataacacttaatattaaataagaggctaagatttcaacagcaataggcagaattccataatataagaagacacatagttgaaaaattgtacattctaaaattatgactagaaacttaacaatgtcaaatgcctatattttacattctttaaaagaagtctcagttacaatgacaacttattttcttgaggaaattttagattgcttttctgttataatgcacaccaaccatttgattacagctctaaatataaatttaaatggaaacagaggtgttagaaaactgttaagacttcaaaaagtttgtgtcattttttaatttataacttacattgggtgtggagattcaaatcatggcttattttattggaatataaatataaatatcactcatatgatctacatcaaatatgtgccccactcatccaacctacaacaattgagacaaaaatgttgaatgagttagtgttgtccttcaataaaaattttgttgttttgggttcattccaaagaactattgaaacagcaaatggcagtttctgtataagaaataaataataatattatattggggaaaaggaattaacataatagtatattatgaaagagacattcaggccaggtacagttctcatgcctataatcccagcactttggggggccaagatgcgaggatcacttgagcccaggagtttgagaccagcctgtgcaacacagcaagactcctatctctacaaaaaataaaaaagaagaaaaaacaacttaaataaatagtcaggcatggtggtgtacgcctatagtcccagctactcaagaggctgaggtgggaggatgggttgagcctgggtggtttagctgagccataatcataccactgagctccagcctggatgacagagcaaaaccctgtctcaaaaatataataaaataagatcaaaaagaaatatttaaaaaaacaaaatacgtcaattgctttcatagcataaaattatgtccagagcaatggcataaaaatgtaatatatagtcttaattgcaggaaaatataatctaatcatctgaaaatatgtcagaaaatctcaaaggtaaatttaatttagcattacttaaatttaactctaaattgtaaataaaatgattgaaaatgatagaacaactgaaggttatagttcgtcatttgtcaacagagtgccaaataaccatttggctcatttttttctaccacgttttgagtaaatctgccaggtttagttttctttgttttcttgaaggtcagtgtcttcaaaacacagtattttttatgtgtatatattttgctaaggaaatttagaaatcattattctaaagttgaaaatttgataactagaaaataatatgacttttagaaaaaaatatgattaacaaattagctgcctgcttatatattaccaaacatttcattcatttggccctaaatgatacaactaaaatatacaagaaaatggattacatcagagctaagatttgtttacatttgtttgttatttatatcacagaatgatcaatatgaactcccttcagatagtaaatcacattattactaataatgatgatgactgcttatgagttcgtagcgtttatgatttgcaaagcactttaacgttgttggtaaaagtataaaccagtgtatgaaaagaggacttacttgctctgcttatcctgcagattatgaggtttcagtaagttacctaatttattatcttactaaattaaaagagtaagctgattgggttgtgagaattaaatgaaattttacatgtaaaatatattgcctagtgtatgacatctactcagtactcagtgaatgttatgtataatgataatgatactgatgacgatgatgatggtggtggtggtggtaatggtgatagtgataatgatggtatctgtatcaagccattttcctactcctataaagtactgcccaagactgggtaatttataaaggaaagaggtttgattgactcacagttcagcatggctggggaggcctcaggaaacgtacaatcatggcgtaaggcaaagcaggtgcaaggaaccttcttcacaaggaggcaggaaggagaagtgccaaggaaagggggaagagtgccttataaaaccatcagatctatgagaactcattccctatcacgagaacagcgtgcggaataccactcccgtgattcagttacctctacctgatctctcccttgacatatagggattatggggattataattcaagatgagatttgggtggggacacaaagcctaaccgtattaatataatttgtacctttgaatcttagaatactggcatccatttctgttatcagtagtctggaaatgcttaccattctcctttctttctccagtcattaaggaaaagaatacctaagatttgtttccaaggactaaaggagtcttttacatcttttatgtcataaatttgttattcatcaatctatgtccgcaaatcactattctttgttcatcagagccccaaacctgtcgtcatttattcctggcattgaaaatctcatctcccttacctatttctagctcaatgtctttggaataggttcctgtcctagccgaccaaatatttacttgttccattaacattttataggccatgtgcaaatagacaaatagacatggggagttaatggaaatagaaatgaagtattttaaagactttttttttcactgtttttctttaagggctctccaggttttccccccatcactttcacttttgaagattactggcacacagtcacttaggttcctgtatcaatcatttcccttttcatactgaaactaataaactccagaagtactagtaagtaaaatattccacagggattttctcctctagcagaccttcattcagaatgttctgctcatcaaactcatattggattttcactccagctcattatttccattacttggccattaacttttgttaaaatataatcatccagaagcactccagcagtgcacaaatattaagtcttcattattacatgttcaatttcctgtactttttgtggacaaagacaatcttagctaaaatgaagaatacatagtttttgataaaggtatagtttattttgtttcctttccataagtgcatatataaactgttgttgaacctcatagaatgtcatatatgtttaaaattattcacaattattgaaatttcaacatattttaagcactagtttttatgcccaggcagagtaaggtaacagttatgaagataatggactataattcaaactggtgcttaagaaatcctgcatacaaaaaaaataaaattatcctatggaggtgcagtattatagaataatttttcttttatgggactgtaatctaagcaaagacttgtccaaaatctgacataatggccccctgctcactaaaggagcttcagaaaggcaaaattttcaacttatttaacacgcatagaaaattgcactagaaatacccattatttgacttctagtgggaattcatgttgtgtttattaggcaacaatgatgaagctcacatactgactcagagacatatgggaaaatctgttcttaacaaaagccctaaaggacactgttgctgagaagaaagcaaggtcttcttattttatctatggaagaagaattcatgggtataattagggccctgtttttgtccctttgtttccacctacatgctgggtttgctaatgaacaagctgttttgttgtttcctctgtgacagtgtcttttacatattaagaacgtaaaacaatataaactttaagtatctgggttttccttagtgtgtaagaaattgtataatgaaagaaaattagcattcataaatcaagaatgtacaatttgaatttatatgtgaattaatatctatgttttcaaaagaaataaaatgattaaatggcattgtttacctaaaggaagaaaggtttatatctgaatttataagatttagtaactataaactgcttactatataagatgccttagtactcagggatggtttcttgctgtttcctatccatgaacttaaggggatgagaaggaaatggccttacattcattatgatgagattaagatactgacttcctgatttcagtgaaagctaactgcacaagactctgcctgagtcaccttcttcatcttttccttagaatgctaattttttattagaaaaaattttaaaatataaagcattagcattttattatattttattagaaaaatataaaaggaaagaaaacacagtcatagcagcattggaaattaagaatatatagcattggaaattaagaattgttgacttctgggaggaatcaccgtttcatatagaaatgagctaaattaagaatttatcaatgagttgttgaaagctagacctctgaaactttaatgaagtcaattaagaaaccagcagaggaaaaattttactcacttctactttatgtccatatctactaaattcagaaattgcatcttactacagaagctggcttgaacctccctcccacctgcaaggtggtaagatgctatgtccgtattccaccccatctgaactaatccaacactttttggacattatgaatccagcaatggggtgagagaggacataaatcttaggatttcaagtgattagcaaataaagcataatgtcaacaaatggtgatactgaggaaaaattgaaattcatggattctggaaattatgtaattccgtgtactacttctagcaaaagaaggactatataccgtttctaatttttcaggagtaaatttacctctagatacgactaaggactagaaaatggaaattgacaaacatctcacctcagtccagttgagcttcattatagccttagtagaccttgagcgtttgactacagctgtgtacctaactgaccttgagattaatatttggggaacagattctggagcactgagagaaaaaagagacaaataaaactgaaaatattgccaattggcaaaaataggcctatagacataggagtacaagagagtttaaagcacaaacacacattaagcatgacagttaactgatagtcataaatttggtaacaagatgtcaagcaaatataaaaagaatcatcatcatgcttaagtacaatacaaaaaaattgtgtgtgtatgggtgtgtgtacaaataagttaataaatatcaggagttgcaaagcaaaaagctgaaagcattctaaatcatggtggcaacgcaagtaaatatagtcatagtccatataggaaaaattaaagatttacaaaaaacagatatattgtagaagcattgtaggtttgcttttattgagatagggtctcacaatgtcacccaagctggagtgcagtggcacatacacagctcactgcaacctcgaccttccagggtcaagcatttgtcccacctcagcctctcgagtagctgggaccacaagagcacactgtcaccaccatgcctggaaaatttttttaatttgttttggtagagatggggtctcaccatgttgcccaagcttgtcttgaattcatgggcttaagcactcctcccagcttgacctcccaaattgctaagattatacgtgtgagccactctgcccagcccactgtgggcttttttaattacatttttgatgagtacttaaggacaatgataaaataatggtatattatcagtggaagaaatcattgaacacggtagaaatttcatttgaagagaaaatgtctgcatggacacaaatacattaaaaatactggaaataaatgcagctaattgttcacaggttatctctgagaagaggattatagataattttcaacgccactttatgcatttctcttttgcatcactgtgaggaaatacctgaggcatggtaatttataaagaaaaagaggtttaattggctcacagttctacaggccatacaggaagtgggatgccagcatctccttcaagtgaggacctcaggaaactaacaagcaaagtagaaggtgaagcagaagcaggcacctcacatggccagagtgggagcaaaagagataagaaggctgggtgcagtggttcacaccggtaatcccagcattttgggaggctgaggcaggcggatcacctgaggtcaggagttcgagaccagcctggataacatggtgaaacactgtttctactaaaaatacaaaaaattagctgggcgtggtggtgcattcctgtaatcccagctactcgggaggatgaggcaggagaatcacttgaacccaggaggcagaggttgcagtaagctgatattgtaccactgtactccagcttgggcaatgagagcaaaactctgtctcaaaaaaaaaaaaaaagagagatgggaagaggtcccagagtattttaaacaaccacatatttagtgaactgagcaagaactcacttatcatcaggggatgatgctataccattcacaagggatctgcatctgtgatctaatcacttcctaccaggccccatctccaacactgggaatctgatttcaacatagggtttggaggggacaaacatgtaaaccgtactatccatatttctaagcttggtctctttaagagaattaataacccaaaataatgcaaatttattgaataacagtgtactcacactctgccaaatagttgaatgagaatgggaaaaaaattctcacattttcaaataattccattttcaacagtatgtttacatagtataacgatgatcacaaatatctaaattaatggcatccacttaaacacagaagatcagaagataaacacttcaggaactctcaaaatatcagttcctaatattttccaaatttagggtgatggaaaacctaaacactcctctttaaagtccttcaaatattttctttttcttgaccactccaccagtttgtttctagatttcacttttttcttaattgttgaatataataaaataagtctcaactcccaacgagagataacactgagaaactcagttaatttaagctgtaaatgacaacagaacaagtctggtttgttgtactatgagcacctccagtttttgactttacatgttacatctctagctaattaccagtttaggaaacagtttatgaattctacttctaaccatggttcatttaccccagttactataaattgcttcacaagttgcctggttgtgctctccacataagcacaacttgaacaagccattaattgctcacaggtttttcttttccaaaagccccccagactacaactttcagcttaatttgtccttaatacaaacagcatctaaaatacttgggaattcaagcatctaagtatatgctcctaactgattcgactacctccccaagtgactcttcagtgaatataaaatggtgaggagagaagattctgaggctgcttagaaaaaaagcattgtacggtcgagatttttagcatcctctgagaattacatagtcacttcttttcagattttgcataaatcacgatgtaatttaactttggttaatttataatgagaattagaggtttggttacaaattaaagcatagtacaatgataaccttgactacaaatggaaagaaactgtacatcatttccatgaaatataacatatacagatgttatcatttgcatgcttacatctctgtgttccaatgacagtgtggtttctgaaaaaaaaagaggtaggtaggtaggtaagtagggagatagattgatagttaataaaatacctatacattttaagatgattactatgttattagttaatagctggagttttcaagataccaatatgattttgttcctctttctttccagttgcaaatggtagctctacttctccttttccttaatggagagagaaaacctttctttctctaccctctgaaggttcagtaactgagtctatgaaatataaaccgacagtagacagattaataagacaaaatgcatacaaattgattgtgtgcacaggggcatcacagaaagaaaagtgagtacccagtaacccaatgaagtttagaagcttatatatccttttcatagaagagaggggtggtgggatataggccacttaagggggagtaaataattttggggagagaatgaataggcccaaagagcacgtggtaaccagtgagaaattctgtctgggtgtggcgctaacttccggtctttttttctgggatatgtgtcaatttctcacaatgatgagtttcctggggaggagatccaggatgaattgaattttttctggagtatctggtatcaaaacaataagaaaaattcagagaaaacctctgcctgctgctgctggtccccaggtgccttcaatttaaagtaatcagcacaacaaaacttcatattttgggataacattcccaaaactccttcaccctcatgcagcagacacatggtctatgaacagttatattcaattcaatttatttccataaaaactaaactttcttcaacatatactgtatataagacactatgccagttcataccaagataagtaagagagaatcccatctcccaaggaggcacctgtctggtggaaaataaaactaatatagacacctataaaataggataaactaaggtaataataaaaataggactgactgagcattgggtatttttatattgcattactttattaaagtcctcaaaataagatacgattttaaataatataatcctgattataaataattaaatcatagagagactgcctaagcacacacactcgtaacaagtaacagagccaaaatgagagcgtcctaattctgtttgaatctaaaacctgttctcagtctactgtaccatacaaaaaactttgagagttaagaaagaagaaaataaaatctagataaaagataagcttcctgggggaactgccattgaagtggtcttggaataggattttaacacagagggacagagtatattttaggaagagacttcagaatttgcaaaaatagttatgaattcaggacacttttgggaaagtaaatactaatatttgtccagggtatagactatgtatcaaaatgaaaaatctgctgaaacaattgaatagctgaagacaaataaagaagaacttgaatgcacagattgagttcaagcttaacttagtagccaagaggtagtctttgaaagactcagttcacatctttttgaattaatatcttttatttaattttttaaattatatttattttatagaaaaatgcccactaattactctgtctaccaaagagaaaagaattaaagttacgacttaaatataaaatatataaataaatattacttaaatatccttgtttcaacaacgagctagcaagaagctagaaggaaacttctggtatcaaaacaataaaaaaaaagaaaaatttttagtgcaaccagtaaaagcattgaaataaggtatgctatttccaaactagttaaaaaaataaatataatgaaaagttaaccaatcaaaaaacagagggatatatgtacatataccaataaaaaaacagagggatatatatatccatatatatgtatgtgtgtgtgtatatatatatgagataatagaaagcataaaataattcagaaaaaccaaatatatcagaaattactgtaaataccgaactagaaataaaaattcagcaattatatgtaagagctttgttttaagcaaaaataaatagcaaagttgaaagttaataatgggaaaaaatgaatcatataatattaaccccccaaaacttgtttaactatatcaatacaagaaaaacagactatacaagaaggaatataaaaatagtataaaatttccccactatcagagtggggaatctcaaatatattccttgtatttcagaatataagggaaaatttatcgctctatgtatttatgttacaaaagaggggagttgaaaatgaatgagctgagcttctatcttaagaaattaggaaacgaacatgaaactaaaagtaaatgcaagaaaataataaattcaaaaataattcaattacaaacaaatataagcacaattagaagattggtaaagtcaaatattgatactttcagaggaccaagaaaatgaacatatctgtagtaatcctaaaatcaagaaaagagctacaaaatactgagagcaaaaatgaaaaataagcacagatgccataaacagataaaaagaaaataaaaacatgataaataattaaatgacaaaaaattggatcatttgattaaatgaataaaaaatgatatttcaaattgactcaagaagaattgaaaaatttaaataatttcataactattaaattagtagttaaaaaatcttcaaacatacaccaaaaaactcaaggtgtaaatgctttcagtagaaatttctaccaaaaaaaataagaacaaatgatcccaattgtacacagttatttcacagtatagaaaagagggaaaataaccctaacaacaaaatttgccaaagacaatatgagaagtaaaaacacaagccaatcaccctcatgaacatagatgacattatataatgataaagggttcaattcaacaagaagacttaactatcctaaatatacattcacccaatactagagaacccaaattcataaagcaaatacttctagacctgcaaaaagacttagccacacaacagtagtgggggaactcaacatcctacttagagcattagacagatcatcaaatcagaaaactaatttaaaaattctggacttaacttgaccaactggacttaatagaaatctacagaatactctacccattgaccacacaatatacattcttgtcatctgcacatgaaacacacttccaagatctaccacatgcttggccataaagcaagtcttaataaactaaaaaaatagaaatcataccaagaacagtggaataaaaatagaaattaataccaagaagacctctcaaaattactcaattacatggaaatttaacaacttgctcctgaatgacttttgagtaaaacaataaaattaaggcagaaataaaaaaaaaaattctttgaaataaatgaagagacacaacacaccaaaatctctaagatgcaaataagcacaatcagaaatgacaaagatgacattatcaccaatcacacagacatacataaaatcctcagagactattatgaacacctctatacacacaaaccagaatatcaagaaaaaatggataaatttctgaaaagcagtgttaagagggaagtttacagcactaaatgcctaccttgaaacatgagaaacatctctaacaatctaacatcatacctagaggaactagataaataaaaacaaactaaacccaaagctagcagaagaaaagatataactaaaattagagcagagctgaataaaatactgagaaacaaaagttcatgcaaagaatcaatgaaaccaaatttggttctttaaaaggataagcaaaattgacagactgctagctaaattaacaaagaaaatgagaggacatccaaataagcacaataagaaatgacaaaggtcacattacaaccaatcccacagaaatacataagatcctcagagactattatgaacacctctatgcacacaaatcagaatatctagatgaaatgcataaatttatgaaaacacacattctcccaagattgaatcaggaagaaattaaaagcctgaacagaccagtatccagttccaaaatgcaatcagtaataaaaacctaccaaccaaaaaacactgaggaccagattagttcactgacaaattctaccaaacatacaagaaagagctgatatcaattctactgaaatgattccaaaaagacaaagaggaggggctcctccctaagtgactctatgaagccagcatcactccaatatcaaaacctggcaaagatacaacaaaaaagaaagctacaggccaatatccccaattaaaaaaacaaaacattctctaaatatactagcaaacctaatctaaaggcacgtcaaaaagccaattgaccctgattaggtaggttttatttctgggatgaaaggttggttcaacatatgcaaatcaataaatgtgattcatatgtttgttgaacacatgtatgtcttcttttgagaagtgtctgttcatgtcctttgcccactttttaatggggttgtttgtttttttcttgtaaatttatttaaactccttgtagattctggatgttagacctttatcagataggcagattgcaaaaatttcctcccattctgtacatgcagccaacaaacatatgcaaaaaagctcaacatcaccgatcattatagaaaggcaaattaaaaccacgatgagatatcatctcatgccagttagaatggttattattaaaaagttataaaacaatggatgcttgttgggctgtggagaaatggaaacacttttacactcttggtgagaatgtaaattagttcaaccattgagtaagacagtgtggccattcctcaaagacctacaaccaaaaataccatttgacctagcaatcccattactgggtgaatacccaaaggaatacaaattattctattataaagatatgttccttgcaacactattcacaatagcaaatacatggaatcaaaccaaatgcccttcattgatagactggataaagaaaacatggtacatatacgtcatggaatactatgaagccatagaaagggacaagatcatgtcctttgcagggacgttgatggagctggaagccattatcctcagcaaactaatgcaggaacagaaaaccaaacaccacatgttctcacttataagtgggagctgaacatgaaaacagatgaacacagggaggggaacaccatacactggagtgggttggggagtagaggggagggagagaattgggaaaagtagctaatgcatgctgggtttaatacctaggtgatgggttgacaggtgcagcaaaccaccatggcagacgtttacctatgtaacaagcctgcacatcctgaacatgtatcccagaactttaaattacacttttaaaatatgtgattcaccacaaaaacagaattaaaaacaaaaaccatatgatcttctcaatagatagagaaaaactttcaataaaatccaacattttatgataaaatccctcaagaaattaggcattgaaagaacatatctcaaaacaataagagccatctgtgacaaacccacaaccaacatcatactgaatgggcaaacaatggaagcattcaccttgagaactagagaaagacaaggatgcccaatatcagcactcctcttcaaccagttagaatggttatctttaaaaacagcagtgaaacctgatcaatttgttattttctttttccctctgtccctctttctttttcttttcttttctgcctgcctgccttccttccttccttcctctctttctctttctttctttttctctctttccctccctcctttcctcctttcctccctccctccctccctccctcccttccttccttccttccttccttccctccctccctccctccttccttccctccttccttctttcacatcagaaatttaattctcactgtctgggggctaggaagtcccagtacaagctaccaggagattcagtgcctggtgagagctcactctctggttcacagacagtgccatttcactgtgtccttacatggtagaaagttcatttatttttgtctttaatatctatcattgatttatattttgtgcactgctaatccttaatcaatttttaccacagaaataaaatcttttgaactgcttaaagttgttttctctctctatctacacacataatacacatcactttaccccaatagcctaagaactggcctctctttatccagtcttgctctgtacagcattctctatccagcaatcagagttttaattttagaaaataacttgaatcatgtcagtttactttttgaaactttccaatggcttccccattatttggaataaaattacaactcccttctacgacacatgagactctgcatgagctaacttctgcctttgtctttctctttgtcccattcccgcatttcttcatgctcatgaaagtccagccccatcattacactccctgttcggtgcatgcagtagatttattcctactgcaggacaaggcaccacttatctcctcagcttgaagtactgttgcccagagtgttgccttatggtctcctgaaatctaggtctcaggtcaaatgttaccttctcggaggccttcctgaccctctatctgaaattattacccctatccttgttacttctctcacacatctcatctggtgttcttcaaatcactcatcacactctgcaatgttctttttggtttattttttatttattcttttttttttttttttttttttgagacagagtctcacccttttgcccaggctagagcgtactggtgtaatctcggctcactgcaaactccgcctcctgggttcaaatgattctcctgcctcaacctcctgagtagctgagattacaggtgcccaccaccatgcccagctattttttgtattttcagtagaaaatgggtttcaccacgttggccaggctggtcttgaactcctgaccttgtgatccacccaactcggtctaccaaagtgctgggattacaggtgtaagccaccgcgcccagcctatttattcattttttatttgtctcactaactaaaattgaatcagggggcttgtttgcttttcattcagtgaccccagagcctagaattatcctttgtacatgtggaagctaaaaaatatgttttaaatgaatttttggagtaacacatgtacccaggtcttctgcagttcctaccttatatgtgtccatgactcaacctcacaaaagtgtgtgtagatggtaatagctcaagctaatttattaaggatattatgaggaatgaatgagacagtattatataccactctgaatttctttgaaaaaatataataacaaaaatcatattattatgactactttcatattactcagataaagagtaattacttttttatggttaaaatagcatggaaattgaatcagaaggttgtaagcagaagtagggtcagttccctttgtttatttaagaatattaactaagctgagttggattttcaagaaagcttgttttctactagtttaaattctgattatctggtcaactgaatttttagaactatcactaaattaaaaagaaacagcagtggggtgtaacttttctcatctttacttcatttacccggtgaagcatctgcaaagcctctgtgggaggtttaaatgctaatattcagaaaagcagtcttggaagcaaacacccagctgtatttaaggcctgcattttcgtggtgaatgtgtctccagggctgtacctttccactgcccagacttttaagcaccatccatattaagcacaaatcagaacgcttttcacaaaccacttaatgctgtttaaaacccacaagtaaatcatcttaactaaaccctttgatatagctttgctctccaaactgtccctatctggttttaaacactattataagattgttttaaaaatttagaggtggcacaccacattaaagctgttatatctgtataaatcatgtgtggaataggactgtgctcttcccccatactgagatcaatgcttaaaattttatgtgattgtcctctttgcgcatatgtgtgtgctgggaggcggaggtggggtgcagtatgcttgcacctgtgcacctggttttaaagcggtgatttccaacttcttttctctttgagttggttgaggccctggtgcttgcaatgacactgaaacaagatgtgctttttaacatataggctgtaaatgttagtatttctgagtttcgcagatccctactcgccctggttttggagaaaaagctaagttccatcctcttgcctcatttcatgggtcatttatatgtacatgagcctcttcagcagcaatatacagtatctgcctcctctctcaatgaccaactttgagtattgtccctgatccgccatacatgttctgcaacagtgcggggttgactcaaagacaacaagagtggctatttccttctgctagttcagccctcacagttatgatctagctgtgggaagccctgttttctctcgggtgttctctataccacagctagtgtttgttgatcacttctgaaaaatgcactttttttgagacagtcttgttctgtcacccaggctggagtgcagtggcaagaccatagcgcactgtaatctggaactcctgggctcaagcaatcctccatcctcagcctcctgagtagtggggactacaggtgtgtgccatcatgcccagctaagtttttattattttttttttatacagatgaggtcttgctatgtttctcaaataggtctcaagctcctggcctcaagtggttctcccacttcaacctcccaaagttctgggatttcaggtgtgagccactgtgcctggcccaagttgcaagttttcaggtgcacacccctatttaattgatgtctttttgaaaatatatataataaagcaagccagggttctctaattttttctacagtctgtacaacctgacttgagttcagggccacaatcaggacctcatgactgctcaacagcttttgccaaagtggcccagtcacaagaattacacgtggattttgttaggaatacagacacctaggccccttcccctggaaattctgatgcagcagatctaggtggatccccatgatctagaagttctattagtgcctaagtaactctcatgagcaggcagaaggagcaaacacagctggtcaggattaacatttcccttcagggtgaacaggagaaagtttcactctccagatttgtaccaattaactcaaattatgcaggttattcataactgtgtcggatccttttgtttacctgaaaccagacatatttaggctttatttaataatggtggttaattacattgttacatctgacaatgagaaaagaaggaatctcttgggttaaaaaaattaaaaattaaaaagcacaatgggagccaggtcttcaggagactgaactgagcagatgccctggatctggtagatgcggaaatcttatcagctatggtctatggatctaactctcaggtgctcccacttgactgaaaacttcttctttctccacctcttcatctcattgtgtatcttgctcctccccctgcctccaactgggtaagaactcatattctactaggcaacatactgagcacatgactttaatccagtccgtctgcctctctcacatcagctgcataatcatttagcttaaagtgacattttaaaatctcagttttcttactagccttgatttttaaagagtcagtcgacttttaaaccttttaagactttaatgttatcaaacgtttaaataatatttccctaatcactggagtaaagccctgatgtgtgttgtggaggggtgatttaattttctgggttctgagtacctcttttctaattgatattcttcactgccagcttctctaaagagagatgggtttgtggggagggtggaaagaaagaagaaatgaaagaagaaagaaatgaaggaaggaaagcagaccaggaggaaaaaaggaaagagagagacagggaaagaagaaggagggagggagggaggaaaggaaggaaggaaggaaggaaggaaggaaggaaggaaggaaggaaggaaggaaattaaaggagaaaaaaatcatcattattccatttatgcttgtttgaggaaaggtaacacatctttttatgagaatttgttgctcaccttgtataagtagagacactagtatcagtcaagacttcacatagaaattattattcattaaaaatcctttgcacaaatatatttaaaaattacttaagctaagcaaatataaagcactttcactccagtgaactgagtattttaggatagcatccatattgtagcacgatttctccactttgcttattagatgatgatattgcacaaagaactaataagccaaaagagggtgaaatataaaactagattccaacttagaggatggatatatgctatcaattttttttctgcaattacaaagtatcttcatttacactgagtttccaagaaaaacctagactatgtttttatgtggaagaaactaactagaagtcttgttgtcattgttctctttttattaaaaattactgtttttgaggggaagaaattaaagtatgtttttgagtggaagaaactaaccagaagtctttttataattgttctttatttattaaaaattcacgatgtgtttgaaaccacctagtgcttatttatatgtagattctggtgtctagatgtatatgaccacaggcaacacagtacacatcatgggtcatgtccatgccatctgtgcaaatacatgggtaatgtgcgtgggttcattgtgtatagttagttaccaatttgtctctctgtaaaaaattgattttaggtaaaaggctctatttgaatatcctagagcaagatgttgtttgaaataaagtttgaaaaatgtgattgtacttttagcacacatttcctcaatcagtaatttagtctcaagtttggtcttaggcaagatctacatgtaaggcttatttctgatggtttctcaagctgggagagaaaacaattaaagaaaatacttagtcagtttttatctacacgtgtgccttcggtgatttatttaagcattccaacagataacatgtctccattatttttagcaaagggctttttgtcagtattttgtctccagttataataagtgttttaaacatctgtcaaagctgttctacttcccactcaacagcaaagaaaccatgatatgtgctggaggtcaggaataccagctacaagcagaattaggattaattattggtagacagggccgatatcatggtctggccacctgtgcagttacataaagcactaaagttagaaggatcctttgcttgctttagtgttttactggcaccaaattgaaattcctagtaatttttgaacaagaaacccatgtttttatttttcactgggccccacaaattgtgtagccagaactattgctagactatttgcttgacgtgtagtcccaggcacattatttaatcttcctaggcttcattttccacattttaagaaggggaggataatgacacctatttcattggttttgcgagaattaaaagagatcgcgctttcaatatgttaagtagagcacatggctcatgttaaaggcccattgttctgagattcactgatatatacccgtattctgggatagtccgtctactcgcaccttttgcccttggctagtgtgtaaacaactacttcacatcatcccctgatacctgatctccctcccacctgggagctccatcactgttgctaccattctcctagccatccgggtttgaaatgataaaccccttgactgcctaggccttattggccaccaaaacgtacaaattatgactacctcatcatgctctaacactctcatcctagtgacttatatccagttcccaagtacacctacactagaatgtagtctgcatattctaccacggagatcaatctacctggcatgtcactttctaccagcatattagtctgctctaaaactttttggcctggggaccaataattccctgtgactctcccgaccacatggagaaagaaaggaaaacatgaatttacatcacatgtgtatttaaaggcaaatcagagactacacagtagatggaaaaagcttttttagctactaatgtaatcccagtagctggggaataacagaattttcaagctgcctgtttggcagagaaacccagtgttccacaagactttgctcttctcttcatttgtttcttaaaaccacgctgtgttatttaaggaaatgatgatcaacaaaattctaactgaaaagtaacttgatgaaatattttccattaaccgttgagatattatagaaatgtactttttcctaagtgattctggggcagaaaaatacctttataatcctaatatatcacaattcctttagtgcctaatattgagggagcagcttttattcaagatggaaggaatattagatatcattcaatctagcttcctcattttacagataataaaactgaggatgagagtggtaaagtgatttgctcaaattcatgaacctgcctctcctaatattcagccaagtgtcttttccagaatgtcacagttccctgtataataagaatcagctttattttccacaagaataaaagaggttagagttagaaaaagaataagttttctggatacagagtgtcattgtgtctatgtgaaggaatgttagcaaaagtgaaaaaaacaaaaaccttgtacagaataaaagaagttattcctggcaattgactgaaatggaaagaaatcataaaagacttgaatgacaggcaaatgaataatgtgatgagatatatcaaattttgactctactgagatcaaaaggaagaatagagtatagggaatgaaagatgatgtctggatttaacattcatttgggaatcatttcaaaatcttgagataaaaggttctttagaaataataaatgttgtgtttctttaatttttagggactgagagattcatgcattgtcacaagatgttattaaaaacagctattcatttttcatggaatgagacagaatgcatattgtatattggaggcaaaactatatcctctgttattcccatatatttcctttcaatagccgatcagatgaaattgtgagtggatatgaaaggacaaaattaaacatggtaaaagaaattaaatcggggagtttttttttaagaaaaaatccttcatttgtttcgttgtcagaattaccaagatgagctaggtaataggttagctttacgagctaaaagtcatcatctatacatgcaaatcacgttgcatgcaaacgttctttctggtccattttcattagtgcttaagtatggagagactactacaggactttaaagcttctgtccaattacccagggacatctcaacatgaattatagctatgtataagcaaaaaaaagtatttgactttaaagcaaatacatcagactgtaaagcaaattcaatattattcatcttttgttgtattcaaagataagaaagtagtgattacttacattataaaggtttaaatatctatatttacccctgactttagtacataacaaaatatgaataatattaagattcccaggatatgataatttcaataataagaaagccctcttttgactaggattttcttatttccaacaggtttttgtgttgtgtttaatctgtctgtctgtgttttagatttactctattaggaaatattagttccaaccattgtccttacagctgtccttgcaggaacactactcattttggaacagattagtgtatcttggtaccccctttaccttgaatgtataaattatcttttagatctatttgttgctatgtaacaaaccaccctaaagctgagtggtttctaatgttattgcccagtagcattttgggccagcaaaatggttattctcctgggcttatcatttgtctgtggtcagccgcaggttgagtcagcagtttggctgaccttggctggtacctttcatatccctcatcacatctgtcacatctgtacagcacaacagttgtccacaaattccatcattttctagcagattagccggacttgttcacccggtggtgagcagagtgtcaggaaaatgagtggaaatcttcagggtttcttaaagcctagggtcagcatcatttctgctgtattctactggtcaaagtatgtcacagagcaggtccagattaaagggcgggaaagacaagtgggaaaaactgcaaagtaactttggaaaagagcctaggtatacagagggggatatttgcagccaattttgtaaacaatttacaaattactgaagaatttctacagaaaattcattttaattaccttggttatacttaaacataaaaacagtgaggcccagagatgtcgagcaactggcccaagttcacacagaaagttaaaagcagaactggaataaccaactgtcctagtttgcccaggattatgtcagttttagcactgaacatcccacatttcaggcaaactggggtggttggacaccctagggaaagggctaggatttcctgattcttagtttgatattattttctgaacactaaaattgatctatgtgactagctattggtgtttaagatcaatctaccctcattcctgcatcctctattagcatgcatgctgacatttaattagtttgtccattggttagactctactctgttccaaaatggtttaaggcattttataaagtactgtacatcacaaggggataactacacaaggctaccttgccattcttcaaacattccacgtattttaatgtttatgaatgctaattctttctgctttgtgattagtctttctctttctagaatggtttttgcttttttttttctattaatatcattcaatttatagtttccaattaccttctctgtgatgtaggccccagttgaagaattcatcattatctcctctgagctcctgggagacttggcccatattttgatcgccatacttagtacattgtttctactaagttacgtgttatctcattacagtgtgttttcaccttacatctcctttatttagtataatcttccatatccagtaggcactctgtcatttctttaagtcattgtttctgttgcataaatgagtgaacagactgtttagtgacagcctagtgaaatgtggaaattttcactttcttcactaaaaacccttgactgcttttcttcttagttccaattatccatttgctgcatttttatcttttccgttggtataattcctgccctaagcaacacagctctcatataatctgctgggttttaattggctgcagtttccaaagctaaatgattagtttcaaaaagattgtttctgacccaatgcactgtaaattctgcacggggatctgaagtgcttttgtttgaggccctgtgtttttgtgtttgtgtatgtcatttttatacccattctggattagtttccagaatatccagaaaaataccaaacacataataggtgctcagtgcacttcatgattcattgttttatcatttgctcatatgtctctatacacccatttatacttcagggcccttcataggcctcttcacttttggaaaactttcctgagcaagcccctccctgtccagctggagttctacaaacatttaccatagaacccattcttttatattttcataaagtattcaattctttgtctctccatccactgtctgtaaactctttgaagctggcatctgtagactatttgcttttgctgtacctggctcacaggaggtaccaaaacaacctttgtttatgtgattgattagtcaaattgatgaatcaatcaaaaactacagtttcagaggaaaatgttataaaaagaaaaagtatttcagacgtcttcttggctcgtattacctgtgtcatagcttttccatattcagaacagtttgcatcttagaatttggttagcagatatacttataagactttgcaggtaagaagaggaaatgcccagcaatcagcttgctaaatttctcaatttgccccacctaaacttgcaacttaaatttagacatttttctgaaataggtaagtctaaactatgagtaggatggatttccccaattttcttgcatcaactgatacaatatctacaaattatcgaaaagatgtcaaaaacacatggggctttagccagtccttataatgagagatgggtcttggtttagcagaagaaaagaatacatttcagataaggaaaataaaagcatctaatgcataaaatagaaacaatacggtatgttcctgtaatagtgaggcctttcatacctttagaatacaggataaaaatggagatttgcatcaacttgatgattggaactaagctgggagatgtaaacttggcatgttggtatatatgagtagaagaggagctttcaaaagtagcattcatgcaagttcagtggaaaagaccagtgacaggaaaacacttgtgtaaacagacatgatattctgacagtgagaatggggaggaaggtaaatgctcaagaaggataagattaaagtgaattatatttctgaagggaggaacaatccacttttctagccttttctcttgccactcagtcatgtatcttttacactccaatgatagagaatttctcataagcatcgagcttattgcatccctttagattccatcatctttcctcatgcagcggcttctgctttatctttactctaaactcctaagaaattccaatgtattctttttttaattttttaatttcaatagttttggtggtacaggtggtttttggttatatggataatttctttagtggtgatttccgagattttggtgcacctgtcaccagggcagagtatactatacccaatatgtagtcttttattgctcaccccactcccagactttccctctgagtctccgaagtccattctacaattcttatgcctttgcatcctcgtagcttagcttccatgtatatgtgagaacatgcaatacttggctttttattcttgaattacttcacttagaataatggcctccagctccatccatgttgctgcgaaatattatttcctttctttttatggctgagtaatatcagtggtgtaaacctaccatattttctttgtccactgattggttgatgagcacttacattggttccatagctttgcaactgcaaattgtgctgctgaaaacatgaatgtgcatgtcttttacatataatgacttattttcctttgggtagatacccagtagtaggattgctgaattgaacggtagttctacttttagttctttaaggaatcttcatactgttttctatagtggttgtactagtttacattgccaccctcagtgtaagtgttcccttttgccacacccacactaacgtctatttttttttttaattgtggcttttctggcaggagtaggatggtatctcattgtggttttaatttacatttccctgataattgtgatgttgaacatttttaaaaatatttgttggctgtttgtgtatcttcttttgagaattgtctattcatgttcttcacccactttttgatgggattatttgttttttcttgctgatttgtttgagctccacattttagagaagtataaaatatttaaaagacagaaagaatgtagagcctttggaataagagacgtgggagaatgtcctgaaaatacagttttccagaggtcaaaaaaaagaagttttaagaataaaaaaggtaaactggtgccaaatgtaaaaagtggtcaaaaactgataaaagaataatttagaatttgttaagaatctgattattgatatgaaacgtttaaaagaacagttttagcaaaagacattactaaaatgtgtattttattatatattttatttatcctaggctataaaaacctcaggactgtaagatttttaattagtgttaataatgcttgatcatagtgtatgacttttctcccttctgtattaccagcaatctgaacattagcactaggcttaatgtgattaagagaaatggattcttcctctaactggctgattttggagaagacatagaacaagggaatctttaagggtcatcttactctcacccaatatgagaattcctcctacaacctccttaactattaacttatttcacctttctagatgtccgtgaccttgtctctaaaataacgcacttggacttctagctctaacttctgattaaatgaattagaacataaagtcactgagtcagttgccttcaactcattctgcatgcaggctgtacaatattttcatccacattttaaaagtgaaatattttaaatgttagtaaatgttaaaaattagtaagcaaagagcaattagcacgggcacattctgaatgccttttagcccttgcttaaacttaagagaacagtctgttaaaaacaagataatatttttattgacatttcagttgttgcaaatgagtctttgccagctttcctcctgattctagtattttgcctaattctgatttcacgcgtgggtactttctgaacaatccatgtcttggagcgcatcatgtactaatgttgctctgacaaccttgtaatgggaatttgaacagttattacatttttcttgttaaaaccagggggaaagagcattccaagtgtttatagctccctaaccttactgtgatgaggtgaagtttgatgtagctatttcctcttactttgaaatctcatttttaataacactgttccacgcttggcgctgcatgtgtcagctgtgaacccattcacctttgcaaggagtagccttaatcctgcaaatcctactttgctccagtcagtacagggttgaagagaagaatctattctaattacttaaagtttacttaccagtgcctgcaatgctacaagggaactggaagctataatagaccaccctcttcagtttgggggaaattctacaagaaaggcttctgtaacatgagcagctcttgacttatcagcaacttccataggctaatgattatatttgccaacatacccacaacagtttacagagatttttgacttacagcagataaatgtaaagattgaaattacgaaataagtagaacttgtgaaaccctttacaaagtcacagaatatactttatcttttttgtcaagtagaatggaaatttgttaaattatctgcttctcacatattattttaaaacaaaacagatgaaagctctgaaatacaaggtagaaaacgtcacttttttttttttttttttgaggcagagtctttctctgtcacccaagctggaatgcagtagtgagatctccgctcactgcaacttccgcctcccaggttcaggcaattctcctgcctcagcctcctgagaagctgggattacaggtacccaccaccactcccagctcatttttatatttttagtagagacagggttttgccgtgttggccagactggtctcaaactcctgacctcaggtgatccacctgccttggcctcccaaaggtgtgagccaccacacttggctgataaggtcactttttaaaaagaatagtttttaggcatcatagtgtcattaggtactataagcagcaagttctagaaaaaaaaatcacatataataactatcttttgttgactacttagtagaaaccaagtgtacttctagacactctgcatatatcatcaaatttaatcctgacctaattgaaaaacatataataaaatattaacaaaagtaatccttaggtgaaggtaacagttaactttacatgggttatatcgattaatagataaaaagacaggtaaacatactgttttcctttgaggaaaatagcaagtgttttcctttgaggaaaatgggcaggacatagtatatatctgggtaatttgacccctccattcttagtgcatcttacctctctactagttttatacctgaatatgcttactgtactattccctttttaactaagaaatctctagaatccttctacaggcatatcatatgttcctctcccctttttgtactatgcaagtatttttcacaaattttgcacctagaatcttcatgttatattccacatcaactagcatgagagaggctgcttttcattaggcaataagaagcagagaaagatctatactgcaataactctatgataaaggcaggacggtatattttacactgatttcaccatatatcctccgcatcgcaattggaaatgtagattttataatgcttattttgcaattcaggaaactaatgttcgaggcttaacttattcaaagcgattacttgaagcaaaagcttcatgaacttgcccagggttattctgctgctgagggggagagatagcattggaacacagggtttatttgccttcaaagttctgttattcctattacatctctgtcatgaggaagactccatgcagcagaatacctaaattttagcaggtgtttttaagagatgcatgagcagagagagagaatttgcatctgtgtggatagagggatcttgcttcatttgcaagcaagaacttctgtgagacttccggtacatcaaagaatgcctttgcatggctgtcttctggaacaacctgtataaccacatgggaataactaggtccaaagtgtcacactggcttatgcatctcctcaagtagtcctacaaagtctaaaaagttaacagatacaaaccaatatcggaaggaaggacccatacggtaagatgaccacaaacatagcacttttcccactgagtcccctgttgttctaagtctgcctttgatgagtatccaggagcttgtggtctcctagtccttttcctcctctcctttgtactctccaaggtctcatcgtttcagacctctcaacccctccattctccatttagagttctggttccaattcaaggcaaaatcctcccagccaggtcttcaggtttccaggcagtgcccaaggctccatgcagcagcaagtcctttgcacttaaaagcaagtctttcacacatgcaagttcttcaaagggaaacaactcttagtcaaacaagcctttctctcataacattggccccattttacagtggaactctgatgcttaattatactaacaaagtatactttttaatggaacactagctacctttaaaagttagccctcagatcataaggcttaccatgaatgaacatgatttcagctcctgtaaagttcaaaccagtgctgctgatcagaagtcggttttcccacaaagggcgattcagggactgcagatggtgctgctgttatctctacatcaagccactaaaagggaagtgacatgggagtttaaatagaccacacctggaatggcagctgtcaccttcactcacagttgactagtcacagctaactgccaggtaatcagagaataagggccactaaatggcacagcaagttataaaatgcattcttaaccggcatatgatatctagctggatatccaggaataaaagaagagaggtcagctaagcagatagctagactgcgtgatgcaaaattttgctaatttctaatgccttaccaaagattcctttcccttaggtttgggacattttgtaatggaagaaaagggagcattctgagggaatgagggaggagggaataaagcatgcatgttgaagaaaactctaccgttgtaatttaagaaacaacaacatacatgccagaatccctttgtaaagtgaacttacagtttaaattgtacattgtatgattgtaaaaccattatataaatgaaaaaaatagggaccattactgccttaaaaacaaacaaaaaaatgaaatacatttgtttggaagatgagaagactatccagatttgactagagatatttgcctataatatcactttaaattgtttctggggacaagaagaaataataataataatagcctccctctctgtaatagaaaaatgttattaggtgacatgatatttatataaaatgttgtttccaatgagacaaaagtaaaatatcctactgtttttagaagcacctggtattcactgtatgacatcttactttcaagggagttcttgaaccacctctataaggcagtcaacttttaaagcaacttagtattttggcagttggaagacatattaactacagtcatacctatttatgcctaaatctaaaagttcaaaaaataattaactcagatttagtagatttggaatatggattgatagtttctagttttgaacctagcttagacattaacaaagtggactaataataaacttagactaataaaagtatccccaagaccactttttcctcactcctgccttgcttacacacttgtcagtaaattagagttttatttccttcatgccaggtatcctgcagattttgagggaaatagaagcccctagtgtaaaatacaagagtttctgacaaccggttgataaattcttatttattaaaaataatttctaacttagcatgaggtcaatagacttaatgaaaaaatttcatggtataaacaatattaaaatattctaattatgacaattctggcaaatcccagaatgcattagattacagaatcacaggcttatttccagatgctgcaactatagtattcttttttttttttttttttgaagtctaaacatctcagtggttccaaaatacagcagaatcagataaatgtttgggaaccatactgaaaaccaattctgagaatttaattaaaggctggctaaaagcaaacaaaaaaactattatatagtgtagttgagtgtgacattctcattggatagttgataattgcactgcttttcctccatatcaccacaaattcatcaatcaataaattgttatgaaaaatttatgtatcaaacgatagagtttatacaagtaaaagaaaattcttattttcaaagacctactactccagtgatacaaatgtatacacatacattttaacatataagcctatatagatatatgtatgcatgtgtgtgtgcttaatatcaaactcttcacaaaatgtaatatagtttatagaaagcaaagtttattttagatgaaacctagagagctgagtcaaatttacctaaacagagaatagtggggataattttttttttttttttgtaaagaaaaggcctaagtaaagctagtaaaggcattcgaagtgcattggtttgatgaaagtagaagacttgtgtataaataaaggagtgagaaaattagagaagagtttgaggtcatacttgtgcaaatcccagaaggccaagctgagaacggcacctgatcttatagagagtagggagataaaatattagaggagttccagcattgtgtgacaaatgttattgagcttggatagaattcagtgagattagtgctatatagcaaaagaatgcataaaatacaacataagtactggctttacaaaaacatcattggaccaacatgtatgggctacatggaagtggaaagagattgaggtaggaagcagatgcaatcattgagatgtgtgagatgtatggtaggaaaggtggatggcgtggggaaggaaaagaaagggtcaaatgggagagacacatattttcagcacaaagcttcaataaatacttgctaaacgaactaataaatctatataatatttcagctcattacatatcctatttttcttagttctgtcaagatcctctgagggaaacaagcaggctgggtacagaagttaaactttggaacactttctctttgagtccccattatatatgttctcatacatgccctcattgatgctgccagtccatatttttataatatcatgtattattcttttgtagcatttattatgattttattaacttttatattattatatatgtaaactgacagagatcgcaactactctacacactccataagagtgcaatgtatattttctcacaactgtatctagtatatatcaaagttcaataatgtttaattgatgtcacattgctatgtggaagatcaaagtaatttgcagcatattagctctgtgtttcttgcataaaattatcgtcttgagagctggctctagaaaaaatgcaaaatcagtggggagaaaaacttcttcccactttataatgatacttcaacacccttgaccaaattcttatctccttcatctgaactctgtcatgccaccgtgtttgcctgtcatcactaaaggaaagcaaaccataaaattaaatcacaaataacgctagaatgatttgccttttaaagattccccaaatagtccaggtacagtgctcactcctgtcatcccagcactttgggaggtcgaggcggatggatcacgaagtcaggcattcgagaccagcctggccaacatggcgaaaccctgtctctactaagaatacaaaaattagccaggcgtgttgacaggcgcttgtaatcccagctactcgggaggctgaggcaggcgaatcgcttgaacccgggaggcggaggttgcagtaagccaagattgcgccgctgtcctctagcctgggctacagagcaagacttcatctaaaacaagacaaaacaaaacaaaatcccccaaacaaggaatcaatcactggatgatagtatttcaggcattcctgaggtacacactcctggcaactatctcttccacttattttttttatttcttctaacaaaaatactaactaaacttgactcaataattctttgttaatgagagagaaaaaaattgttcttatttcaacatatacttcagatagaatttagtacttgaataagcattcagaataaaatgcgaaagtattattaagggcacaaaagtattatgcacttaacgattatgccgataattgttaagggcgcaacctaacaatgtaggatgtgacaaaaatatcaatatcggctttattcaccttcatgatggaatgtaaggcattcatttcttatttctccttggctttggagttagctcactcatttctacattctagctgtctaactagaaaggcaaaacatagccatgtgtggtggctcatgcctgtaatcccagcattttgagaggccgagatgagtggattgcttgagttcaggactttaagaccagcctggcaacatggtgaaaccctgtctctaccagaaatacaaaaaattagcctggcatggtgtcgtgttgctgtagtcccatagtcccagctactcatgaggctgaggtgggaggatggcttgagcccagtgggtggaggttgcagtgagcagagatggcgccactgtactccatcctgggtgacagagtgagaccctatctaaaaaaaaaaaaaaagaaaagaaaaagaaaagataaaacataaataagcaaaatagaattttctctataagttctagaaatctaataatgccaaatttttagcatttaagtaaattgtactagagtgacagtttataaaggaacactatttaaacaagagcacctgtagacgtgtcatattttaagggcaattataagaaattctatccaagttgatattttccaataatataggattgctatttttttttctgatacatggttaagcaattttctgaattttttaaaaacaagatacatttcagttcatgaatgaccttagatatgagttttctcactaggtgttataaaatgcgctagaagagaaaaaaacacagaacaatctatttataaaccatataatgagaataaggtaccctttatctaatttgcaatccataatagaaactataattgtctatagttagaggaaaataacttatatttgcttatcaattgtaccttgaagggctctgtatttaattaaatgtccaatgacaaatctgattccaccaattgcatctttagaatcagagattgatagaagccacagagtcaggggaaccatttgccacaacagtgaaatgtgggattgatgtcacttcagcctgggatggtttatttgaaaatggtaagcctctggtagcatcaataatgccatgttattatcttttggcatttatgcatatactcctgatagtgcagtccattgagtattgaattaaagagatttcaagtcctgtccttcactagaatatagcttttcttgaagtgttaatgcaaaaaaaaaaaatgtaaagacaaagaaaacttgtaatcccaaatttttctgtaccagaacatgtttatataggtttaccaagggaaagagagggagaaatacattggatttaaggtagaacctgttcatatcaagactgtttataaatgacacccaaaatcagatactggggagtggagagggaaaggttagactaacctttttccacttaactgacttttgtgggactgtatagatattgttttaaaaccagtgccgttttttgtttcagttaaattctccagttaccaattcactttagacagtgaaaaaatggaatgacagagagtctgaatgaaacagactgatgaggcaacatctcaaaaaggcaggatacaaatgatgaaaggcatatgtcagccaaccaagttatctttgtgatccagaggcatggcagagagacacaaatctgtccctgaagttctcagaatgaaaagtttggttcatagttcaagcgaggttaatattcccaatctcattctattctttatctctctaccaaaagagacaataatgttgttcattttacctactgcaattttatcttctttcttgcagtgtcttttgcttatgaattaattttttattcttactgtgataagaacacttaatatgcaatctatcctcttaagaaaatttaagtgtacaatccattattgttgactataggtgcagtattgtagagaagatctctagatctcattcatcttaaccgaaattttatgcctgttgattaatatctccccatttgctcctactcctgtccttggtaagcatcattccagtctttgattgtatgaatttgactattttggatatttcatgtaagtggaatcattaagtatttgtcttcctgtgtttggtgaatttagtagtttcttaacatatctctttttcttatttgtttacactacgttgtataggaaaatattttttaaatgctgcaatttttccagtactagtcatgaatcttcataaatattctgactctatcctttccagcacatggagggattacacctccgtgttgacttggaaactaggtgtggccatatgacgtgctttagccaatgaaatgtgagtggaagatgcctgtgtaatttctgggtaggagctttaacagccagagactgctttaccatgttcttgtcctctgccaccaacatggactgaggccattccaacatccaaagagataaggatgaagacagtaaagaacagaactccagctgaccttcaatgaacatgttgaggaataaggggcaaaaagttctctgttatttttagatactgagattcagagtttgtttttttactgaagcatagtgcatatcactgatgatataaacactgataatagtagagaaatggataaaatagaaaaattctattttaaaacatgaattaatgatattaactatcagacaccgaaaatgtaacatatatccctgtgttgtcttagttccttataaattagtctggtgttagaactgtaattttctgacacctacttagagatacggtagggtgcttgttacagttcacttctttgcatggcattatgaaacataggcagccatgtttcactcctcataactagggtaataaaaatatgagaagatagagaataggcagcgcacatctttctttacttgaaattgttcagctcattttgagattgataaaatggcacaattaagtttaaaaataaagaagtgaaagtttcagactaaaggtcatgacataatttaaagctgagggcaaaatgatataattgaagagggaagagtgccttttaacaacagtaattgactaactcccagttaataatgttatgactgaaaattaagagcatagctatgctcaggtgatatatctatattaagaagaaagcaaaatcaaagtagtattgtctatttatatatcctactcatcaaatatctttgtaacagaattcttgattgcttctatgctagtcattagagttaaacatagaatattgtattctttatttaacctgtttgagtctttcattatggaagtcaaatcttagtctctctttaatgatatcggatagatattgctgtgatcagacaactgttctgtatctgtgctgtccaacaccatagccactgttgaacatttggtatgtagctagtgccacagaggaactaaattttcagttttactgaaattactttacatataaatgtaaagtattaattaatttacattttaagagcaaaatgtagctagtagctactatattaatcatacagctggtatcgccatgtaacctgaaactaaagttgaatcttcaaggtcacaaataaacatttgaaaggtttaatgcccaaccagggatgccatgccaaaaaaaaaaaaaaaaaaaaaaaaaaaaaaaaaaaacaagaaagaaaaaagaaaaagaaagaaaaagaaaaaaacaagcaaacaaacaaacaaaaaactttgaaaagtaccaacaccaaaatcttagcattcagagcctcagtattgttcaaaagttattaaagtggatgaagggagcacaatgaaaggttttgccaccagagaattacatagcatatgacaatactgaatgcataattttccccacttctttctaacttcttaatctaaatgggtcacatttctgtcagcaaacaaattcctatagtcaatacaatttcttggaaatctgacattattataaacacttcaaattactttaccttcttggtaaactatcagtttctcagatttttgtttccacacaagctcaaaagtctccatgtatgtaatttcactttttttaaaccttttagcgtatgtctcatgtggtcttgttgccaagagagtgtaacataagtacatttctaaaacttaccatttacataaaacttgaattttcaagtagagccatttgagacctcagatctattcttccatccctcttgaatgtatatggtcttgatttgtttggaactgccatccatgtaagtatcttattctaccactaagtggttggagcataggtaaaagtattcgaactttgggcgtgcatccaagatttgatttttcagcagtttaaaacaaaactacctgatgtgttccactgtatgagatcaaaaatagacagtgttatctttgtgagacaacatcaaaatttgatttaaaatattcagatgaaacatttttttcttaaggttgtttctgtgggtaaactcaagggaagattaattctatacctagaagctgtcattgatctggcactgatatacatatatagtctgttttttaatcagtatttggatcatattccaaagtgtcagttttatgtgatagttaaaacagtttgtggcaggaagaactttaaaagattttcatgaatctcaattaaataacttgaagttttaaaaattcaatcacattaaaatattttttgttttttaataaagttctgatttgatagattatcacattaattacaaaccttcagggctcgcctttgtccattgtttaaaatgcttagtgtagtgtgttaaaagttcttcaactctgggaccaaatttttagccccttcttacagaagttttttttccttctgctcacaacttaacttgtcagtccttgaaaaatgctctcttttgaatagttagaaggctattcttcctttccccattcaacaaatctcgctcatcctttaagactcaatttacatgtcatctcattcattcattcaacaaatagataatgagcacttgctgtgtaccagtcactatgcttagtgctttataaattaattcatttaatactctcaaatgtttttgtgaagtcgatattaatgttatcatttcacaaagacaggtaagaactgcctaccttttgtcccactccactccacccaccattctgactgtggaagctccatgggtgtccccattattggattgcgctgacaccattagtcttcaccaccagtcagtttctttaggactgcctcctctcccatggccaaacctcagagaaggactacatgaattttctagactgctataggtatacagtaaaaaaaaaaaaaaaaaaaaaaaagaaagaaagaaagagactctgattaatgtggcataaacctggttgcatcttgagaatttcagtctagagattcaagttagtttgttagcaaaatggctttagttcctactatgcttttcctatgtggtgactacaagttgtcttcttattcccatcaactattaagactaattaaggagtaagatattatttgtatttagctcattttgatcaatatcagaaaacatttattgagtgactattatgcaagggcatctacaaacacacacaccaaaaaaacaaaacttgatgtaataacaaaaaacaattcaaaactttgagagagaactgtcctgggggaagaagttgagtatatatttgaagcatgttgtttcctggagtgttatggaggatttaacacatgaacacgccagcagaatgtaaatgtaacagagaggttggggtaggagaaataggacacctctgtcttcttttcccagaagtgccccaaacctgtaagatgagaccatatgctcagtttatagcaggaatgttttggtaaaagacctattttttaattataatataatttttaaatcataaaatgttagtggaatttgagagattgttctattttttcctatatgcctgattggaaataattatttaaatggaaaattagatattgtttttaaaatgttacaaggtattttgggttttgaaactcagaaactaagaaatttattcatatatggcccagtgaggtgtgcatgaaagaaagaatctggttctacattcatgtattacctcaagccattcatatgaaaaattcaggccaatgaccacaagagggatgaagaagagaatttgttggatggatctgtctgaagccattaatgcttttggagaagaaccacctcttcctgcctttccattcttctagtactctaagacagtccctcagccagaatagcaataaactcttggcatctggcccaagtttaggttctctggggctggattgctcttatatcaaaaagtcacatatgagatccatcagtaccagcaagcagaggaaagagttcttctgactgctgggtcagtagaattcatccataattcactcaacaaacagcagttttatataaaagagaaaatacattttaccttgctgagggcaaaactaaatgtattaataaaccagttaagcaaaaagaagtcgccttcatattgatgttatgtaattgtcacttgcaaaacaacctgtagagcatggaaaatatcctatctaataaaaaaaatttggtgattataaattggacttagaagagtactaacatagtatattcaggtatcactgattactggcttgattaccagagggaattagaaaaaaaaaaagactttttaatgaacttggttacctaaaaagagaaaaaagagtataaacccagtttgtttccttacctgtttttttctaggttataaaaaatagcttctgagagacaaatagaaatataattgcctattacaattttattttacctgtataatgataatataatatcttttttcttcctcttaatctattattcttgactaatctcatctttgaaaggcaagtcttacattattttacatgtagatttttcacatttcttcttacaagtttgaattgttgatttaaaaaaaagtaaaataaaagatttaaacttactataaagagaaagcattggtatatagcaaagtgaatgaaatactggataatagctcccaagaagctcttttgggataatagtgcaaattgaattgcctgccttgaaagaacatcacaggtaggagttgaagaaattctcagcttctctgatttctttccagccagtaaatgtgtctatcaaagtcacatggtcagcactacttgcttgcttggttagacttgtattcagttaaaaaataaaataaaaaataaaagcaaatactgaaataagcatatgtttcttttctcctggcaaaaggacctactgtcttctgaaaaggaagtagattttaggcaaaaacattgtgtgtctattaaaatcactctacgtaccatcactcaaaagcattttttgaataacttcaggacctgggttctggtatttcttactccatcttgagcactgatctgctttgtgacactgattgagccacatccctgtactttcagtccctgtcttgcaaaatactggaaataaataatgctctttccaactgccacttgttatgcttctagtgtcttatttatgttatggaactctgctatgagaagaaaaatagcagaacacaaaatctatgaagtttcctggcctgatagtatctgttgcaaaatagtgtttctgggaggattacgtgaaatagtacatataaaatgtctaccacatagcatatgctcaacaatgttaatccacttgccacagggtcacttccaatatctcactctggtaaaaattaccttcaccacctgaaaatctctttgtatcaggcataatagctggacttaagaataacaggactgaagaatacctgaaagtctaaaattgttattgcaaaatcagtacactaacttttgcagggcatttttttttttgtaaagaatggcattctatttcaacacactatattttacttaacaactattagttattcaataagtggataacatttacttgaataagtgaatgaataagtcaattgaataccgtacttctccactacggcattaatgtataatgtatcttgggctatttgtctcattagtttacataggagaacctgacttactctgtgatactgatttggcctgtgtagcagattcctgtcgtgaattcaacacgaactgggaaaatttctctaacttttttaacctcgcagttgttttttttttcccttccatgtaatgggcataataacacataatgtacagagatttgtcaaaattgaagataatatctaacgtcaaatctatggtatgagataaatatgtatttatttttaagtaaatttgtatcacttttgagtatatcatgtgcttttaaaataaccactttaaatttactttttaataacatttctgaatgtacactgttggggtagtgtaggagattccctcactacctttggactaggctgttgctcatgacagcagaatgaaatttgctaacctctactgtgatcccgaatttcttgtgatcaatatcaaaaaaagatgtgaaaggcagtactgctcgttacactatagtttcttttaactatgcctatctattattatttggtcatagaaataagaaaatgacattgatataaaatgcaaatgactctttgaatcaataataaattactgctcacaaactattcaataacaagtaattgatttgaagccaggcagaattttagacttatctattgtcttcagctgtacagagttaatgaggatttgtaattactttggattttaactaatacatctttttcattttggaaattgattttatattagtgtcatattttatggtttacacaattacctgactaaataaaggttgacaaaattgaccataatcaaaggcttgggagtacaataagccattttaatgcatagaatgtgttttctcttttcaagaatacccatctttttaaattttttatgtataattgttaaaaatttctcctttagaattgtaaaatgggaaagggaatagcttttagtaactaaaaagcattattcacataaagttctttggatttttcaaattacattgtttacctagaaaaaagttgaaaacctgtatctggcattttaaatttctacgtcataagccatgtacattttctacattaaccatgtcaaagtgtgaacttttagtctcctttttaaaagactggttcaaaaaaaaaacaaaaaagaatataccagacattctttgaatgtcactcaccaaggaacacttacatatgcctcttgtgaaaaagaagaggcatagaacagccactgaagatattatcctaaacttttatttggcttggtttggaattgtccagcagcataaacacacgattgctgtattctcagctggaaacaggttaagctagaaacacatattactacagccaaacaaaatagatcaatttgtccatggttattcatttatgtttctccttgggggtccctaagaagcaaatgatatgcaaacagctgcatgattattgctatgctcttgttgctatttggtgattgctatttacatgtaaattactacttggcaaagtacaacttctcttcaccagcaaccagacaacaaaacagttcttactaagctgtccaagattaattactcaaaaatacttcctaaaggatgattcctttagatttctgcatttcctagaaaagtaattttagaatgaataaaatataaaagaacaatcccaccatgattctaaggcagtatctatttaataagcaactttagaagattatggaagaatatagaaatgtaggtttcttgctgtgaggactgatttgggcagaatgggaaagaaaagaaaaacggaaagctagagtagatgcttaaagacagatgataagagatcaaagataaacttgatttatttccaaattttatctctgagtcaggctagatgatatcactcctcgcccttaatgtgtttatacctaaaaattgtcatgagactagagattattaaactgcctgaattaggcaaataaaaagaaaaggagttctgcacattggtgtcagttaacacttccgtgcctttctttacaaaacaaaaattatttaatgatatgaaaatagatatatttacaactgggtcataatctatatgcagttttgcatgtttttctcctaacattatatgaaatgtcattttcatattaattaatgtaaccacagcaaaatgttaatgattgtataatatctcctttatgcctgcactgctacttatttagtccccagatgtgttgtttttcacttttcactattataggatattttaaaatggaaatacttaagcacgcatctttgttttactcatccagttacttacttggaatttttgtaacaagcatgtgattaaggattttatacatattgacaaattgctctccggggaagttatccaatttacaccaccattaaattagtaagagaatgtcatttccttcatttgatttcatttaaactgatcatagtatcaatagtctacttagtgactcttttttttccttcaatttcatgtttcagaggatattaatcaacccaaaaaagttcaagctgtattagtatagtcaagaaaaatgggaaaaatgaaaggatttatgattcaacagaagaatcataatccatttaatccacgtttaatccatttaatcctggtttttcacaactggaatacctatgattataagccatagatttgggggaagaaaaaataagaattttagaaacagttgaaacaaagtgaagacaaggtttattttcaaatataccttggagacttgtagattttatataaaataatagggtcaaaagtgacaagcttatttttacaccatttttgataaatatggttgactctatattaatcaagatagtaagggagaaagaaaggtataaatatcccctattactattttaaaaaggaattagtcataatgtaataaaaataaatttattttaaacttattttattgtaatagcatctagtatttttaacacataagtaattcgatagactatcattcagcattttttttcaacaaacattttatttttccagtactgtaggggtgaaagtaaagcatccccttcgccttcagaaagtttgctgaaaacccattccaaaaaggcagattaattggagaaaaaggcatacaaatgtattggatcatagtttatgtgacatgggagccctcagaatgaagacccaactcactcaatggggtgcagaagcttacataccatctggaggttacagaaagaatgagggcttggatcctggcaaaacagtttacaggagaggggagaagaggaattttgaaaaggagcaataaattacttctaggcggaactgatggacttgaagaacataaaatggtctaggaccaagactattggatccataaagtagacaatgttttgtgacaaaagtctgcctaggttttagacagattttaatcttccttcctgtgatgtgggttttgataatgaaaactcaagaaaggaaatagaggagatttttttcttctttggtgtgaccagactgtagacagataagggaacttcagcctgtgctttgggagaggtagaagattgaaaaacagtgggggcagggggtggggagggcaattgttcctctccttggtgggtctgcctggtcttcatgtagaggataagtgaaaagtctcttctagcatctgttgatctctaaaggactttaatttaaaatattcattataccagggagccatattttgaaatagtatttcctgttctccttcagtatttaccatgtgccaggcactgattgatgtcctggacctaataatagtgaataaaatagagagtctcttgttttcttttcatggagattccattgtagtgggagaaaacagtcaaaaatcaagtaaaaaacatagtaagcaaaatagaggaaagtattatgaagaaaaatagagcagattaaaagtattaaaaatgatagagaattacaattttaaaaaaagatgaacagggaaggggttttagggttctccagagagaaccaatggaatggataggcagacatagagacagatgtatacgggtagagagaaagagagagaggatttattagggtaatttcttccagatagaggatttattaggggaactggttcatgaaattatggagtctgagaagtcccagggcaggctatctgcaagctggagaccctgggatgccagtagcaaggctcagtccaaatctaaacacttcagaaccaagaaagccaacgatgtcattctcagtttgaggttgaagacctgagaacggggtgatggtggggtggggaggtggaatggtataagtcttggagtcccaaggtcaaagaatctgatgtccaaggacaggaggagaagaatgtcttccaagttcagcagagagattgagagagagaggccaattcctcttgcgtctctttttgttctatcaggcgcccagcagattggatcacactaaggatggatcttccctgctcagtccactcagactcacttgctaatcttctctggaaacaccctcacaaacataccccaaaatgatatcttgccagttctcaagctatttttttattccattcaagatgacacctaaaattaacaatcaaagaagtccaatctggagaggtcagatttgagcatagatctgagtaaaatgaaacgtgagcaatgtgaatgtctggggaggatgctcttaagcagagaaaaaccatttggagtatgcttaggtgtttgaagactactaaatgggccattctgatggtgtagttagtgaaaggaaaattgtcagaggggaggtcagagccaagaggtagtggtggtaaaacatggagtggaaggaaaacttacaggttaggctacaaaagtactttggattttttcctgaatgtgtctggaggtttgatattatcatactcatgttaactctccctactgtgggaagaatggattctaggcaatgaggatgtaagcaagagatcagttcagaggcttttgcaatatccaaaggaaaattattgaatatgttttgtagataatttgactgatttgctgtgtgtgtagatgtggggtgggagagaagtgaagtacattaatcagaactgtgaatttgcttccagggtaatagtttaaggaccaaaacattatataaatagtttaccagaagtatattcctacagtttttattccgatactatttttttttcaggagaatgtactcatctttgtctcatattttaggagtctaacaaaactaatgattcagctttaaaatttgtgaaatagtataaataaatcagtccatcacaatttctaccctttaaatatgaaatatttttgccacaaggtttttctattattgttagataaaaatcagcactttcttttatatctctatatatgtctagtcttaatattccatgcagaaagaggaatcaaattcataaataatacatctttacctcctaggtggaataaatataaatatggtgagttgtatgctaatcacaaatgtaatgtaaagcattttagtttaaaccttttgatgtcatttaactgattacaatgccaatcattcatctaaatattgaaattagtcatttttgctaatttaaaaagtcttccctaaattttttattgaaccattaatcagtcaaactcctaaggaaaatgaagacagtttttgtagtctaaccaagaatcaaaacaaattctgcaactcaaaatgctttgaggaacagaaaagatattgggtggaaaaagatatctagctttgagtactaatattcaaagttaataacagtgaatgactataatgcaattaaatgggttcggtggattataaatatattgattataaaaatattactataaaattgagttaaccagtatttattgagtactcactagggttaaggtagtttttaaaattattagctataaatcatattagagaataaaacaaagtttggaaattactatgtcatcatcaacttaatttgagcctacagtgaagagctgttaggtaataaagaagaatgtctttagggtatatcaaatgggcttataaaccaaaaagttcttgttcttctttataaaaatagccaatatttattttgtgtttaccatgcaccaggtactgtgctaagcactttatggtcaatatctttttcagtatttccagaaaccctctgagggcagtactgttattgtaaaagatacagaaactgaggctcagaattgttaaaatagtttgcttaaagtctcatgaagtaagcaacaaagacagaatatgagcccaggcattatgactctacatcccattctcttgaaaactggatattagaaatttggtaaatataagattaacatcccctttcctattatttgtgcaatatatctttttttctgtacataagcaccatcttacataaactatacataagggcaaaggtttgtaaatgtgtatcaagaaaattattatagatcctggcagagaagtcagagaacagagaaaggtaaacagcatgcaaggaaaaagctataaaagaaataaagatgagaggcagggagaagccaccaggaaaatttttaaagagatacatgacaagacccagttcagacagatttctggcaatgagccctgggaataaaagcaactaatttggaagtatcaataccatataaagtattgtgatttagtataaacacaacagtagtgctcagcatactatccacagcaaaagacatttatcttcactctttgcaagtcttgaaagagtaacaaatttctgaaagggaacaaaagagagtggggtcttgtagagaaactcatgtttataaggacctagacaagagatgcatcaggattaagaaataaaactgtgtaccaataaattgctcatgtgaataggtatataaaccaaggttcttcacatgtaaataaaatagttcttatgctttaagccaatggttctcaaactttagtatgcataaaattaatctggatggcttgttgaaatacagacgtctgagtctcatcctcataatttctgattctgtagatctggggcgaggcctggaaatttgcatttctaacaggtgattgccaatgctattggtctgggacaccatctcttgaaataggtaaggatgatgttgctaagaattgaagatgttatagaaaataaagtgggagatattttactccattcatctagtttatacaggcattctttccagtttttttcaacttttattttagattcaaggggtacatgaacaggtttattaactgggtatattgcatgaagctgaggtttgtgatatgattgattctgtcacccaggtactgaatataatacccagtagcttttcaaccttggacctctccctacttccctctagtaatcctcagtgtctattttcatctttatgtccatgtgtactcatcgttcagttgccacttataagtgaaaacatgcagaatttggtttcctggtacttcgttaattcacttagtataatgaccttcagctccaccttgccacaaagcacatgatttcattcttttttatggctgtgtagtagtccatgttatatatgtatgacattttccttatccagttcaccgttgatgggcacataggttgattccatgacttcgctattgtaaatagtgctgtgatgaacatgtgagtgtatgtgtctttctggtaaaacagtttattttcttttggatatatacccagtaatagcaatgctgggtcaaatggaagtttggctagtggtctatcaattttgcttatcctttcaaataaccaacttttggttttactgattatttggatgcatttttgggtctcaatatttccttcttttctgccgtgattttagttatttcttttcttctcctagagttgggtttaattattgtttttttagtttttctaggtgtgatgttaggtcattaatttaagagctttctattttttgaggtagatatgcagcactataaaccttcctcttaacattgatttttctgcatcccagaaatttttgtatgtgtgtatctattttcatttatttcaaataattttttgatttctgccttaattttgttgtttacccaaaattcattcaggagcaagttgtttgttttccatgcaattgtgtggttttaaaagatcttcttggtattggtttacagttgtattccactgtgacccaagagtatggttgggatgattttgagttttttttaatttatcgagacttacttcctgggcagatcttggagtatgttccacgtgcagatgaaaagaatttatattgtgatgttgatagatggagtattctgtagatgtctactaggtccaatttgtcaaatgttacgtttaagtccagaattcacttgttaattttgtaccttgataatctttgtaataccgtcagttggtccccctctactattgtgtggccatgtgaggctttttgtaggtctagaagtacttgttttatgaatctgggtgctcaggttcatatatatttaggatagctaactcttcttgttgaattgaatcctttaacattatgtattgtccttctctgtcttttttttaaaatcgttattggtttcaagtttgttttatctgatataagaatagtaacttctgctgttttatgttttccttttgcaaggtagatctttcttgaaccctttactttcagcctatgtatgtcattacatgtgagatgggtctcttgaagacagaggaaaaatgggtcttgtttttgtatacaacttgccattgtaagtcttttaagtgggttgtttagatcgtttaccttcaaggttaatattgacatgtaagcttttaatcttattgtgaagtcattagctggtttctttgtagtttctattctatggttgctttataggtcctgtgggctatgtattgaagtgtggttttgtggtataaggtaccactcttttttttctcttttgagatagggtcccgttctgacacccaggatggagtgcagtggcatgatcataggttattgcagccttgacttttcaggcacaatggatcttcccacattagcctcccaggtagcccaggtagctgggattacaggtgcacaccaccatgcgcagctaatttttttttttttttttttttttttttagagatagggttttgccatgctgcccgagctggtctcaaacctctggtctcaatctatccactcacgttggcctcccaaagtgctgggattataggcatgagccacagcacccagctggtattgctttttcctttctgtgtttaggaatcccttaaagatctcttataggctaggctagtgatgacacattcctttagcagttgcttgcctggaaaagatgatgataacaatcctttgaaagcagttatacgttcctgcttcatgttcccctggttttcatcatagtttttaatgttatttttcttaaaaaataatgttgtccccttacaggacagttagtaatataattgtatagcaggaataatttgtatcagttatgatggagttttcattccctggaagtggttaagttcaagatgtataattatttttctatgttttacctgaaatcctacctggagtcaaggaagcagaaagccaaatgaatcttaatggttcataaacagactttctgactttctttctttcttttttttttttttttttttttttgagatggagtctctctcttgtcacccaggctggagtgcaatggcacaatcttggctcactgccacctccgccttccaggttcaagcgattctcctgcctcagcctcctgagtagctgtgattgtagttgcctgccactgcatgcagctaatttttttatatttttagtaaagacaaagtttcaccatcttggccaggctggtcttgaactcctgacctcaggtgatctgcccacctcggcctcccaaagttctgggattacaggcatgagccaccacacccagcccccataaacagactttcttagggtaggaataatggctactctgagtcctacactgtcttttctaatatcctttctgcagatgatctctattgtatcaattgtcctttatgcaccaattattcaaaatttatatctttgactcgaatatctcctcttagccccaaactcatatatccaattgcctactgaacatctccacttggctggctttctcccttttacgtacccaaacctgaactcataatctcaacctcattcctaaacttattctccctccttttttcctgtctcagtaaacagaagcactatgtgttcatgtgcttaagccagagatttaacagtcatctttgatactttcctctttatcttttaccacatctaatcaatcagtaactgcagttgattctctatcctatacattgttcatgtttatttcaagttgcataatggctcccaaagaggtccatatcctaatccccagaacctgtaagtatgtcactttacatggcaaagtgttgcagatggatattatgtggctaatcaactgatattaaactagaaaaacatttctttctttattcctatgaacctaatgtaatcacaagcacctttacaagcaaaacagggagacagaataggagaatttgagaaagatacagctatagtagaaaggcacagagagatacaacattcttggctcagaaaataaaagctaaggtatgtgtgtagcctctagaggcttgaatgggcgaggaagctataatgactccatgttccttcttgcctcagagagaccttttatgtgctactacatctatctgggatactttccctccccacccactcctatgccacccccctaagccaacttctacctggctaccagggttgatataaaatattacttgcccagagaaaaactatctgaatttgcataatactagattgtatcccccctcccatcatgcattagtgttctgcaattatacattatatcactcgctactatttcagatcattaatatttgtgtaacaatttgtttacagagtttgttttctccaatagatttaagcactagagaatatgaggccagaatatatatccactttatttgttgtgatatccaaataacttgtacactgtttgaaatagagtaggtccacaggaaatatctactgaatgagcacataattaaataaatgaatggatggacaaatgaaggttaggtgaatgaaatgagaaaatacatttatatagcgtgcgttatgccagtttaaggtatattttgaagtggctatacccctttcaggtagccttttttctattcacagctagaaatttgacagaaactttcaagctgggttttcaaagtagatttgtcttaatcttgaccaatgggccagtaaacgccccagtccataagagttatttgccattctatgaccatttttctatgcttccatttttacacttatacacagacactcatcacatcaaaattcctttgaagaccgaagaaagagattgcaatcacagataaaactgcagttgcttagaagtgtgagtaaagctattttcatcagtatttctaaagagtggcataaatatatggctctctgtgcatgaatattttttaattttcttcggagctacagaagttcttttggtctcttttacatacatttaaattgaccagtatgaaatatttccccaaaaaaataaatagctaaagtccaagatgttgcatatcacagaggattatcttagtgccaaagaaaataccagttgttcatattcacactcttttctcataatcacatgtgaaagctacaattagtatgtaaaaacgagaatctcatatatatttgtgtgtgtgtttgtgtgtgtgtgtgtgttgtattaatcaggttaaaaaaacacctgactggtacaactaatggttgtgctaatcattagtcgtggtaaaaaaaatcaccatcactagtggttttttaacctgattagtacaactttccaaaataggaatatagactggaaatcatacatggaaaataaattctaatttttactgatgatgttctattggcttcataagtgaaataagcaagtaacctctgttctcagaaaaaaagaagtaatgcatatacacacaccatattcaaattaaacccacactttctcattgatatccgcatattctttaagaaagacaaaggtaaaacttaaaattcaaacacttcaaagacacagtcatttgaaagcttaccttttatgtttcattcacttgtttccttcattccctctcttattcattcattcattcagtacatttctttaaatggcacccatgtgctagacgctatgttaggcattggagaggtacttgcaaacacaacagacgtagtccctgctctcacgtaccttagaataaagctataacagaacagaatttaatatactggtagtacaaagaatatggaaaagaatattttcttaaagggaacgatatgtataaaagtactgaagtgagaaagaggtgggcattgtgagcaagggccaaagtatccagtggcaaaagatgagacatcacaaggttatcaagcagggctctgcagggcagggatggctgtgtgaactacagtagttctagaactgtgcttgagtacccacaggatgccatgggtttgggcttacttattgttagtttttacgttgctcaggaggcatgctattctcctagataagatttggaagtggaagtgtaaggatgagagcagaataaatagcctggaagggctgaggaaaggctattgcttggagggaggggagttaaagagatggcatgatccacaggaagtacagttttggcgggggaaaattgggcaatttaagcaggattttaatgacttattgttgactgatttggaggtaagctatattccatctcccataaaaattttcaaggaaataccaataaacaatggcttttcagttagaattgtatgctgttgatcggttgttatgtaacattggtatcaagatggtaacggagagcagggctacctaaggggtctccctgaaattcagagttaaaatgttaagtaacttttattatatcctcgtggcaatggtaagaaaattaagcacgggagttatctgatcttatttaccgtttaagaggttttccctggcttttgtgtggaatgaaatgagttgcagagaagcaagagtgggtacagaatcactaattaaaaggctattttagtgttcaggagacagaggatagtggcatggactagtgagctagtgatgaagagcaaaggaaagaaggatttcaggtattttggggaggtaaatgcaacaaaccttgatatggatttgatatggagtgtgaggatttgagtgactgggtagaaacatatgctttttactgagatgggatatgggaggaagaatgattccaggatggaatgagaggaggtttaatagttaagttttcaacatgttaaggttgaggtatttgtgagttatccaaatggctatgtttggggggaaactgacacaaaaagcctggacttgattcttggcaggtggtaatggtcgaaacaaagcaggtgaaagagattgccaacagagagtataaatgaaaagggaacaaagcccactgcctaaaaatggaaataaaaaaaaggctgaccagagaggtaggcggggagaacaaaaggcatgtctgaaaataaagccaaaggaaaagaacttttcaagaaactggctcatcataataatgtgcttaccagtgaggatctaaaaacctcgaatttacatccctgccttacagttgaggtaggctgaagttgggggaagggagacttgaacaaaaataatttcaacaagtccatgataagggccatgatagaagcatgtacagagtattctagggaccttagagaagcatttaattcagcttggaagggcactgaggcaaggagaaaggtagggcgggggcatccacacacagggactagaatgtacacaggcgcagtttagagagacaacagattcatttccaagaggaggccttgggagtagaagaacactgaacgtttgagggctttgagcaaaggaaaagccaaatcatatatagccaatttggcttccttcaacaattcttagttgaactctggttgacctcattagacaacttctctcattagactgagaactctttgagggccaaggtcaacgcttattcaggtttctaatacttatttgaccatgagttatttacctatctcctggggcagtttcctcacttttaaaagtagacactcaatataatgattatgaaaattaaataaagggtgataatggatgtaatgcatctcatatagagcctgcctggcacatactaaaagcacgacatatggtaggagctggtagtggtagaagagatattaatgggggcagtaggagtagtaactgtagtaatagttgaggaagtaaagtcaactgctcttgcttatttaaataatgtcttctcaaattttaggggttttgagatatatttgtcagtgtttctagtttatttttacatggagatatcatggattggtccattatgcacattgttgaaataagcttgctagtgagggcactacagcagttaggatgaatcatatttatcttttgagaatatcatgtgacattatagttaattttgagtaactaagcaataaaatccccaagtgtttcatacgtattttttagaactgaaaccaaatggtgcgctatgtattatgaatgcaccaaaggttctaataatcaagaccaccattttgcaaaaaaggtattttccttaaatacaatctatctgccttgagaaagcaaatatttatgattacacagtttttgcttttcatatatagcaaaactagtgtttttgaattatgatttgcaaataaaaaggcaactcatattttctatttttagtattactctataggattattatagactttatgtattataaattattcaggcctttataaaaatagcagaacagtatattttaatattaattttaatgatattacaaaatggacagcataaataagagatagttggaaattctgtggtaattttctcaaaaatgaccacatagatcaaaagaaattatatacactgatgtttatatgcagtcattggcaatgacattaatgatgaatagcaacttacatatgcagttaatggtgagttcaacccatcacccttcacacaggctgtcagcttttagatactctgcacaaaaatgtactgccaccaacagatatgaaaagaattgccaacatgagaggattaactgttccatttaggatgtccagctggctaatgggattcattttggtttgttgtcagattcagcctggcatatttaatttttgttctcttgaaagtatagcttctcactgagattctgcacgcataacaccaatgaaaatggcgtagtaaaaagttgaaaaattcagactccctgtttatctctagcaacacagctacaaagaaaatataattatagttttgcattgggaatgtatttataagggcttattggaccccagatagatattttaaccctgatgcaattcaccaagaaccatgtaaagttataaatgtggccatatgcctcttcttcactcattccctccacacgtatttattgagctgctctctgttctcagcaacagtgagcttgaccccctttaccatataatctgaaagggtctagactatttggccttttgttactgatattagttccaatgggaggttaccgagggtaagtaatcaagatacttgctggtaactggagttaaaaattgaacactacaatttgtatctaatttcaaagatggttctccctcaaattcaatttataatgtcatttgattttgattattttttaatgataccaaagatggatttatagatggaagaaccaggaaaagcaaaagctagtccagcaggtgaaatgtcagaaaataacgaaggattgccaggatagaaatcagaaaagctaaatggaaaaatgagataaatctgctaaagatacaaataaatgatatctttaaactccttaaatatatcaacaaaaaaagataaaggaaatatgtcttctgcaggagatagagaagggctcatagctgcttctaataattcaattacattcaaaaataaacttattgagcatgactttttcctttaaactcagtttttacaaaaataaatgaaatatgaacttagaagggcaggctgtaaacccttgaggatgtgcttacagaatcttattttcttctatgttcccctgaaagggtggtattctcgatgaaattcagcctccacattttattggctgtatttccttgggcaaattcacttttctaaacctcagtgtcacaaattatgacacgggtggtaggaatttaaatgagataatgaatataaagtgcttatgtcagtgccaggcatatggctaatgcctaataaatgataaactggagttttattattttattccatgtatttctttatcaatcaattgggttcattggactacaaatccctgtaaatcaggggctgttatttatttttgtattcttagcatgtaacagagtgcctagtacattgtacctactcagaaaatgcttgtgcaacaaaactgcacattctgatcatccatcagccttaaaggcctctatcaatttctaccaatctgcctaaatttgactttcaagatgcggcagaaataaacattttcccaaaagctttccatggactccagtccacctaccaaatacaagcacagtgagttgccctgtctctgtatttcagttgtattttattgttttctgcactactccaaacatgaggacattgcaattatttgttcatgtgttcatgttttccctccaattaactcatctttttatacttagaatttataccgtggcttgtatgtagataactctcagtatatattggtttgattaattgttaattcattcattgattcatttaggggtttattattaaagttaattattatattttctcttgggattctaaagacataaagagacaacataatttaagttgtgataaaaacatttacattcctgtttggatatgtgttatcttgttaggttggatataaaagtgtttttttttttttttttgagacagaatctcattctgtcattcaggctggagtgcagtggcatgatctcagctcactgcaatgtccacctcctgggttcaagcaatcctcctgcctcagcctcccaagtagctgggactacaggcatgtgccaccatgcccagctaattttttatatttttagtagagatggggtttcaccattttaaccaggatggtctcgatctcctgaccttatgatcctcctgcctctacctcccacagtgctgggattacaggcatgagccactgcgcccggccagaaaagattttttaaaagaattatatttaaatccctcagataaaacaagtgtgcctcttaccataaaattgtgagaactaggttagatcactttcctaattttcttccatcactaatagtcttaaataagcaatatattcattaaatatttactacttgcccagcacaaactaatatgacgagttttcttacacaaagagtaaaatcaccatgagtattactctctcttctgctttctgatattggtgacaattttaactgtgctgttttctgactagcaaatatggctatggtcacacctgtagttgctggtattattttgtaattctttcatctttcattcgggtttatgatctcttgtttctatttggtttcaatcataacttataggttgattttaaatgatggtccatcatctgctttgttagatatatctctgctgttctttgagttaaggtctggtttcattcctgttcgtaatttattgaatactggtacatgatattatttgtcaccattatctggaagttcagtgctatgttcaggggcatataaaaatgatactctcaatctataaatcatacagtattgtcttaactttggaataatgttttgttgaattaggaaaacagatgtgactaaatcatccatagctcaatgaagatcagattaaacccaggattgtcaaagcagacgtacaaaagaacaaccatcagcataacactggtcttgggaatttgaaatactttgtccttgaatatggtattcaaggctggctatttcaatcttctgttcaatataaatggaaataaaatttcttcatatatcactccttatggcagtggcatttttacatcttttctaaagatcacatattcatctgtatttggacttagagcctgccagaaatctgatttatgccagttcttttgcttttcttctaatttagtttgaggaattaaaatgaactttgctctatttcccttgaagattatattttcaattctggaggaaaaaatgacctattttatgcttatgttcttttaatttattttagttttttgtaataattgacattaatcaatctagtgataaataaaatcattatacaaaaaaaatcatatgaataataaatttttactaccaggacaatatcacaagtgtgttcacagcactttcaaagctcttcctaaacaaaggtaaaaggatcatcatttgcttaaacaaactatgtgtatgcccagtatggatttattacaccattcagttataaagagaatgaaaataaatatgggcctggtttccacattgttaaaaaaaaaaaataaagtaacacagaagaaacaaacacttgggaaaaaaaagaaaaataatatgtcattttatttcacctttcttatttagattggacatcaagaaaagtctatggtaatgtgaactccattacctgcaaggaaaattagagaaattaaaatgaattcagatatttttatcattaacagtttaaaataaaatatatacttacttaaatatgtatgtttacatatatgtaatataatagatattttaactaaaacatacactccaggtataaatacagaattctatggcatataaaagatttaaggtaaagacaaggatgtgtttttatattttactaaagaaagatgttttccattatccatttctcttttatatgtaaatcattcttccatcacatgtgtcaaatagtgttgcacaaaataaaatgtaaatatcaattttaatattcaggctgttttacccatataggaggcttataatgtgaaattcctactgtgaaccaataattcaaagagtttcaaatataaatttatttcaaattggaaacataccagaaactatttattcaactattaattcaatttaaaatgtatctactgaacactagctatgggccaggtgctatgctaaatataggaactctcatggggaagaaagcaagaaattacacaataaataaattctaatttaaatacctagatgataaatgaaaggatgacattcatttttatctgattaaatagctatctcaaattatccatgtaatattatctaaataaaatctcagggaagttggtgactgtgtgtgtatgtgtatcaagtgtcctggagtaaaaatcacaaaacctggaatctagtcacttattgagaacttgggcaagtcagtttatcactatgagcttcagttctgctggtaaattgccatacattatcaggccggtatggaaaatgcaattaggatatgattaattgaaatacattataaaaagtactttaacaaaattatgcaaaagatgatgtgggagcaaagagagtaaagcattacccatatttcttaatcattctgcccacagtgtaaagggtggttttgagagaactgggaagacagccagggataccagtcaaaatgatggaaatatctaggtgagtccctaaatattgacactggcgatgaacttgaagaataaaaaactgacttgagagatattggaaagatagaattaacagaacttagttgacaaaatagatgacggaaagggaaatgaaggacagagagtcatctggattcaacttgggttagggtgccactcattaagatagaaacatgaaagagaataaaataagggagatgagaaaatgagcaggttaagaagagttgatttaagggtacttttaaaaatccaacttgaaatgttctgtaggcaagtggatatatagtcctggcactaaggaaaaaaaaaaatgaaccgataccaaacatttttgagttaacattcactgattcaataaatactcatggagtacctactatgtactaggcgcttttctaggtaccgggaactcagcaatgaacaaaacaaagtctctgccttaaataatttgtattgtatcagggaaagtcagatgacatttttgtaaagaatgtgatttgtcagattgtgttaagtgcaatggagaaaaaaataaatgggtaaatggaatagaatgccaaaaaataggaattaggattttggcttcatataatacaatcagaaaaggcctattcatttaagaaacagcaaacagattactatggctgatgatgattgagtgatggggagagcggtaggtgatgtggttacagagctcgtaggaggacagaatgtgtgaggtcttacggtcactgaaggactttgatttttcactttgagtgatatagaagcctttcaagtgttgaggaggggatcatgatatgacttattctctactggattgctatgactactgggtgaagaatgaactgaaggagcataatggcagaagcagaaggacaggttagaatgctattgtacaaattttaggcaagaaataagggtggcttgaaccacaatgcttggtagtagagatgatgagaagtgatatctttctagacgtatttggaaggtagaaatgacaggattttctagttgactggagtttgagtgtatgggaaagaaaggaatgcaagatgattctagaatttttgacctgaggaattgaaacaactaaaagaataaaattagtccttattgatggaaccatttgcagaaaaaagtagatctggatgactgaagaatttaagtgagaacctaatataaataagaatatttgaagacagttaaatatatacattggtagcaggagatgtagtcacagggcagagatatggcataatcaccatatagattataattaaagccccggtttagctcaccatggaatttgtgctagtgaaagaaattgtagaagtaccacacttcaaaatttgaagtctttggaaataaaaatatcagaaaaagaaactgatttacatagtcatttagatagaagaaaacaaaacagaagtcaagagcagaaagtatttcaaggagaagaaaagaatcccttgtgccaaatggtgctgatatgtcaagtaaagatgaggacacagttttgaccatagcattttagtaacatagaattcagtggtaaccttgacaggagcaggcgcagtaagccagggacaaaagtctcattagggcagtttcaagaaatcataggataatggccaggtgtggtggctcacgcctgtaatcccatcactttgggaggccaaggtgggcagatcacttgaggtcaggagttcatgatcagcctggccaacatggcaaaaccctatctctactgaaaatacaaaaattagccgggtgtgatggcacatacctgtaaccccagctactcgggaggctgaggcaggagaatcacttgaacctgggaggtggaggctgcggtgagctgagattagcctgggtgacaagagtgagactctgtgtccaaaaaaagaaaaaaagaagaaagaaaataataggttaatatttagagaaagcaagttgtagactcataaagaagagaagaaactgatggctaagaatataatccctggtgcaatgctctcaagtatggaatggctgacaaatcctagcgcacagtagaaaggttagcccagcagggtgtcatgataagttatcaagagaaagagaggaagtagagtagaaacaagggcatcccttaacagtgaagaggggaagagatagaaagtttgagccaaaagaagttggtgtgaaataattgcctgaaagagcagaagaataaataaaccagtgatctccaggcagtattaggagcttacttgagttagtgctcatgaattttaaaagaaatatgccaacatggctttgtatttttctccagctgtgtttaactgtatgggtgcaggcatagaggaggtggagagttcaatttaaaatagaacttcaggttttaccaagtgagtatgataaatgtaaagagggggaagtaaaagaggcaagaacataggaagaagtggttatgataactcatcatggaatttaagctagataaatagatggcaaaggacagtgagattaatgaattgttggtcttgatgagattaaaggcttgttggagttagggtacagaaaagggtgaactagaaggatggagttgaagttcaagagtaggatatttgcaattgagattatcagggggttttaattactagtaaaggaaaggccaaaggcctgaccagaggcgtgaagagccgagatgagttagaggacagaggagggtaagaaactgagaagccagagaagtagaataattatctgggatattaaaatcaccaagaattaagacagatagagtgttagaatgaaaaacggcaagctaggagctaaaattttcaaggaatgaaagtgattaggaagaaggttactatataattctaacacaaagtgtcagttggggctatgacctggtgatgtaagagtcaaagttgaatatttttagtgaacaggaaatgagatgttctggaaagggcagtgagaagcaagaaagtcccccatccttcagctgccatccttatgggcatgagcgttgtacagaaataatgttcacatcaaagggctaacagggaagtattgtcggcaggaaaaatccaggtttccattggaacaaaatggtcgaggaaaaattgaaagtttgcaaatatgacagtatggtgatgactgaagcttcatttccatagggcacgtggttggggggaggcatgttaaagttggagaggggtagaattcggagtctaaaaaggcaatacatacagccatgtggggattaaagtctagggaatgaaagacgacttgggagtcttgcagttattgtgatttcaaggagcagggaacagggaaaaatgaaattagcccaatcctgagggttccaaggcagaaagtgttgacgagactgcttgttttggaaacagtgaggggtggggtgccctttgaggaacacacgaacagttgggacttcctaacttctgctttgtggctagcagaaggacaatcctgagcacaggggtgttcttttgacctctcttaatagtggcttgcagaaggagaggtatttagcacattctcagaagagagaataacaacttacctctatttagtccctaatgcattttgttataattttgtagcagtcttctcagagtgaaaacatcttgaaaacctaggaatattaattttgtttcccagtgcttgtcaaagtatttggtacagagtatcctctaagtcaacatttgttatagaaatgaataaaatagcgtaagaaatcctaacctgacagggttattcaagtgatttaactggtgattaagttaggtagcatatgtgtaatttatggtaagctgaaaattcttatatattatgatgggtaatttgaggtgtcaatttgactggattaaaggataccttgaaagccagtaaagcattatgtctaggtgtgtctgtgagggtgtttctgggagagatttgtgtgtgagttggtgggctgacaggaaagagctgccctcaatgtggatgggtaccattcaattggctggggtcctggatagaacaaaaaagcagagaggaaaggcaagtttactctctctttcctggagctgggacaccctttgtctcttgcccttggacatcagaacgccaggctctctggcctttggacttcagtagacccccaagttctcaggctttcccctcagacggagaattacactatcaccttcccttccctggttctgggactttcagacttgaactgagcctcactaccaggatttctgggtcaccagcttgcagatggcctatcttgggacttgtcagcctccataatggcataagccaattctcctaataaattccctctcacacttctatgttatccgtctgtctgtctgtctgcctatctgtctatctgttgatctctcttctatctttctctcctgttggttctttgtctctggagaactctgactaatacatatgtagattgagcatccctaatctgaaaatccaaacatactaactgctccaaaacccaaaatttttgagcttctatatgaaactacaaatagaaaatttcgcacttgacttcatgtgacaggttgcaatcaaaatgcaggtgcacaacataatttattcagtgtctccaagcggttactgtatcaagtaaccttttaatcaaaacacagcatcctaggtgtagacagaaagcttggcattttttgctgttgctgttgttaacagctgacacagatattcctgggatgctactgtgtttcttggttaccctgaacacattattttttcactgcattaatgatgtcattttttttttactgtaaagtacttatatgtgaataagttcaggaaagtgattacatattagtagaatataaattcaaactgagtaattattatggtgatgccaaacaaccacagattgtccacgtggatggctgagaaaatgacacctttgctttctggtggttgactgtacctaaaccttgtttcatgcaccaaattatttaaaatcttgtataaaattatcttcaggctatgtgtacatgtatgaaacataaatgaattttgtgtttagacttgggtctcccaaaatatttcagtatttatatacaaatattccaaaatctgaaaaaattcaaaatctgcaacactactggtctcaagcatcttggataagccaagggctactcaacttgaacatacaatgtaatatgtatgaatcatttcatcctagttttatgttttttttctagtcatgtttgaaaatgtatctgtaacattgaaccaagcttcattgacgacatctataaggaaacattactttcctctcccttattatctcagtattaaacacatttggtgagtattctaattgttaaagccagctggagcctgaaaactgtaaatgccagtccctgagtaggaggtaggatcttcctactagtcaactctagccattgacaaacatgaactaaactcagaaaaatgagactcgctgggcaaaacctagttatactaggaaagagaacagatctctttttctcttgggtcagattttaaagactccacctgtgcaggtctgcagtcactcctggacagaatggcaatgtgcagctggaccagttccgggaaaaaaggaaggagattccaagggaaggggagggcaatgtttatgaactacagagtttaagctatactcctctatgccagattgttagtaatatggtacccactctatttatgtattccacttttgtctttaaaaaatttagagccagtgtggcaaataaaatttagggaaggtcaggttcatctatgcatgagtcagagctttcacgggaaagggacctgaggtagccagagggatgctagcagaaggcattggtagggagagatcaggtggtgtgatttgagcttttttcctcctcaaggcatgatctcaacttgtaaacagtccaaaggtttttattatccagatgattctcattttagtgcttaccttgtatatttctggttttctcgcattaaggaaaatggcattttcttacatcattctctgtaatgattctctataacaattcctattaacatttaaaaacaacattatttctaaatgaacaattcaagctcaatcatgactatcaaattttactaaaatttggtagtttagtatctgcttcgatccatgtttcataaaccaattcaatataatgttaatgtgttctgaagaaacaaatgagtttcatggttaaacaagtttttttattttatttttttattttatattcagtgggtacatgtgcagatttgttatgtagatttattgtatagtgctggggtttcggcttctattgaaacccatcactgaaataataaacatagtaccccataggtagtttttcaagcctttctctcctgctttccttccactttttggagtcccaagtgcttactgtttccatctttatgtctgtgtgtacccactcttttgctcccacctacgagaacatgtggtatttgattttctagattaaataagttttaaaacactggattaaacagttaaacagacttagaccttcttggcgcattcaatatatgcatttgctctgactctgaaaggagatacagcataaacttctaatgcttatttaatctcagaaactcctttactggagtacctgttgccaacctagatgtcatccacaaaatataattgggaaattctaatctaggtgattaaattatgctttcttttcttcagcctattggagtgaggaatttttttttttttgagactgagtctggagtgaggaattttaagggaacattattcttgtatttcataataaagccctgtacttggttataatgttaaaaaattgattattcttcagaattcagtgtgctagtttccttccttctttccttccttcctctttttctttcatttctctatcatctgtctccgagattgatgcataccttcctctttcatactgtctttctcaagtttaggtgtcaagtttatggtaccgacttcacataataaattagagacctttccattggggtcatatctttaaattctgtcttttttaactagattcaataggtctttaaactctattaactacctgtgtgattatgagaaagtcacttcttgatgtctcatttttgatatatgtaaaactcaggataatcatacctactttgtagagttcttgggaagagtagacaaaattacgccgctaaatcacttagcacataaaatgacatttaacaccaaacgagtattagctactgtcgttaccattctggatagcatacagctggtttcttccaccaaccaccaattatatatgtctttattgaagtcatgtttttggtgtgcactggtttggtattttcagacctctaacccatttgctgctcattgatcactaatctcttggctctgcaaatgatgatgcgtttaaatttctgatgagtgactcttacgtaggtaggtgttacacatttgcaacatgtctgaacacacggtttgtatttaaatggaaactgggacttgacaggagcctctggggaatcatcactacctaataggtttccttaatgaccagtcaattaagaacttgtatttgcaaagtgctttgccatcattgtttttctttcaattctctgagccattactatcatcttactgatgaaacagagatacagaaaggcttattgacttgcttttggctacatggcctgaaattccagggactctagggatttaggtctcaaaaatcctgcagttctaagcaaacagggttaggctttctcaatagactcactcaagagacagagaactaaatgtagcctgctcacaaaccatgagaggacttaagggcttttggtctgtaaaagagttctgtgatcgtccccaaatcactccattaatagccgttctctaacagtcatgatttgctcattaaattattcaccagtattagaatcagataccatggaatagagaagttttatcttaatgtgtgagatatttcaggatgagtgttacaagacttaattcttaagtaaaaagcgagacattccctttagcttctctgtaaatgtagtaaataccgctgtataaatataagcatgggctctttgtagcctgcaaagcagattttgtgttttatgtgagggaaataacaatcagtaatacttagggttttgaattcagggtttgattaagggtgactgtattacaatttttctcatctaaatagtgttcattaaatattagaagaaaagagctcaaaatgtaggcagtgattatgtctaaatgttggaatcatacaagatctttactttcttccgtacacatttttacaattgtcatatatattataatgaattgccattacttttatattttctaatcaggagtacacacacacaaaatttaaataccctttgtgtttttataacattagatctatgatttttattataaggagggctgagagtataattacagaaacagcctgttagcttctcttaagaaacattctctcattatttcaagttttgttttcccttggatctcagctttttagtgacaaatgaaataagtattatgtcagtttgtaacaaattattcatttcaaaataagaactccacagaacgtttaattactattctcagcgagtagatcatattcactgttgaaaatataatatagttagaatcttctgtttgggcattttatacacaagataaattcattttttcctaataatttttacctttaagctaatgtaaagggatataaatgattaggcaaggtgacttttaaatgttgtgaacaatgcatgaacatctttaagtatacatattagtagaaatttattgtgtcagctctttgtaatatatttcactaagcaatgcaaaataaaataaaagatacagtctccattttcatcattgcctataatctaagccctcctcatattttgcataggctatttcagtaacctcctaaatgatctctttgctagcataatcctctgtttcacatgtaaacgtgatcatgtcttttatagtctcctcatgcctctttctctacaggataaagtccatactctttagcatggcaaacaaggtctctgcaacctggtttcatctttctgttaccttctgccagcccacctcaaatttactctggaataaggttgggctgctgaagtcccctgagactccaggcagggtcccatctctgtgcagctggcttatactattttctctccattgaatttcacgcattcataggggaaaggaatgagctcttccgtctggtctttttatctcccttcttcagaagaggagtggcttatctgacttgtaagaccagtgacagctagatctgaactgagttattgtgttaaaggtcactgttcttatggacttctcatgtctcatggtatcttgcctcagttctgcatccttaggtggaaagagtttgtcttgcccctataagttaaacctgaatcattcgaacctgcaactcttgcctgcagctgggtcagttctgctcggaagccgcgatttatacacacgtctccaccattttctccaattcaactctgctaggggagccttatatttttttgtcaaaaaaaatgcgtgtatttgtgtgtgtgtgtgtgtatcctttattgtccctttccttctattatatgtcttcatattattcacgacacccacagagaagaaaatgactaataggatttggggtgcaaaaacctgccttgaactttcgaggttctgccattctccagggactgggtgctaattttaccttatggtgggatacaggaagccttgccaggattacaatcaggttttctataaataaaactcactgatgacatttacgtcttcattttctctctagggagtgtttctaaattgtttaatttagaaggtgtatgtttgaaaccctaaagcttttaaaaatattttaaattaattctctgtaaataaaacatttctaaattacacttaacccctttatctcattcattctcctctcatctggaaggtttagccaatattagtaacttttatacttgttcacaggctctagcatttctctttttaataagaccttatccatatactcataatttttaaaaactgtaactcattcctttgtttttaataaaactctgagcactctatctctgcagctttgagatacctgcttagtttataatccaagcttgtcccatagttgtttggtcttgtacatattgtcatttaatatctcagcccccaaatcagtatctatacatggagaagataatacaacttcaaaaggagagttgctctcagggctaagtgccatggctgtgctgtgaaaagtttgtatattttaactcatgtttcaatgtgaaagacaaatagccatagcctctttctcttttccctgcccttccaagctttaacaatatatctctttcaaggacagtatgcagggcactcactgttcaaaatacactttgtcaccccccaaaccggtgtaactgagatctgctaactaactccctttgatctcaagtatttgtgtgagtcgtttttgccaccactgccctgttggcctctttggtgtactggactaatgtgccttctgtgagatgcatgaagcccccgggccaacaaataacaggaccaatggaaagtatgaaaaattacaggtcagatagatatatctaacaaacaaacacgtgtggataatggaaactgggcactcttgtaacatatagggagtagtctatgctcttgctctagcatccttgtcacttatcttgcggtgtaaatatttatttgattgtttggtagtgcggttcttatttagtaataaatattttggcagcatgagctaacaaaaaaaaaagaatgtttaatgaaaaaattaagtactgaatttataattcttaaagaacttgatgaacatattagtcgaacaaaatatttgtagatacttaccaagaggactgctgagcacttgaaaaccagggggcagaatgtgctgatgaaacatcagcgttttttcaaaagttaatagattttaggaagattatgtctaaagatgacaatttgacatgtgaagctgctggctatgcatttgcatattactctgtgaagcatcacttttcatttagataaatgtctgttcctctaaactaatttcattcattttctgttccaagttttcatatgaaagtacaaaaagtgaagcaattgctgttaatgcgttgccttcattaacagcatcagaccttgaaaatagctaaatgatactggttttaaaacaatgcagtaaaattaaatatcaattaagtttattcaaattgaatcaatatctgtcttcaaaaccatggaattgaagtatagctctttgtgatccattctgttgaagatgaaatatctgacaccataataaatgctatgataaattcagtttaaaatgtaaaaaaattaaaggaaaagtgtttgcttttaaaattatatttattgaattattttgaaatgataaaataaaatatacatttgggtgtagcacaatgtcatggcacaaatgatattaggaatctcatgggggccaggtgcggtagctcacacctgtaatcccagcactttgggaggccaaggcaggcggatcacgaggtcaggagatcgagaccatcctggctaacacacagtgaaaccccatctctaataaaaatacaaaaaaattagccaggcatggtggcgggtgcctgtagtcccagctacttgggaggctgaggcagaagaatggcgtgaaccatgaggtggagcttgcagtgagccgagcttgtgccactgcattccagcctgggcgacagggtgagactccatctcaaaaaaaaaaaaaagaaaagaaaagaaaaaaaaaatctcatggggtagagctcttctcaaaatttatgtagtgcacatttaagttacactttaatccaaacaaactgtgatattctaccaatataaacaggagaaaagtacttggtgtggagagaaaacagtattatgaaaatatttagtctcaaacatttatgcatttcaatagtaactgcccctccaacagaattgaggatgtcttccatttagcagaatgcgcttttgcatatcaggtaatttatcacctatagagagaagatttttctcaattaaatatattatgatctgcagaaaagttccatgtaatatatcaagaattttaaaaatgcattcttcagaaaaatacaagtgacgaggcattagacacatatatatgtaagaaactgagtaaaatatatggctttgtatccagaattattattgtgcttgcttgtgttattttaaaatttgcataagatcaatactaagatttcaaatttttttctttaatgtgtatggccatatgttcaatttttgaaagaattttatttttgaaaatggcctttaaacagaatgattttataggtccaccgatattataaaactgatttgtcagttaatctataaatatttcaaaaactctataattttagttattttttgtgcctttttttccctctcaaaacttttctaatttggattacaaatttttacggtcagtcctcatacacatggaatactcggaaaatcagtaaaatgtcatcaacacaagcagaagaacaatcaacaaaacacaacttagttttctagctgaactcggctaaggctttttgcctgttcttcgtgaggaaaaactagacattaacaacaatattgcattgttatggatttaatctttgtgtctccgaaaaattcatatgttgaacacttaccccctaatgtgatggtatttggaagcagggtctttgggagacaattaggttttaatgaggtcatgagaatgtggaccccatgaaggaattagtgagcttataagaagaggaagagagaccagagctctctgcttgaggacacggtaaaaaagtaaccatctgcaagccaggaggaaggttgtcaccaggagccacattttctggcaccttggtcttagatttcccaccctttagaaccatgagaaataatgtcaatcatttaagtctctctgtctgtggtattttgttgtatgagcccaagctgactaagacatccattttataattaatttagttgttgtaattgttgtgtgtaattaaacttgtataagtaaatgcacattatacttattcacaatgtaagtggagttcatggtatgtatatgtgtatatggtataaaatataccatgtatgtttattacataccatgttccaggcattgtcctaggtactgggaaacagcagtgagcaagagacaaaaatcttcattgagtctatgttctagtgtatgcgtgaaggggtagggggagacagacagttgccaaaatgagagtaggagattatagaaactctagttagttatggcagtgaaggtttttgggctcaaagtgcaagccatataatatcagcattctttttagaatgcttctgaacctaggtatactcctaacggggcaagcaacccggtacatcgacttataggtttccctacgttaatttgaacagatattaccaacttaagtgtcttcaattttattgtcataccaggtccttaaatctattcccgctctacctatttcccagattttattaaattatcttgtgcaatttagatagatatgcttttcctcagctcaaagctacatgagtattttttttccagaaaagactgactgctacttatactttttttgtatacttaaagtattttgaaatatcttcagctacactgtgataggtttaggtgcctcttagcttcctgtgtatagtatgtctttattcctacatgaaagcctcttggcaggtgggttagccagtcctctggcctcagttctgtttaataatatctttcagacagaattctctcctgatcctatctgctagtttttctgaaactcttaacctttcacaatatgaccttaaccacgtctcctttagtcacaattttattcctggaggaaataagcaatcttcagccttgagcctctaagtgaaatcgtcaaccagacttccaccaccctgtggcttggctgcctgcctgaattgttgtgacttctacagcgactcatttgtctcctttttctccttaaccccaaaggcttcttccacttggtgcgttcttttaggctatgatcatccagcaagtcttgctgtattctgtggcgttaacaaggtagccttattacaaacagagacccagaagcgtttagagatctgcttaagtttggaaggttaattgctggcagaaccagacctggaactctggtcccctgactccctgttccaagcattttctaattcacgtactgccaaaacaaagcaaaagcaaacaaaaaacccccgctgaataaaatgcttttatgcgtgacacagaagaagtgaactgaatgtcaatatgtgcctgaagaaaggtggcccatttaggctgatgaagctgtgatgaaggtccctagttgatgaacaatatatattcattgattgattgaaaataattgacttcttattccttgagattttccccaaacgaaaactgcatgtttagtgcctccttctaaaggtatctgaatttttttcagtacttaaaagactcagaagtataacctgtattatttttcactatttttaattaatgttaactcattattaatgattctttaaaaatgtctactctgtatgagtaaaatcatctataatacaaaatgcttcaaagtatgttatagcattcctgttttacagatgaggaaactaaggttcagaaagttaaataatgtgccaacaatcagacagagcttaagggtgagagccaggatctgcctcctcagggcatgccctgagcatgagatcaccataatgaagacatcatgggttgtttttacccataaagtattaatttttaatggcttaaccacaaaaaaagtattctcataaaaaggagaacagaaagaagtaataaaaatgcaattttccattccatttgatttatgagaaacaataaggggctagagcaactgagcaaacattctaaaattagaatccagctagtatcaaataatcaaactctaatcagcaaaatcgtttacatgacacttattataatgttgctactttttgttgtcacaggattgcatcattaacattattagtaaacctgcgcaatcagttaaaaatcactcatttcctgagaatcgcagaatgttgaatttttttacgatttcagtaaagttatattcttggagtacaagtacttttaaaattatttgttcttaatcagaaggttatgtgatgtctctgataataatgtatctattttaaatattgaaaattccctttcatcaaatataaaaaaacgcttattatgttcttgcccccaaattggtcaaaatgtacagcaaataataaatcagatttgttttgatgtacttcgtattcttgttaaaaagaaaaagatttccaaactctatagaaaattataaaagcaaaatgaatttactgattattaatcaaatggcgtgaatactaacctttcttccttgaaaaataaaatgggcacacagttttggtgagtataaaaagcctttcgcaagaaaaaactatgccaaaacattatatctggtattaatgctgactataatttctggcatcataatgcctaaatgttttaaagaagctaacaaataatttgatgaccgtatataaattatattattttatgctaacttttgtttatatatggaatagattaccaggcagtaaagtattatttctagtgcatataagtttcaaatctgttagtataagtttcaaatctgttaggtttcaagtctacttaaaattaaaatgtttctctgctactgaactaagcaatacttagtaatttaattatattttaaatatagcaattttatcacatttctttttttattacactgtaagttctggggtacatgtgcagaatgtgcaggtttgttaacattaggtatttctcctaatgctatccctcctctagcaccccaaccccgaacaagcccctgtgtgtgatgttccccactttgtgtccatgtgttctcattgtttactgccgctaatgaggacatgcagtgtttggctttctgttcttgtgtttgtttgctgagaatgatggttttcagcgtcatccatgtccctgcaaaggacatgaactcatccttttttatggctgcatagtattccatggtgtatctgtgccacattttctttatccagtctatcaatcattgatgggcacttgggttggttccaagtctttgctattgcgaacagtgccacattgtccagcctatcattgatgggcatttgggttggttccaagtctttgctgttgtgaacagtgccacaataaacatacatgtgcagatgtctttatagtagaatgtgttataatgctttgggtatataagcagtagtgggattgctgggtcaaatggtatttctggttctcgatccttgaggaatcgccaccctgtcttccacaatggttgaatgaatttacactcccatgaacagtgtaaaagccctccaatctctccacatcctctctagtatctgttgtttcctgactttttaatgatggccattctaactggcatgagatggtatctcagtgtgggtttgatttgtatttccctaatgaccagtgatgatgagctttatttcatatgtttgttggctgcataaatgtcatctttttagaaatgtcttttcatatcctttgcctactttttgatgggttttttttcttgtaaatttgtttgagttctttctttgtagattctggatattagccctttgtcggatgggtagatcacaaaaattttctcccattctgtaggttgcctgttcactctgatgatagtttctttggctgtgcagaaactctttagtttaattagatcccattagtcaattttggcttttgttgccattgcttttggtgttttagtcatgaagtctttgcccatgcttatgtcctgaatggtattgcttaggttgtcttctagggttttcatggttttaggtctaacatttaagtctttaatctatcttgagttaatttttgtataaggtgtaaggaaggggtccagttttagttttctgcatatggctatccagttttcccaacactatttattacatattgattcctttccacattgcttgtttttgtaaggtttgtccaagatcagatggttgtagatatgtggtgttatttctggggcctctcttctgttccattggtctatgtatctgttttggtaccagaaccatgatgttttggttactgtagccttgtagtgtagtttgaagtccgagagcatgatgcctccagctttggtctttttgcttaggattgtcttggctatatgggctctttttttgttcatatgaaatttaaagtagttttttctaattctgggaagaaagtcagtggtagcttgatggggatagcaatgaatctataaattactttggggagtatggccattttcacaatattgattcttcctatccatgcacatggaatgtttttccatttgtttgtgtcctctctgatttccttgagcagtggtttgtagttctccttgaggtccttcacatcccttgtaagttgtattcctaggtattttatttctttgtagaaattgtcaatgggacttcactgatgattgggctattatttgtgtataagaatgcttgtgatttttgcacattgattttgtatcctgagactttgctgaagttgcttatcatcataaggagatttggggctgagaagatggggttttctaaatatataatcttgtcatctgcaaacagagacaatttgactcatgtcttcctattttaataccctttatttctttctcttgccttactgccctggagagagcttccaatactatgttgagtaggaatggtgagagggggcacccttgtcttatgctggttttcaaagggaatgcttccagtttgtgcccattcagtatgatactggctatgggtttgtcacaaatagctcttattattttgatatgttccatcaatgcctagtttatttagagtttttagcatgaagcggtgttgaattttgtcgaaggccttttctgcatctattgagataatcatgtggtttttatcattggttctgtttatgtgatggattacgtttattgatttgcatatgttgaaccagccctgcatcccagggatgaagctgacttgatcatggtggataagctttttgatgtgctgctggatttggtttgccagtattttactgaggcttttcacatcgacgttcatcagggatatcggcctgaaattatctttttttgttgtgcctctgcctggttttggtatcaggatgatgctggcctcataaaatgagttagggaagagtccctctttttctattgtttggaatagtttcagaaggaatggtaccagctcctctttgtacctctggtagaatttggctgtgaatctgtctggtcctgggctttttttggttggtaggctattaatttcagaacttgttatcggtctattcagggattcaacttcttcctggtttagtcttgggagggtgtatgtgcccagaaatgtatcaatttcttatttcttctagattttctagcttatttgcctagaggtatttatagattctctgatggtagtttgtgtttctgtgggatccgtggtgatatcccctttaccattttttagtgtgtctatttgattcttctctctttatcagtctggctagtggtctctctagtttgttagtctttttaaaaaaccagctcctggattcacagattttttgaagtttttcgtgtgtgtgtctctgtctccttcagttctgctctgaccttagttatttcttgtcttctgctagcttttgaatttgtttgctcttgcttctcttgttcttttaattgtgatattagggtgttgattttagatcttccctgctttctttttatcacttttcttaatatgcaaattagttgaagcagtattttgtttattaaacccttataatggcatgttgttagtacataatgaagtataaacattgaaagagggaaaaaatcacatacaattgcacatactgaaagaggaaaacatatagattacgttttagaaataagattcacatggttgtagttttatatcatgataagagcaaatagttgcaaaataaaaatattttaagcagatatttaatatagaattttgaaaatccagaacccaggaataaatatgctaaaatgggcagaattctatttaaggaaatttttccagtagcattacagaaattaaataaatgtgagatataccatgttaatgaattgaaaaactcaatcttgtaaaaaaaaaaaatcccaagtctcaacagtgttttagtattggtcatgtatatttgctttgtttttgtggagcttgataagcaaattctgaaaattatatgaaagtgcgaaagttgaaaaattgtaaagattcacataaagaaagaaggtggaaaacttgccttacagaatatgaagacaactatgatacagtcttataagaatgcagaatttaaataaaatactgacaccaattggcttgcaaacacatgttatagaatggatagaaacaccaaacgaagatctgcatagttacagatgcttaagacagtggtgatattccagatctatatagataaataaaaaaagcatgtgaaaaaaggaagaaatttacccctattttgcattatactcaaaaatacattcaggtgaattaaagctctaaatacaaaagtaaacataaaatttttaaacatgatattggagaatatcttaatgaccttggagtggagcagaaaaatttaaaaagagagaaggaaaggaaaagggaggaaaaaaacaaaagtggcaaccattgaggaagactaattttttgaaaatctgtattagaattaggaaattttgttcttcaagtgccaagacaaactcagaagagaaagatgagttgtttgaactacaaagctaaaaatgatctatctagatttacagtcacacaaacaaaccaaaatcaaaacgaacaaaatggatcagggttactggaaatggagagttgttggtcaaaggatacaaattgcagttgtaagatgcataagttctggagatctaatgcacaggatagtgactgtaattaataataatgtattgcatacttgacatttactaacacagtatttgcgctacacacacaaaataacttcaaggtgatgcatatataacatttcatcttgtatacatatatcaaaacttcatgttgtttactttgaatatataccattttgttaactatatcacaataaagctgggaaaaatgcgataaagtagaaaaattggcaaatatcctgaccaagctttccataaacaagaaacttcaatagaagaagtgttcaactttattagtattagagaaatgcaaatttttaaaaatacattgtgtgatagccttaatacaaatgctccaaattaggaaacattttaataatctgaaaataccaagttataatggaacaaggggcaaccatacatgctggaagggttatatattttcatgaccactccagagacagtttggcattatgttccaaggatatgaatacccaagaatttagcttttcaacttttatgcaaatataccactaatctgttgtacatgtgcatacaacaatgttcatagcagcactgttagcactagcaaaaactgaaaaccacccacgtgtccatcaacaatgaaatgataaattcatgacagtgtattcagataatggaatactatgcaacaatgaaaattaataaactaaagctatatctaacaatataggtgaatcacataaacatactgttgaatgaaaggagtaagacacaaaggagcacatactgtgcaattctattcacctaaagctcaaaaacaggcaaaactaatatagatgctaaaactacaggaaaagtcaatgaataatcatcaccaaagtcagactggtattgcatagatttgtcttgtgaaaaaaaaaagttaaaatggtgtgtagggttgtgatcatggtgggccataaaaaaagtgtaggttttaaaatgttgccaatgttctagctcctcaccttcataatgattacataggtgttcccttcattatttctgcactcttcttggatataatgttaaatttgtacttatttttaaaatatctaccatacaccaaaactgctctattactgctaagtcacctaggttgtggatttctcagaacgaatatggatggctgtttatacttctgctgttgagctttaaaaaaaaatgatcattgcaattacattgaagagatgtagatcaatttgactccagagcttgtatttagagtttctttcatgtgtatgttctaatcacacctcagaaccctaagaaatagacattatagaacagtagaggtgaatatttcatgcattggtttaaagaacaccaacatgttagaaatttagaagaaatgtgggtgacaaaggtcgttaggttctccttctaaagataacaaggtgacaatagagcacatgccagatattacttatgccagtgaacttgctgaatatttgcagcatttcctctgaggttcaaaagacctccaaaatagacataatctagagtgattgataggcagttcccatgggccactatttcttcaggcagtgtttttttaagtactgtgaagtgcactcactttatcacaacatgtatatttcttttcatatatatactttaagttctggggatacataggcagaacgtgcaggtttgttacataggtatacacgtgccatggtggtttgctgcacccatcatctacattaggtatttctcctaatgctattccctcccctagcccctcacccaccaacaggccctagtatgtgatgttcccctctctgtgtccatgtgttctcattgttcacctcccacttatgactgacaacatgcggtgtttggttttctgtttctgtgtttgtttgctgagaatgatggtttccagcatcatccatgtccctgcaaagaacatgaattcaacttttttatggctgcatagtattccatggagtggatttgccacattttcgttatccagtctctcattgatgggcatttgggttggtgccaagtctttgctattgtgaatagtgctgcaataaacatatgtatgcatgtgtctttatagcagaatgatttataatccgttgggtatatacccagtaatgggattgctcggacaaatcacaacatgtatatttgtaacagatgaagaaagatgattgtttatgattcccagtagaaatgtagtttcatcaagagagaagagagtgaaagagtgagaaacagagatactaaatttaggaaattcattgaacagaaactccactttggactggaaatacatttctccaaaatcacaaaagagttactttgtgcacactcaagttacttctacttatggggaaaagtcaactatacattcataaatgattaacacttatgggataataatgacaactaacatgcaccgtatgccaggaatcatgctgcgcacttaatattcattacttcattcaatctttccatcactcctatgtggtggagaacactatctgcagtgccactaacgagcaacgtttgatctccctaatatgtaactaagatacaaagtagttaagagacttaagttgtataaccacaaggtcacataactagatctggatataccattatagggatccagatcagtatgactccagagcttgtattcttaagagttttcagaatatcttccatgtatatgttccagtcatacctcacaacagacattacagaacagtagagctgaatatttcatgcaattgtgtaaagaacaccaattctaaaaattatcattaggtatcccattcattttttttaattgtcaagtaagattagataataaaccaatacaattttctttactgaagtttttcatgattgggctgtgactcttcacaagagagctgtatagctagtggtattatctaaactgatgaattgtggggtccccttgaagaaggcccaagccccaatagagatgaaaatgttctaaatgaggctgtagagaatcagacaattgaaggacatttctagcagactgacttggtaaatattatagttaatacctgcagattgacattgcattctattaatgttcagtaaaacggttatatatcatagttcattcaaatatattttactctttgcaatttgtagagtatactgaaagatattttcatggatgatgttcaatattcttactagtaaatgcatattgtaagtaactttacagagagaatgtctaatcagagactaaactgacttcacatagacagtaggaagaagtccatgaagtggatttgagtcctctccttgctatgtagtttattttttcatttacaaaatgaataatacttatatcaaaaaagcaatgatgtaaataaaatttttatgctagacatacatatgacagaaggtggttattaattttagtaaaagcagaggtcagaggtctgtgcttttttagactagtaattgatatctcctctcaaggatagccctggagcttcctacacacacacacacacacacacacacacacacacacacacacaaaacaaaaaacaaaaaacaaaaaacacacctaagcattgattggtcttggaactgctcaaattcccttgacttcctaatttactcaaataagtcatcttctctaatggaactttaaaattgagagtggttcactatgctatggaggagtgaggccagcaggagacagccattcattcgtccaagtgggtgaatagggaagagtctgggctcaggatccagactccttggactctcattctggctgcctcacctactccctgctctttgttctcatctgcaacatccagacagtgaaagtaccaacgcagaaggttgtcatgagcattaaatgaactaaccgcgataaagaacttagaataatgcctgacacatattaacaccataaatgttaatgattctagttcttccatgcccaatcaatgataatgcagccactttcattatcctctatgctaattatactttattctattcactaaacagaactaactagcaatgttttgttagcctaatactagttattgtatttgagaataacaaattattattttattataaattattcataatttgaaatgtttacaaacagaaactagctggcttcatgaatgaaggcgtactgattttttaatttttgaaaattaacatccattgattttgatacaattcctccaagatattgtctagtattaggcatctgcttaagctattgcttttctcaccttgttagatataactcattcacacaactagatcaggcttatcactaccccataaaaaggataattacaatcaggaacatcaaaaatgtggcagaaacaaacgagagaactgaagagttgaaacttgatatttcatctcttgtttgctaatggtgcaaatgctttttccctcttcatattaatagtaatgagatctttgaatataatgtatatttcttggtaactgccttttttccccagttgctaagtaatatttcacctttcatcagaagagaaagatagatggtacttaacctgctttgcaagtcagagtaccagataactcaattcatttctggaatgccaaatgaggtttttattctcactagaggaagccaagggagtgtaaatatgactctagttcattattgcctttgtgcctcctacagccttagaaatgtgttagagtatattaagttttaaaacaacattatttttagagtacttggcaaaaattatctttcaaaatctctgtactaaatttcatttcgacaaattaaaaacaaaaaaattgatatttagcttatttagacatgacctttgttaacattcatttggagaatcttaaattaagattgagacataatagctaataaaaataaggagtcaggttacaacctgagtctcattataaaaattattacacttataattgtttatattatatacatatttaaacttgtttatgtttttttctgttttgttttacattatgccactcagtacagagcattctcactgtaatgttagtggtctaatgaatgttttgtatatcagagcaatatatttacatgatacagctgatctggatatgtacagatggatatgaaaatatttcttgaaggaataattcccttggatgtcatactactaatacttatcaagcaactattttctggaagtcaataaatacagtatacaacttcctacattattgctttggagtttactgtgaataccagaggtcctgaaatcaatcaatcagttgtctgacctactgcctaccacacacttcttgtttctgctgaccttgtttatttgctcaacttaatgtgcttaccttctaaccaaataatctcttctccagcccactgattatttcatttcctctgatttagttttctctgttttgaatagtttacctcattaggaccttccattatccctaaggatatttctgagtgaaaacaatcaaaatcattgctgttactcctatgtaccagacactttaaaaaggacttcatatgttttatatcatttagtccccaaatacacacatgagttattattattcttattttacaaatgaaagaattgaggcttagagaagttgcataactcacccaaggtcaaaatcctatctgactcaagtctacactcctaaccacaaaggtgagtttgaaagattctttaaaaactaggactagcctactactgttaacctacccttgtaaactgctaatgttattactgtgaacattcatagatccttattgaattttaaatcaaaagcttgagagactaagttttcatgattctctatgtccatcatttggcattgacgatatggacaatcaaaggcaaaaaaatctacttctgataacaggagaataaatagaaggagatgacaaagtgtatagttaataatgtatacttttaatgtggttctgtatttcttagtcctttgaattttatttagcctttcaattattatttgctggatttctgctttaaattaaaatacaatcttattaaaagagatagctatatctttcttattctatataccaatcctcatattacattaggctcatgaataaatagcaaatcaaatggaaaaattcatattttagttatacctaggtgaattagaaaaaaatggaggacacagcaaaagtgaacaactaaagagaagtcccaaaatacatactaaaaatataattttgttctgttctcattctccatcgtttataccataaattataacactagtactatagttgtatttcaataacagaaaagacatggaataaaaatgataaaactgctttaaaaataaaataacttggtaatttagtaacagatgactaatatgatttttgtagacatatcagaaaaccagcatgtaatattggtgagagtatggaaattagccagaagattctgtttgggtttttgaatattttagttacttgcttgcacaagttgcataacttttcttactaatttgtaaaagagattgataatccctgacctatgacactttttaaaaatcaagggagatattacacataaaagtcataaaaccataaaatattgtataaatgtatattttttacttattttttaagcagtccacagtcaatctcaggttctagttgataggtttcagctaaggagttgtctgttgaaagccggagtgcatcaaagtgaatgggaggttgggtaaaggaagaggagatgagggtcaggactagatgggtggcagcaaaaataaaaaattaaagaggcaattttggaaacattatgaaagaataggagactcagattctcatctactacaaatgaataattattaatcttgtaaataatatggttgaaggacaataaaataaagagtacatagatcttggtgcccctcctgctttcactgtactccagtgggaagtatcagatcctgtgtaacttggccctctcctctgttatcagtgtttctcacatagcaggtgctcaataagtatttactgagcaaagaaatgaataaattaatgaataggtcacagggttattgtgtcaaataagataatgtattgaaaagtgactaatgtatcaaaagagctctgttaattgtaaataatgacatataggaaaatgttattactaacttacaggaagtatttttaggtttcttagtaagaaagttccaataaagctcttcaaaaattaattgggttaccttcaaaatagtgaattccctatctctgaaagtttaaacatagaagttgaatcatcttccatcacataaccaaaataattactactgagagcgggagagtgaatgaataaggtctcatgcaattttaagattctacagtgccattaggaatgatacctaatgtttatttgatgcttgtttggtgtttgttaggcacagtgctgatcgccttgcattctattttgttaacccctaaagcaatccttgagataaatattattattacatacagaaaaatgggggctctgacaagttaaagaacttgcctgcatcataagctaggacataactaaggaaggattttaagccatatttatctaactcctgagctttcagtttaaagtgtgtatcactatgatactctgtctcataaaagagtagttttctctgttccagtttaccttctaaatgattggtgttggctgcttgatgattcaagtctctgttaccagaagcaaatcaaaagtaccatttctgatttcatgaatccctttaactaccaaatggtacgtgatgcatggaaagaagcaaataactataatatgattttttggagtgaaaaatacatttttaataaggtgtcattgatacttaatattccagaagcagtgctcaagattttgaaccaattagagatttgggcttcatctgaccagacattattacaaattttacaataatagtttagtagatgattactgcccccggcatatgaaaatgttccatgtaaacatctcattaccaagactaaatattaaagaaatgtattcctctaaaaggccctttgtgtttcagaatatggaaataattcttctgttcatttcatattattcaaggtaagtgttggcatcctaactgtatatggcctccaaataaggagttaatactaatgtattctattactccttagctcatggtaatcatgccaagaacactttttaaaattaaccccatgctctctcatgggttcatttaagaagaaatgttataagaattctttggaattagtgaaaaacaattttgtcctcctaccattaagtctgtcttcatatctaaagcagaataggcacaaaggaaagtagttactagctttgtgttaatgacttttaatttgtgtacacttaacagtatcttgaaaaattgtcttacctggtggattctctgtttggtcagatatctaaattaaaaaggcctttctctatgagtttcttggatcagttatcttagttttagagtcatatggtgtgaaggactaaaagatacattagaaatcaactagaataatttcctcattttataggtgaaagaaattgcctgtaagtgaaatgacttacttaatgacacacagaaaaatggggcagaagaagacttagaccccaagtgtcttatttcctagtttttatcctatgcatgattcatggaggaattcctgattgtgctacaatataaaatcatgtcatttccaacccttttaaagtggcatttcctgccacaacttccaaaccccgcccccaaattccaattaaaacagtacactgagtttaatattcatcaaaaacaaacaaaaaaaaattaaagtaacaatgtatttaatcttttattctttcagagagtgattaagacatatactgtgtgtaagatactgtgtgtaagagaccgtagcttctgcttaaaaacattatttaagcttaatttcaatagcaacagagaaaattggagatgactgataaatacatttaaagcaggcaaaatttgagatgttttcttaaacattcatttctgtattaatgtattcacttaacaaatacctagcactttatctgggtcaatcctcatgttagacacgagagatacaatgataaacacaaataggcctggaactgcctatttgagcttttaatataatggagaagcttatctcaaataagtatcacactaattaatgagtaataaattaggttaagtaaattaactgcttttctgaaggaaagaggtgtgatcctatgcatatgtgtaacaaaagaaacagacctagattaggactgaggtagtcaaggagaacttctggaaggaggtgacacttaaactgagaactgactgaagaatgggtgtcagctagccaaaagatagatggcagtagtggagtgaaggagctagaagtgattaaacttgttgaagaaggcatgtcaaatgccaagacaggccaaaagctaggcctcttgtggcagacagttagccaagctgtgaatgcaacggaaaagtcctggacagaatttacaagtgcatctccattgaatacacaaatgataagagtgcacaacagtctttgctgctatggagaaaattctggtggtctaggtagatcaagccaaccacaacattcccttaaactaaatcctactctagagcagagccttaatcctcttcaattctataaagtttgacagaggtgaggaagctgtagaaaaaaaaattttgaaccttgaagaggttggttcatgaggttgaagaaaataaatcatctccataacataaaatcacaaggtgagccagcaagtgctgacgtagaagctgcagcaagttacccagaagatataactaagggcattgatgaaagtggctacactaaacagtagattttcaatgtagacaaaacagccttattttggaagaggatgccgtctacgacttccaaagctagagaagagaagtgaatgcctggcttcaaagctgattctcttgttaggggctaatgtaactggtgattctaagttgaagccaatattcatttaatactccaaaaattgtagggctcttgagaattatgctaaatctactctgcctatgctctataaatgatacaacaaagactggataacacaacatctatttacagcttgctttactgaatattttaagcccactgttgagaaatactgctcagaataagattcctttcaaaatgttaccactcattgacaatgcacctggtcatctcagagccctgttggaaatggacaaagaaattaatgtgtttttcatgtctgctaacacaacattaattctgcagcccttggatgaaggagtaatttaattttcaagtcttattatttaagaattacattttgtaaggcttaagctaacatagatagtaattcctctgatggatctgggcaaagtaaattaaaaacgttctggaaaatgtttaccattgtagatgccattaagaacattcatagttcatggcaggaggtcagaatatcaacattaacaggagttggaagaatttgattccaacccttagggatgactctgaggagttcaagacttcagtagaggaagttactgcagatgtgttaggaaagagcaagagtagtattggaattggagactgatggtgtgactgaattcctgcaatctcatgataaaagttgaagggatgaggagttgtcccttatggatgaataaagaaagtggtttcttgagatggaatctattcctggtgaagatgctatgaacactgataaagaaagaaaggatttaggatatcacatcaactttgttgataaaactgtggcagggtttgaagagggttgactcctatttttgagagaagctctgttgggtgaagtatgaaccaacagcattgcatgctacagagaaatctttcatgaaaggaagagtccattgatgcagcaaactgtatcgttgtcttattttaagtaattgccaccagttacttaaactgtgactggacaagccatttaatatttctgaataatctgagtatttgccactagtcagttaagccaccacagccttcaacagccatcaccctgataagtcagcagccatctacggtgaagacccttcaccagcgaaaagattagaactggctgaaggctcagattacggttagcgttttatagcaataaattattttaaattaagatatgtgcattgtttcttagacaaaatgctattgtacacttaaccacagtatagtataacaataacttttgtatgcattggaaaacaagacatttttgtgacttgctttattaagatactgattttattgaggtggtttgcaactaaatccgcaatagttctaaggtgtgctagaacttttcttccatagtagctgagatttaagttgtctagttagtatgactaagtttttccattaatacaaatgtctatgctcatatcttcattgactatgctcattcacaccggccttctctctgtccctaggctaaaacttattctagtctcatgacctttttacctgttatttattccctccaacaagaatattttcctcccagattctgtgtaggtatttcttatccttgaggtcttagcttactgttactgtatgaaaatacttcccccaacttttctagataaaagaacacaccacagttcctgacccatggaaggcactccacaaatagtagctaatatgtttaatgttaaataataataattgaacgccttctattagtccttgcacagtaatagccacttttaacatttctaattctcaccatacaaatattaccatctctcattttgcaaatagattattcagacagattaaatggcatgcccaaaagcttgtgacagtctgtctaaatataaaatctgtgtatgattttgtttgcactatgtcaattttcattacaagaaataaaatgcacaaatgatgcagttattttgggcttaacacttcataagatagtcaggctattatgattttagattgggttatccaaacaatactatcatatttctccaaaacctttctatttatggcactggctaagccctacactcaaccaacattttaacttattcttgatttcctcatatactctagtcaacaatgacttaaaattctttttgtacttacagttatcccctaccacagaaattagctcttgagtgttgtcagtaagcaggttgtttcacataagtgaaaaagggatcagtgattatctcaaacgcactgagcatgttttatattcttgcgtgtcatccatagacaaggacagttccatgctgtctatggtggagtacaaattggaagtcagaaatggcatcttttctttgctctgagactgatcttgatgagaaagaaacttaaacttcaaggcaacttcagagaaaggaaaaaaaaagaatacactgattctctgatgcttactgttaactttaagatagaaaagaaattatagaaggtatcctgaaacaaaaacaaaaaaaaaactttttatttatgggtaaataggtgaaatgtgctagaaatcttgcccacactcttctttttatacatgagggggatgaggcagggaattaaagggaggtcaattacacatgagattacaagtgatgttattgtactgactgccactgtattttacaatgccacacataaaagttgattgatgttgatttgactctgttcaaaaaaataacttgagctaaattgtggaagagctgtgaatgaattgaaacaataaataaaatgagttcttttaatattaaaaagcttagccacggtcaagctttctaattaggtcagcataatttaaaatggactaagaaccatcccaggtggggatatcaaatatttataatcttgccccggatgctatctctgtgaccttagtggtttcagaagagcacttaatgtacccctagttcctatgagatttagatatttatgcagacaacagattaaaaagaacacgcaaaaatctcacacaaattcaagaaataatgaaggttacaattctttacgaatatttgtccttttcctttttagtcagcattaagaaatactgtcaggcttcatgtccaagttaatgtgaaatgacagattattcagttcagagcactgtgaagagctacagggtaaatgattcaatgccacctcaactatgtgtttttactgaaaaagttatcagttttgaactatatccaattctacagcatatttcagtgtaggaacatctcagtggaaacgtttagaacccagtgcaaagtcactctgaaagcatttacttagctttattgtgtttggttttaatttctctctctttgtgagatcaatttctcattagtgcaaagccgaatacttccaggggaaaacgaaggaatgtatttagttgagacaggtttttaccaaactattcgaaaagctaaaagaaaaaaaaacctctaatatatagtagaaaaaaatgttataaatacgttggtttatatctagctataaatagtgttttttcaaagtatggttcaaaggagaaacaaccattaagttttcagtagctttgtactgtcaaggaaaaaccagcttattcatgttaatacacatactgtagtaccatatgtacctaaaacagtgaaaaatcataaaaaatattttagcagtggaaataaagacagtaattgcaatccagtcaaatgaagttaattcaaaatgcaaacgcagtttgcattaaaactaataatattaaaacaaatactattaaaactaatagtagttactgtctctatctgtaactttcactccctgccacccaactgtagttagatagccagagatctcatcatgaaccttcatggggaaaaaaaaaatgtggtctgataaattaattacattaaaaaaagtgattaatcaaataccctgatgaggaaatggagaacatattaactaccatttgttgactacttattgtgttattatgatactcatttccttcctcaagtaaatttcagtctagggaaaacatttacaacagaatatgctgagtgctgggatactgaggagtagactagaagtataagaggacagaggaagagtaatgatgtgtgggtgaaaagataataactaggaatctgggaacattgcctaggtgtaatttgagtatcagcaaaacaataaaaattagagaatgataagtaatgtattagatatgagacttggaagcaggaaaagtcttacagaagtgaaggaaggctatttgcaaaaactcaagatcatgacaaaacagactcttcagagaccaagtagtgcattacgaatggaaaataggatggatatagatgtaaaaaagcagctgggattttgagatggaatcagaaaggcagaaagaggttatgattatgaggaatatcctatgtcatgctaagaagtttgggttttatcctgaatgcagtggggagcattaagtcagttagtgacatcaacctatgtcacactgtgaaggcatcaagaccaatgtgttgaaatggggagtggcctgataccaaaggcaaaggtagcagaattgcagtaacatagatgaatcctgatgagagtctcaaataaggtaggggaggtcagataaagcagtaataacataattaagcctaaggtgggaacaaagctacattaggcacccagtatactgaagaaacacctaaaattctggaaatcagacagctcctccagagccttgctagctgcaccagctctgcttatccaaatccttatcagcatagcattgccttccccattatgccaccttccattcctcacccctttacatatgagaatattaaagagaagggaagacattttttgcacactttagcgtagtgggggttgctaggctttttcttaacctaaccttcctacctccaaattcaaggaagagggaaggctcctagcactcatccccagaaattataaaaccagtattttatttcttgtttgagagtttgcctaggcaacagacttgccgattagctcttggccctgtttggacaggaagagaaaagaagtagagagagatgacaagacagagcagtggcaggaaagaaacctacacctccaccgtttagaaaggcaagagtatgcaagtttcccgtgggttggatggatggactttggagaaggtaggccagcatgaactttctaggctccatgagcaaaatggtagaggtggtagttgaaagaagtttagaaaagacagtgccagaggagtcgtctaagtcagggaactctgcagtaaggaggttccacagacatcacaggtgtgcttacaagagcgagcctttggaggcctgcctcagtcacagatggttctgtggacaaccagcttcacccagagtggcagctatgtcccagaagggaccacaacagaagttacataagtaagacgctggtcccttgcctgctcattctgtcctactttgatacacagagaaggaaaggaacctggaagcaggaggagaacaaatgtgaaaagagactttcctcctcacagctgcagggtcctgggtcccactctattgtcaatactgaactagagaagagaaagagaagagcaataaatcagagctaagctttacctttataacaactgaaagttatcaaaaagctatgggaccttcctggatgtccaaaagggatagaaaaatggatttgacagcatagttaaaggcaacggttagaaggagtaaaaccacttcatctttgttacccactgcatttagactctccagtaagtcagaaacaaggatatggatatcagagatacgtaaaacgtggaatagatccaacttcacctatttgttataagagaaaaaggaaagtaaattaaaacttttgagttagtagcctgaattatgttctgagctttaaaaaagaaatactctaggctttccttctctgggcatagtaatcgcacctataaaataaacaattgtatgatagttcttaaccttgttttcatcacagagtcccttgagaatctaagggcaactatatactgtctccacaaaaataggtacatgcacacatggaagtttccacacaaaatcctataaaatggaaaacattgaaatgagaagccaatttgagcaaaaagattgagtgtagctctatatatattaagcctgatatgcctgtgacgaataccttgtagagacagccttcagaaagaagacaagtctgtttctccattttgttttttgtttgtttgttttaatctcaagcaccttctgatatccagctgacaaaaaggcggcccccttcttattcttccattagagcctggaggttctgaaattattcggtcgcttagcacacaagtctctgcagtttcttcatgattcttgcagtgatgctgagccccaggggtggtggctcattaattaaagtaaattctgcacttaggctttcttcctcactttccaagtgctgtcatccttgtctctctgggtcacctcacttcttccttccagctaaactttatctagaagaaagaccatggtgacagcacagcctttcttgagtgtgtattgcccttagctgttaaaaaattttactgatcacgttaaagagtatgaatttctttcatttccatcatctgtaggaaacacgtgtcttatcttgttacccttgagtttcctcttctgtcagcctggattgtaggtcagagctgctactaagcatgtgatcttatgcaaagctttcttttgatatttacttcaggtcagtgtgcagtggctgaaaattcagtacaaatttgggaatccagcaggtctacttttaaaatcctcaggtttgtcagcccggtgtgcttcattttcttccttttcctgtattaaatgagtgtaataatatatgctaggtctttgtaagtgttaagataaggtatcaaaagtgccttgtacagtgcctagcaaatactaagggcttaataaatgttatcgaagtaaattattaccattgccttttttaacaaaaaaggaatttaaagtgatctggatctcaatgtcttcatctataaaatacagtgattcaagtatattcagtttgatttagtcctcatttattgagtatgcagtacttggaaaacactatgtaccagttaatgtgtcctttatgaagacaaaaagtgaaggaggttacgaattagtcaaggagacactgacgggaaaatatgtaacaaatcaaagagcctggttgaaattagggttctgccacttgctaaataaccttgaacaaggtagtaagtcatactgagccacatttttatcatcagtaaatgagaccaataatactcaactcacacagtggttagaagcattacatgaaacaaagttgggaagaaaagtagtatgatgtctgacacatgaggtgatccgtaaatgtttattattagcagaaacattttaagactttcataggtcctgggctctcttatttttttaagatctcatcctgcattatatcaaaaataataaaatgtacttatatcctataaaaaggtgctttttgctagaaaaatgtaaaaattacttttataattgactttatagttgaagggattcataactttttttttcttgagatggagtctcacccttgcccaggctagagtgcagtggctccatcttggctcactgcaacctctgccttccggttccaagtgattatcctgcctcaacctcccgagttgctgggattacaggcacctgccaccatgtccagctaatttttgtacttttagtagagacggggttttaccatgttggctaggctggtcacaaactcctgacctcaagtgacccacccacctctgcctcccaaagtgctgggattacaggcataagccactgagccagcctatgacaatggaagaattaggttgtagttggctgattgttataacgttacattgtattattttcaacactacagttattattttattgttcaagccaatagttattttttaaggtctcaaatttttatgttggcccttaaaaatgttgaaactatagtgcttaatggacaagtgctcttgtctattaaggaaaaatgtaacaaatgctatgatgaagccctgaggaagcaaaaatgaaggcaggaaaaattctatgtaaagtggattaaggatgagttcaggcagatatatttgagcagtgataaatagttaggaatctgaccactgaaaagcatgtggtcttacataactagaataatggtctccaaatagaagtctgagcaatttagagagtgagcaagagatccatgaggggaatggaagatggaagggagaaaatagtataacatacttgcttttaattctaattctaatttgaaactactgtttgttttactacatatttaatatatgagtatatttcatatagtatggtgtgtgtgtgtgtgtgtgtgtgtgtataaaatgcatatgtaacctctcaataaagcatatattgaggatgcattacaagacagttccgagatcttcccagcacagagcaggaaataattgaggttatgactatttggtgaagatattcagctcttctgctgaagagtatgttatcttgtaggcatggggagccatgaaatgtttaggaaaagagtgatcagatttgtaattttagaaattaaatcctgagataatgtgcaatttgaaggaaaggagcaaagactagagttcagaaaagtaattaagaaaaaattcaataggcttatccatggatcattttacctattcccctcccaagccaggaaaaagataaggctaactaattttgaacctccaagtgagatgtcagctcctctgagatgccttccctaactgtgctcacagcacccctgctgtgtatttcaagtagctccctgtatttccccctttccagaattgattacactacatagtaattgcgtgtttacttgtctaactcttcctttcacactgtggtacctgagggtaggaactgggtcatattcagaatcttatcccagaagccatctacagtacctggaatttagaaactactcaatgtgtagtttctatagtagtagttgatgaatctgactgaaatacttcactccttctccacttccagccattcagtgaactaattcccattagttcccattttcaagtctgtgcttagataccactttcacctgaaaggtgtgtctctgtttagcacttatctcctttaattaaaattgtatgtataattgtctttccttttaaaaagatggctatttcatctgccaaaacagggagccgacatatacgtagagtttaaagttctgttcagtgttaaattgaatatattcatgctcttctggggatattgttgtaagtcctgtggtgtgaaggagatggcctacatagtcaacccagatgacgtcatatactttcagcctctatgtagccactgtttttctcgtccaagttctctctcttctgacctggtttatggccacatccccaccctgtactcagcataaaaaaacctgccagggttctcatttcaaaggagcgaactcaatgtcctgtacagagaaaataggtagaggcaaaagcagagagtaccattatttatgaaggttttcagaatccatctgttctctggatcatgaaccctttatcaatgcactgtagcaaaaccctcagctccactccctcttctaccataaggagaatagcagctcttttcttgtgctcttcattagtagctactgacagtacagctgccatcatgcctctccaaacgttattaactcgttttcctaaaagcaaaacactattctggtctgttttatttcttttctatcttataaacataccatgctcacttttgaattctcctcctttgctcatttgttcccttttttcttaaaatcttcgtctacttcctcctccctgttcattctttcaaatctgtatcaaatcttgtccacttgtaactggactcctccagcttttattggtccttccttctgagctacactagaattatagtttgatacataattttaacattctgcaattcgcatgtgaacaattaaattgttaggactttatggacaaagattgtaccttaaaacttccttcatctcttctgccattatggcatagcacaagatatacactaagcattaatgctattcaccagacagttgtggtttttcttccacacacatagtaagattgtgtttccttgctgttctgaggtcacatgagactatttgccttgccagtgaagtgtgaatagaagtgttgtgtgctgtttttatgtgacaaatttaaaagtcacagtttgatttgggatattctatttttctctatcttggtcactggagaggtgtcagcacggatgcttaaatgaaggtgatatattgaagaactctccagctgacccccaatgggtggcatcccaaagattcaacgtcacttgctgaaggtgctgggagagccacctgcttagtgcatagcatgttttcacatttttgtgggtacatcagaggcatatacaagtatggggcacatgacctgttttgatacaggaatacaatgtgtaatcatcacatcagggcaagcactcatcatttctttgtgttgtgaacattccaattgtactccctcagttattctaaaatgtacaacaaattattgtcaactgtagttatcctgttgtgctcttaaatactagatcattcattgtatctaattatatttttgtacccattaactatcgtcatctccaccatcatcccctactcccatgctgccacagcctcaggtaactatcattctattctctagtttcatgagttcaactgctttaatttttaacctgtagcatttggatcatgagcatcagatattgggccagtttaggacagaagcaatcagagataacagagaaaacttctatggaataaatgtgaaacttctctactcctgacataagcataaccttcctattctacagtactgtaagagtactggtacacaatagtataaaaccattaggttgaaccaagtaaaattgacatttttataagataaaaatagccaaataatgaaaattttctatagttcaaccaaatagaaataagaccaggaggaaaaatgtgaaaaacctgcgagaagaaatgtgacacccttgaattagctattgagtcatatagtgtctgataataatgaaacctgcatttacctgattatacctgagaggtgatgatatactagaattcacttgttactagattataaccatattgaactaaaaataatttatccattgctaagccagaactaatgaatcaaatttgcatttacataaataacaaaggaaatttatattttataattacattccccagcttaaaagtctttttgaactcatttaagaagtagataatcgtaatagtcctatgtcttttttaaatatttaatgtgtagcttaaatctttcccacaaagaaaactttaggtgtagaactccctactggagaattctaccaaacatttaaggcaaaattaatgccaactctacaaaaactcttccagagatttgaggtggggcagatacttcccaactcattatacaaggacaacattatgcttaaacccaaactagacaaaaacattaacagaaaatacaattataggcaatatctcatgagaatcaagatgcaaaattcttagcaaaactatcttgacgaagaacaaagtgaaatgaattatttttcccgatttaaggattattagatgactacagtaatcaagactgtgtaatgctggtgcaggaatagacacataggttaacagaacaaaacagataacaaaaataaacccacataaatatgctcaactgatttttgacaaaagcaaaaaagtaattcaatggaaaaaggatagccttttggaaaatggtgctagagtgatttaatatcctgaggcaaaaacaaagacaaacaacaacaacaaacctctcaacctgtcttacatctccacaaaaattacctcaaaatgaatcagagacttaaacgtcaatgtaatattgtaaaaattttaaaaatacacacaaggaaagcataatgaactaaggttaaacaaagaattggcagatatgattccaaaagtatgatctataaaaggaaagttgatagattggtacttatcaatcaaaattaagaactcttgctctgtgaaagctcaggtaaaaaggataaaaggtaagctacggactggcagaaaatgctttcaaatcacgtacccaacaaagaactggtatctagaatatataaagtactctcaacacttatcaggaaagtaaaaataatccaattagaaaatgagcagaagatatgaagagacagcaagcacagaaaaagattttcaacatcattacaatcagaaaacaaaacaaaacaactaaaacatcacccactgctaactggtgatgatgtgtacaaagtggatcattcatacattgctggtatgaatgttaaatgatacagccaccttgaaaaacattttggctgtttcttacgaaactacatatgcaatttccatatgacacagatattatactcttgggcatttatcccagagaaattaaaacttatgttcacataaatatctgtacatcaatgcttgtagcaattttgtttgtaattataaaaaagtagaacctgcccagatgttgttcaatagctgaatggttaagcaaactatggtacatccatagcatggatcactacttagcaataaaaggaaataaactactgatacatgcaacaatttggatgagcctccaggcaggaaagtaaactgattgaaaaaaaccaatccccaaaagttatatactgttagattccactaatctaagatttttttgaaatggaaaaataatattataaatggagagaaattagcagttgccaggaattaggaagcgaatggtggtgagtatgtgggatgaagatgagtgtggttataaaaaggaaaataaagaatcggtgggttagaaatgtccaatatttttattgtggtggtagataaacccaaagtggtgaaaaatattgtataaaacttaaaatgcgcacttacacaaataagtcaaactggaaaaatctaaattaagatgaacgcgtataaaaatatcaatatgctggttgtgatattatactataattttgtaaaatattattggagaatactgaggaaagcatagaaggaatctgttttatttcttaaaactgcatgtgaccttacaattatctccaaaatgttcatttattaaataaatactttaaaaaagcaccaaaaatatagatataaacctttaaaaagatgtctaagatctatagaccaataactataaaacattgcttagagaaattgaagacctaaatagatggagttatgtcttcttcatgagttatatgactcactgaagttccaatcaaaatctcagcatgcctttttagaaactgacaagctaattcttaaattcatttggaaatgcaaaggacacagaacagccaaaacaatttgaaaaggaagagtaaagtaaaaggacttaatctatacaacttcaagagaggtcattatgctatagtattcaaaatggtgtgggtttgtcataaagacaggtaaatcaatgcagcagaacagagaatcaagaatttgacctacatatatatgccaattgatttttaacagtgatgtaaagcctgtgggaaaatacagtgttttagtttgggcagctgtaacaaattactgcagcctggttgcttacatatttatatctcatagttctggaggctgtgaagtccaggatcaggatgctaagatggttagtttctagtgaaggccctctttttggtttacagatggctattttccttctgtgtcctcacttgtcagagagcagagagagagagaaaacaatctctttcatgtctcttcttataagggcactaatctttatgaccttactaccatccaaagactccatctctaaatatcatcacattggcaattagaggcttatcatatgaatttgaggcagacataaacatccagatcatagaagttcatcatttcaaaatcaaagtatgatgcaactgagtaaccatttgcaaaataaataaatagtaagattctacttcataccacaaacaaaaagtgattcaaagtgtatcacagacataaacatcaaatttaaaactataacatttctaggaaaagaaaaacagaaatctctgtgaccttaggttaggtaaatatttctgaataaaacaaaagcacaatgcataaaataaaatcaataaattaaacttcaacatgaggaatttctgtttttggaaaaacattgagaaatgccacagactggtagaaaatagttgcatgtttcatacctaaaataagagttatttatacactgtaaaaaaaaaactctaaatcttgaaatctaatgaataaattgataaaaaagggtaaatatttgaacaattagctcaccaaagacaatatgcagatggaaaatgaacatatgaaaaattgctcaagatcattagggaaatgcaacttaaagccacaatggattctactacctacttgttatgatagctaaaataaaatagactgaccatacgaagtgctgcaagagctctcatacactgctggtaggaatgtaaagtggtacaaccacttggaaagattatgtcagcttcttaaaaaggtaaacgtaagcataaagaagttgatctagtcattgcaatcttaaatatttacccaaaagaaatgaaagcatatatccatagaagacttgtgcacaaatgttcatggtatctttattttttatagccctaagctgagagcaacccaaacatccatcaacaggtaaatggataaacaaattatggtatatacacacaatggaatgaatactactcagcaataaaaggaagtgaattactgataattggagccccagggctgaatctcaatttaattatgccaagtgaaataaactagagtaaaagtatgtaatgtattattctgtttatagaaaattctagaaaaatgcaaactagaaaaatgcaaactaacttatcgtgatgggaaacagatcagtagttgcctaggacaacgatggggttagaaggggctgggggaatgcaagggaacacagggatgcttctgagggtgatgcatatgtttattatcttcactatggtaatggttttatgactacagacatacaggaaaacttttcaaagcatacactttaaacatgtgcgattatatgcctataataactcagtaaagttgttgaaaaatgttaatagcttcccattgcccttaaaattaagaacaaatgattttcacaggatactatgttctacagggtctccccctcgcctacctctccagtctcatcttttgcccctccctgaccatctctctgttgccatcaggattggccatttcttcaaggttttcttgtccttccgacctcaggatctttgcaaatgcaagtccccctgctttcccacactgaaggataagctcaaatcaatcacccttcagttctcagctcaaatattaccccctaagaagagacttaactacttccgtaaatagctcaggtttctgtgttatttcctggcactctctactatttcctttttaacatttatcacacatttcacttatattttcagtaaaatttaatgtatatcacatgccactacagtacatttacatatattatgtaatcaatacttttaaagaactagatattatgacagttttacatttaggaaggagattaagaaactttgcttaagatcacacatagagtagtcagtgtcagtaatttgaacacagccctatcctgctttaaaacatagggtcttaattaatgattaattaaatgattctatgatataatgtccaccctgatatgataccaaaaagaaatctgatctgctgaaagcggatgtatgccaaggaatgcaagtggcttccagaagctgaaagcagtatccagctgacagacagcaagggaacagggacacatacaagacaaattctgccaacaggcatgaacttggaagcagcttcctctcctgagcgtccagagaggagccctgcctggccaacaccttttgagactgtaagcagaaaatccaattaagcccacccccccagacttctaaccaaaagaataaatgtatgtttagttcattaatagctatttgttatgcagcagtggaaaactattacttttctattttctaaagtgcttacatatgatatatagggatcatttacaaattatatttcttattaataagttgatacagtatggctctgtatccccacctaaatctcatctacattgtaatccctacatgttgaagaagggacccagtgggaggtcattgtatcatgggggtggtttcccccatgctggtctcatgatttgtagtgagttctcatgaggactgatggttttatatggggctcttcccaccttggcgctctctctcctgccgccatgtgaagaaggacatgtttgcttcccttttctccatgattagaagtttcttgaggcctccccattcatgaagactgtgagtcaattaaacctctttacttcataaattacccagtctcaggtacgtctttataccagtgtgaaaattgtctcatacataagtcatgggctcaatcaagtcattttaacttttggggggttttgttgcttgatctgtaaaatgaagttttactggataagttctactctctcaacttccctaagtctaagaattcatttctagctttttgcaactattgtgacacaccctgatcaggtatcctccattctcctctccagattcattctccacccttcagtactctgcagtataccccaagagactgacccctaagaactacatcagtgggctcccttgtccctgagaatggggcagcagaagtgataaagaagagcgaggtctcggtatttatttcctggcttcctacaagtacacaatacattaaggggaaaaatgattcctaacttcacttgtgaatttttggaagcagaggaaggacacgtaatggactgaactgtgtcctcccaaaatgcatatgttgaagccctaaccctcaatttaaatgtatttgagggagggcttctaagaagtaattaaagttaaatgtgttcataagtataggctcccaatccaatagaactggtgatgttttagaagaggaagagaaacctctctctctctgccacacatgtgcactgaggaaaggccacgtgagcacacggtgagaaggcagcaatctgcaagccaggaagacagacagcccttacccaaacccaaccattcttgcacctgattttggactgtccagtcttcagaattgtgaggaaataaatttctgttgttaaacaacgtaatctagaaatcaaagatcactaaataatatcgcaatgggtaaacagacggtacttccaggcaagcagtctatttgtaaaggtttaaactaagttgtgtagtatctgacaagtaagccaaacatagatatggagagtccaggctgggcagggtggctcatgcctgtaatcccagcactttgggaggccaagacaggtacattctttgagtctaggagtttgagaccatcatgggcaacatggcaaagcccatctctacaaataaataagtaactaaatacaaaaattagccaggcatggtggtgcatgcctgtagtcccagtctttactcaggaggctgaggtgggagaatctcttgatcccagaaggttgaggctgcactgagccatgactgtaccactgcattccagcctgggtgacagagcaagaccttgtctcaaaaataaataaaaatataatgaaataacaaatatagggtccagaaaatggccccgaaatcaagataggcaaaataagtcaataataaattcctacaagataggggtaatcacagtgatgtcctacatgaactgggctactggacagactaacaaagcagagactgagtaactaggtgcaaggtgagaagcaagacatctccagggctagatagaaacttatggagaagtctagagaccaggacataagtgtgacttgatcttgaatgcaagaatgctgatttaaatttccaaaatctctcccagcccctgaaaaccttcacctcactgctcccttcactccctttcttcaagtcaaagactgtctgagcagaattaatccccatatatgaaaattctataatgtagaagccacatggtaatagcagaggaatgaagacaaaggggctgtattgtaaggaagtattaattcaatattaaattatctaagtaattacgtgtgcaataaccagacattgtaatgtaaatcacattatctaatctgtatttttgtgaagttaaaaaaaatgagctcagctggtaagcatttgcaatttgaatcagtagacagaattttggagaaatgacactgccacttaacagacaaaaaacattgtggaattttttttccatttgtgtgtgtcttctattacctctttcagcagtgttttatagttctccttatagagatctgtcacctccttagttacatatagtcctaggtattttaatttttttgcagctattgtaaatgggattatgttcttcatttcactcttgcttgttgtgtatagaaatgctgttgagttttgtacatcgattttgtatcctgtaactttattgtagttgtttatcagttccaggagtcatttggcagtctttagggttttctaggtatagaatcagattgtcagcaaagctggaaaaatcagtattaaaatggccatacttcccaaaacaatctacaattcaacgctattcctatcaagctgccaacggtttttttttttcgtgtaactagaaaaacttattctaaaattcatatggaaccataaaatagaccaaataaccaaagcatttctaagcagaaagtagaaagcgggaggcatcatattacagggcttcaaactatagtataaggttacagtaaactaaaacagcatggtactagtacaaagacagacacatagaccaatgggactgaatagagaaaccagaaagaaagctccacacctacagtcatcttaccaaagttgacaaaaataagtaatgaggaaaggacttcttggtcaataaatggtgttgggatcgctgacaagtcatatgcaaaagaatgaaactggacccctacctctcaccatatacaataattaactaaaaatggattaaaaatgtaaatgtaagacctcaaagtataagaatcctagaagaaaaactaggaaacatcattctggacattggccttgggacatttgtgactaagtcctcaaaaacaattgtaaccacagcaaaaaacattgacaagtgtgacctaattaaactaaagagcttctgcagagcaaaagaaaactatcaatatagtaaataccctgcagaatgggagaaaatattctcaaactacgcacacaacaaaggtctaatatccagaatctatgaggaacataaacaattgaacaactgaaaaacagctccattaaaagagcaaaagacatgaacagacacttcttacaggaagacatacaagaggccagccaggtgcagtggctcactcctgtaatcctagcactttgggaggccacggtgggcaaatcacttgaagccaggagttcaagaccagactgaccaacatggtgaaaccatatctctacaaaacatacaaaaattagccgggtgtagcgggccacagggggcgaggagagacctgaggcaggaggatcccttgcatcccccagaggttgaggctgcagcgagctgtgattgcaccactgtactccagtctgggtgacagagtgagactctgtcttaaaacaacaacaagaacaaaacagacaagaggccaacaaacatacgaaaaaatgatccacattactaattgtcagagaaatgcaaatcaaagccataatgagacaccatctcacaccagtcaaaatggctatcattaacaagacaaaaacaacagatgctggtgaggctgtggagaagagggaatgtttacatactgttggtgggaatgtaaactagttcagccactatggaaagcaatttggagattcctcagagaacttaaactgctattcaacccaacaatcccattactggttatacatccaaaagaaaataaatagttctaccaaaatgaaatactcatatgttcattgtagcactagtcacaataatgaagacatcgactcaacctatgtgcccatcaatggtgaattatataaagaaaatgtggtacatacacactgtggaatactagccagccataaaaatgaacgagatcttgtcctttgtaacaacatggatgcaactggaggccattatccaaagtgaattaacacggcaacagaaaaccagtgccacatgttctcactcttaagtgggaggtaaacaatggaactcatggacattaaaatggcaacaataaaaactgaagactactagaggagagagggagaaagtggggcaagagttgaaaaactaactattgggtactgtgctctaccctgggtgacaggatcaatcaatccgaaacctcatcatcatgcaatatacccacccaggtaacaaacctgcccatgtatcccctggatctaaaataaaagttaaaattataaaataaataagttgaattaaaaaaaaaaaaaaaaaccttgtggtactcaaaattctgcatgcccaagtggatcaggggccgaaagtacagggcattcataaactgtctttaatagtttatgttaaatgttgcctcctgtcagtaagaaagcactcctcttaaatcaaaaactataatactgccagtgtctgtgacacatttatttctttaaaggaagtaaacttttaagccaaacttcttacctgctagatgagaattcacccaagtcagtaaaatccacataatttcaagatattaacaatcagcacaaattaatgtcaaccatctgtaattcttacaagaggatgcttgtttgtttacaaagagtataatttttgctttctaatacattgttttgtagcataggtatctttggggttgaaatggaataaataacatttcattttcatagaaaatgaacactatataatgaatagaacttttcattgacaatcttgaatgcattacattactcttaagggcattgtgtttttcaaatgttttaagctagcatctctcctagacttaaatgacaaaatgaagttcaccatttctagtttgactttttttctaaatttgtcttccttcttacacatcataaatcaagtttgatccatattggaaaccatatgttttcaaactgatatctttattaatgaaaatatgtaagtataaattcctgggcagtttttttcagcagcctagaatctaatatcaattgttacgaagttcaatgctctaaataaccatgagctccagttaattgacaagattgaatacacattttaaaataacataaagaatgttgactaaacatttagtcattatttctaaatcttaaatagtttaatattatcatactgccatggaataaattgtccttagaatcaggaggatccaattttaggattttaggattttaaagttcacaggggctactggttcttacccaaagctagtggcatattcactaaaaccacaacagccgtgtctattatgtttcaggttgccggagtaggtcgatgcactggtgaaataataggttatatttctggagcatagaagggagaaaaggacaaaagtactaattaaatttgaaatctgtataatcctggaataaatacacaggagaatacgttaattccaaatgtcagcctcattttcactgaacttctaaaaatttttaacaacgctttaatttttcaccttcatatgaaagtgaaggtccagttttaacaaaggtcttgaaagagcccaaatgcaaacttagatatcatattcttatgtttagaaagtgcagtgcaagcagcccaggtatcaggttgcattttcatactcttgctactctggtggcaacgcagaataactgccataaatcatctcttggctgtatacaattaattttgtgttctgtacttatactcctctatgtttttatgctgttttttttttttatatatgacttttgaggtcactcttggttttaggtgaaatactcaagcttaatattaaaatatcactgggtgatattgtagtaacaagttctaataaccaaactcagggtcaccccttctgcaagttttaaaattaactgtcaaaaaatgtcaaaagaaaaatatcttgttactccttaacctttttgaatataagaagatttaagtaagcttattatacttcttgaagggtaaaatatttctactatcactgcatattttcacagtgatcctttatcttacttattatcaccctagaaatggttttagacttcatcattggttcttactatttagctgattgcagtaaaacagaaaaaaaaactgtttttaaataattttcagaatagctattcttccagacgggagtctacggatcctaaatgcttccaaatcagacgagggaaagtacgtttgccgaggggaaaacgtctttggttctgctgaaattatagcttcgctatctgtaaaaggtaagacagcacgggtaaatgttttacaagcatagtctcatggtcttatcggaaagagaataaatataatataaatgcatatatgtttggacttaagtgtgtgcatgcttgtgtttataaaatacattgcaaacatagaactaaaacagccacattgttactttccaccatttagggtaccaaaaatgaaggaacctcttattggcagaaattttattttgctttgaataaaatttgtgagagaatgaggcaagctttctgaagttttagtcagtgtctcaaaacttgaaagtatgccaacggtataaaaatatttttcctctaccaagaataattttagcatcaatcactaatattactctgttatcacttcaactagggatttggggcagaaaggagcagcagcaggaggatatgatggaggggtggtataggacttcgcattagataaactggctccagagctgtttgttgatgtctgtatcaatgaaatttttatatgcctttattttatataagcaatattaatattactgcttatatgtttccattcattttatcgttctaaaatgagctcgatttcaagcctagaacattctgttgaggctctatgtcattgtttagtgacagaaaacctatcttaggcagtcccttcagatgtttttcacattgagtctttaattgttttcactgtgcatgtatcatatggcaaaccatactccggccataaaaatataaaaatattattttttctgtctttaaaataaaaatgtaattaatacatttacattactggtactaaaataccagtactctgatattttagaagagagaacatcaagaaagaaaagaacaaaatgtaaaatatactttcatttatataatgcattactggactcaaacgcagcctttcagttcttattccttctgtgtgctagttgttccattttgtaataaggcaatgctagatccaaagacatttttaaaataacaacaaaaatgttattttcttaatcatgagtttaattgtttactcagaacactccaatccccacaaaatttaaactacagtgtactgcttttatctgtcttctctgatgaggccagaacttagaatgccatatggaacatttgacttccagaatgttaatatttacagtgacattcctgtcccaggattccatttttttctcagtgactgcatagaaggacatggaacattaaaggatctgatcagtggttaggagtggtgtttcatcagactgcactgtcgcaaacaatagacctagaataggaaatttaagccaattgttaatcactgtgttaattgtcttgaggtatctatgaccaggaatctaactaggaaagaagataaaaccaaaatcttcatcacctctctactatatttaaaacacatcatcttgtaatcagctaatcactaacttaactcttaaatgtaaagcctgttttagcctttattggttcaaagttgctctaaacccagtaaaaaagtgtgtttttaaaatttaactgaatcattaaggagttaaacataaacattgttttctaaaaacatttccattcagtgtttctacctttctttatatatgccaattaagccatctacaatacagcaaaggtacaaaaacaggtacgttcttctgattaaaaaatacttttctactcctaaaagctttttgtcgagtgtaaagcaaatacaaggtagtgttgttgtagtattatatttttatctctgttaagatagttatttggagggaggtgctttctattgccctgtagcctcctctcatctttaagcaagtgaaccctctctgaattcttcctgaaacacataacctttttattgtaaaaaatcttttatttacttaatgatccttgaaagtggtcagagaggctacagcctcttctttttttctaatgttcctccttccataatgtcaaatgctgcttctaattaggtagtctcttgtctttttaaaatccaagtcacattcttaataggaacagaggctcttaaatcatttctcccctacaaaaacatggtaatatgccctagcatccaaaagctaataaagatgtaaaaaagctggtatatgtatctggagcaactgtattgtatagatttcttcttttctcaattatttcaagcaaaatattatgtatggtaacacaacaggttgattatcttaattaacgtatttttatttctatagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggccgtaagtgaatacacttttattcttttagtaatgataactttagaaattttgaatcaaatgtaagaccttgcttagctatgaagtgctaagaaaaaaaaaaacagaacatcgacttgataaaaacaattactttctgccattattttatgttatgtcaaactgaaagtaatatgtaattattttaaaacccccagtaaaaaactgagaatacctcattatttaaatctggtttctttgccacctttgtttaatatttacacaatacttctcaaaagttatgttgctacataaagtggcaattcattatttaaagcatcgttaacagtaattatgataaaataaataaataaaatgcctgcctgtccttctcctcaagaacagtaatttttggagtttctttaattttttacaagctatagagcttaaacatacaactcgtagtcataaatgcacattagccttaagtcagtattcaaagatatactcatttctgccatttttttcttaatatcttcttttatattgtgtacctacatggcaatcaaccaaatggagtgggaaatctcttgaaccaaatcctacagaaccatcacagtgctttaactctagagaagtgaaaagaggccccttccccacatggacttatttaaaatgtaatagagtaacataatgagagagggaggagaaagacagatggaactggggtggcagaaaaagagcgactttggctggaatcttccttctatattggctaaagagatggagccaaatacaatttttgcctacaaattggatttaaaatgctgttgcatacttattagtatcagttgatccatcctgaaacactttgagaagcattggaaaaccatagctttagtgagcccaagtatttaaactcagtgtcaattggattttattttaaaggttatgggatacaaggaaaaaaaaaaaaaagccctaaatccaaagtcaggaattctctggatcaaatcccagcttaatctctagtcagctgtgtaacataaagccagtcacatgatttgcctgggcattaatttctggagaaatcaaagtgaaaaagttacaccagataatttctaagatagcttctcaccttagaatttggtaaatgtatattagtggaagagtaaagatgagctctctttgttgcattttccaatgtaacaaaaattagcccactttcttcaaaactattcctttcttcctggtttactatccaattaataggagagagtatataaataagaaacaattgccaactacattgttcaccatctcattaaatgagcgaattttaactgttaatatccaagttatatgtaaagtatttagagtgtgttaaattaaacacattttgctctgctttatggttttccttcttcctttaccttgggtgataattccttcctacaatacttttcctacacattttataacatggatgttgtaaaacagaccaagaaaatttaattttaaaatatcacattttgattaaaaaatcccatgagaaaaatatcttcttaggattgtctgcaaacatcccttttgagtgatcacatatctaaagaaaaaatacatctaaaaataaatagcccctcttcttataagtaatccctctctttattttacaataccaatataaaaatgaatgtacctggtgaagttacatgaattattgtttttgtctcttagacatagatatgtttaggttgatgtcattcatttgtatcaataaatacctttttttccatgaagttggcagttaagaacatctgctgtattcttctttgcatatatgctttccttgccccagagagtgccaaatggactccttattccacgcaaacccatataattacaacccactttgaaattaggctctggattagagacagtaacaataaactctgagatagaagaagaaagcaaatcatggtactgagaagggagaaaaacatttagctttaaggtataaagccaaaatatacttttagtatgcatatgtattttaaaacatatggaagcttcaaaactatggcatgtataagaaattatctatcacctttctctcagttacttcaaacactgagtcttggttggcttcaaggacacacaccagagaaaataccattgtatgacaataaaaaggcaaagaatggaaagaacaacattctgtttcccttctgcccttctcatgtaaattatgtctggaaaataatgctttaggagaaaacatataaaagtgttataaaggcagatttgggaggccttctgggcttgtggataccttctttctgtgagaccaaggacagactgtgggagtcagagggacaggatggggctgagaagagagccaagtggggtgactcaaggtctgctttgagtttccaagaagagtcattaaaggatctcctaaggtgtctaacttatcccagcagagtaaaaaaatgaaaatgggattccgggacttaagcaggaatagagtgtgcctatgattggagcactgtccaggctaactgtcctgggacagaaccctgccagtgggtgagtgaatgagggtgaatcagaagaaaaacacattaccactgcatgaggtaacttaaactaactaaacctctcaggtgggaaaaagagataacaatattttgtattattttgtagatgccaaaatatgacttaatgatgttccctatttttcaactgttgtactggtatcttttatacacagacattagcttgcatataaatctctagtcaattattttatgtagccttcatatacaatctatatacaatgtacattgtatacatccacatctatatacaatgcacatttttatgttttaaaatagatgattgctttgaactccatttcaacagagtgcataaacatatgatcacatcaggctaaaaaataatagtattgctttaaattaaaaattaagtttaaattaaaacattcataatgaaaatgcttctactatttatgttgccctcttaggccatgttttacaaactcagcaatttgactaatttggagtgaatccattattggaagtcactgttgaaaggggagaagcaatcagttagtacataaacatttgatccaattcatccaaatccttttttttggcaaattttatgaataaactgaatgtgataagctagtgagtatattcttaagattttaaatctttttagttctacaagctaaatgctgttgggggatggggatccaaaataaaaggcatagcccttcacacctaagagagcaccatttaagggtagaaattgcagtatgggctatgatctgctataataaagctacaccagagaactatgtgcattcagctgtttgttagaaggggttggtatttgaaatggacctggcctcagatccattcaaatggaaggatttcagcaggtgcataggagaagctgcatctcagacagagcgagcacgttgggcaaacaaagaagggcagaagagcttagtgcgtgttttgggaacagtgaggaaccagtgagggtgtatagtagacaataagtcactgtttgttgaataagtttaaaggaaagcagcagaggcctcaaaggcactgatttcggagctataaaatttgatttgtattttgagtacagcagggattcacatgattcagatttgtttttaggaagataattctgacagctgtgtggagcagggattggctagtttgtggattttacattcagtgtagacctgttaagtagaggttataataaggagataatcgttgtaagtgttgaccttaaataaccatcctgtaaccaaataaaagcatttactatggtgtcctgacttgagagtttatgttggtcagaggtctacaagaacctctgattcctctcaggatatctgaatagcatctgagctattgagcattgccatgtggccccagagccacagtcttaatggaggactgtgctgagccactgttttccagtgacttgaagtcctctaattattcaaataggatataagaaagtttctatccttataatgcataaagaagtgttacactgaatatcatggtggcctgcaatttgctgcttttttaacacagaaaaatatctcacgcatttgttgtcagaatggtccactagagaagaattgccctttcattgtgaacttgataaattgcaaccaaataggcaactgagccaaagtgctatatagctgtatggtccttcacatttacccaattctctggttatagcaatacatgtaggaaggcagaatgggaattttgagcccatttttttaatgaggaaactgaagaataagacttttccaggccacataaattggggtaataagattcaatatcatgtgatttttaaactacacatttgttcactctcctttataaaccctctccatattcactgaccacttcttatgtgttaagcctttgtctataaactgtgagaaataaaaataaaaggaaggtttgaatccagtcttcagtaaacataaagataatgcaagacattaagcaattcaagaaaaatatgaccataaaaacaattactaactaacttttaaaatcacagccaaattttgttgaagactagaaagagattaatgtgatattttgtcattgtggagaaaagcaaaataaataattgaacacctatgtgccaagcactgagctaagatagatggatactgtatgtatgtctgtctagacacacacacacacacacaatagctcactgattcctcttaacagccatatgaagtaatgttatttggggaaaacatgctacctgacctagacctcagtgagtagcattagaatagtcaaagaagaaaaaggaaggcaacctaaggtgagaaaagatattgttatcttagggttgtgctggatcttagagattattgagtttggcctaggctggtaccggaagtctctttcagtatcactagtgtatgtcctaaccctttaagtgatgaggactcactcctctaaagttcgtttcattatcagtcacttctgaatgtcagaagattggaaagtaggagtaattatgatcacctgtatgccaagcatgagactcataaggaaacatgcctgattcatatgcagaatttttgtggaatattaggtgaatagaaagacagaatataaaccccttagtgccttgagaattttatattagctggaaaactctagcctatattaattttcttattacagacacttctactcctagtttatcttcttcagaattagctatttcctaaggagtaaaagtctctgaatagaacatagtaagtgctcaattggcaacattctgtttcctgattgataaatattaattgtgtaaaaatcaatggaatgcttgggtatactgccagtttactaaggcacaaagctgtaagcgtttcataagcaaatgcttcatcctcttcttcatcaacttggcatgcgaagtcctggagccatttcaccactaaacaggaagtgtatcaaagggcggaagatctaacaaaggctcacagtctcttagactcattatgtttgctagtagcattcacactttcatgtaaatggtcccatggactccgagcgctaccctttccctatctcactaagggcctatcctttctcatcagttcagatcctacctcttggttctttggcctgctctgaacgctggcaacctagtaatccacccattttctattccaacctcctgaccgccacatatttgctatattactgttccctcccaatctttcacctaacttaaaaaattgtgtaattttaataggacagaaacatacagtaaccatcaaccaaaacttggggaccctcacgaagaaagattaccttcaaaggttttagaatattcagactatcccagaaaagtgcaccatattcattctccctgacttgtatgtgctaaaaaatgtgtctccactcactgtcttctcaaagtagaaatcattccgaaagcaaataagaatgtccatcttttttttggtattatatatgtttgtttcatatagtttatgaatatgatcaatatatgccatttaattatgttattctataatatttcatgtattgatgataaactgcagggatcctaaaagcaagggctaataagtaattttatttttcatcactttgtactaagaatgtccataaaacagccattcagctagccaatgctgtttcaataaaaacaaaacctgatataaagcgttttctctgcttagccaactgctacattatttcagaggttttaatataattaaatactgcataaaattctgttaaaatctgttttcataacagaatagtttgtttccttgcttttttactttttacacaaaatggaatatcacgttagcacagtttggaattgaatgaaagatgactgccttgatgacacctaagacagtctgttattgggagacccttacttcctatgggtcacagggcagtcagtactggaaagtagtgctgtattgattgcccatctccactttactctaattagcagatttttcacacatagcaaaatgtgaagtgcgtctcttcactttctgtagattgtcaaaattagtaaaattaggtaacgtcttcaagttgtcccatataaaaagacaggcttagccatccaattcataggctgaactttgttcatctaaatataatctaccaaaacaaacttcctatattgtcgtaggtatacagagcatttttattaatttggaagttccatttttgatagctgttttatctttatgacaggtctcataacattatgtgtgctatgaatagttactagtatccttgcaaatttttattttggtgtagaactgcaggtctttgttattattgtcagagagagaatataaagctctctgatagagaaaggcaatttttgtcgggggcatgcttggaaatattagatcaataccttggattctgtaatctctgaggggataagagtaccgtaattcccagagccagctaggatattttaggttattggatagaaaaaaaattgaagaatgagaaatagaagacactccttactccttagaatttgctctcctaggttgtaaatttcaaaagttaaatatgcttctagctcagtaactccagaaacttaaaaaatgcttacaggtatctaggactgtatatgttttctctttctgaggttttgtgtttttccaatgttgtttttccatttcatacctatataaactcagactagtttttaataatcctatattctcactgagttgattgtttttaatccaacaaaaacatgaatttatctggaatgaagtgcctattattgggaaatgtgatcactggtaggccacagtgggttgttgcattcactgttgttaactttgacagtaaagtcaatccgatttatttcagtgatgtttattaaaccaaattctcacctaactccaagttacttttgacaatgacttacttagacataacagtctttctgatatacataacaaacttctcatgcaaatttctattgattatcctgtaattgtacattgaagagcaatcaatggctcctggctttaaaaccattttccctttccaatctgacagaaacttcagaaggcaaaaaaaaaaagtcttaattatatacatgctattaaaagcttagaatgagtgaataaccaaataaatgaatattatcaaaaccattctttataacattatcactttccacttgtatcaaatgttcaagttactgaaatgagtacctaaattatctttggtgcctaataaccatcttttctcagtattcaactttacacataatcggtactttcttttatttatatcttaagggactgctgttcacatcttgataatttttcaatatatctctacctccctcctgttttcctttacttgtctttcactattcatattactcgtgagcctattccaatgaattgaaattggaaggataactaatgtgtcaactttaactgaagataccataagccagtgtagtagatactgtggtgtgttgcccaggttctcccttcaagactgaaccactccttccccaagctatggagaatattgggggctgacagctctcagcagtgttccgctctgggaattgccttcagtcaaagagagttatctggttcaagctgtgctccaccccaatctcatgctcaatgcatagagatgattagtgtacaggggtgattataaagaccagacccctggcctcagctccagaattacatctctcacctgttgaatgcctaatagatacctggcaatatgctagacttttcaaatattatttcatttacttccctcaaatacgctatggtatagaaattgtgttattgttgttgtcattgttgtttgacaaaacaagaaaaagaaatttagaaagataaacaactttcccaaacttaaacaactgttggatacaagagttatccaaactaggactgaactccaatacattatcatttatcagatctagggcatatctagaactatttagcaagatcacatttttaatttcctacttagtaaacttagtaatatcttgtgaaaaatgtaattatccttcatccattttagaatttgtgagtcaattatttccattgccggtaacattttcatgtattcttctaatattactcattcttatgaagtttatattatgattatgtggttacatttacactatatgagatccaattttcaagtatttatacatttcactatcatgggcaatctcctgcccctttgccagaaaacatatttctattaaatatagatatatatttatatttatatatttatattaaaagcagccgtataagtcagattattaaaaccttaattgtttgttttataataagtttgaaacagtttcattgtctgagtaagacctaagctaaaacatttaaatagaattttacatttttaacagccctttttacccttcttccctcataggtattatttcattggattcctgtaactacactgttagtcagccaagttatatataaatgagaacactgagccccaggaaggaagacaagtaaaggtcctccctaatgaagacctgagcaacacaggcccatttacgcaacagcccccatcatcacttgggcttccttgaacttaaaacttcattgccatgaacgatgttccaaatctgatttgctgttgtaaagcacagagagaactaaaactagctgtaactcttcattgtgtcttttaacactgagatgataaaaaagatggtgttattctctgaagtcttacctctttagctgggtaactacatctgttactactatacttacttgatcactattaaaacattaaaattaaaattatgttcagtaagataaaatcatcaaattgtttaaaattctcccataaaagttactgagaattatttgaaaaacatcttaaaatatcctactacacttgcctcttcagatgttctgtgggtgtgttttcccattaattaaagctcattcttctggctgctgcaattgtttcattttatggtatgtgaacccatttttatcaacatccctttttaggctttgaagcttctctcaaaatggatatgagatgcagtatgttacattgctttaacaactgaagtggatgcaaagaatgtagagtacaaaggtctcaatcattcttctgaagaaaataattggtatccacattttggacattaaaatcatacctgttcttaataagtatgcatttacagcattgttttatgcagttttggccaccaaaatccagttttcaagtcaggtatctggcagtgtctcagattcttttctttactcccatatatccatcaaattttcaaatattactaattccattttgaatctgttgattccttttctccattcctggagtcaaagtcctattcccagcacttatttctagtgctgtcatctcaccaccttttacactataatgactatcattaccatgtttctaacaagccgagtttatcatactgcccctccccatcccatccaattacataaatgtgcacgtacacacacacacacacacacacacacacacactgcccctatcttggatctaactccagcctacatatcaaacttcatcttccaacatttttctcttattattttacagcaaagcataataattctctgaaaatatcatgttctcacatgctgacccactgccaagaatactcttccctgacttgtaagctttgcaaactgcagcatttgcctccaggcaacttgaagtcctttcccagtgcttccattataccttacagatcccgccaccaggatctatgctgctttaaacatttgctcagttttttttcctcttctagtctttatgtttctgaaagttagttaggaacatacttatttgctgggcttaacacagtacctggtgcacagtaaagaccaaataaatatttgtagtcattaaaggaatcagtagacataggagtatatgaactaaaaactagccatttagagtagctcaccaagaaacaaacattgactaatatatatatatatatatatatatatatatatatatatatatatataattataggcagacagatagatatatcgctctctatatagatatctatatatctctcattgatctatatggagagatgatatatagatatctatagatctatagatatagatctgtaaatatagatacacatgaaaagaaagagagaagagagacaggctctcactctgtcgcctaggctaaagtacagtagtacaatctcagctcactatagcccccacctcccagactcaagccatcctcccacctcagcctccagttaaagagttttagttaacagaggaagtttctaacttctgttgtaattatagaatattatcagtgataaacatgtttattcattttacttcacataaaaatttaagtatttttaatgttgtcctaaaagtaattattttctctggagataataatcacaggagttgctcataaaagagaaaaatacaatggattctagttttcatgttgaagaaatactgatatgttttataagcattgcattattttaaggagaatgccctacatatatgtatgtatctaggagatataatttaacctggagaatgatgaaatgcgtaatataataaggccctgaatactggaatttttaccttgtaggaataatatatgaaaaagatttttctttttagttttttgaaagccttcttagataaaagattgttcctattatttaataccacataaggtttaggatttatataagcaaacagttcagttttacattttgaaatactattgatatgtaagtattgtgtttttagattgactcctatgttatttctcaaagtgattttcaaagagttgggtttttgagaggccattatttctaagacatctttaaaattctaccttcattttgcaatttctctttcggcatctgttttgtattaaattctaaagggtgactaagtgttatgatatatttagttttcagcttttcagaatcctctagtttctttcatggactatttttatcatattacagcacaaaaatcagctttaggagtctagaattaataataggtagcatctcaaatatgttttctctctcagaaaaggaggaagaggaaattttagaaaagactattggactattattcacttcctttttccatctggtatccattatataagagacctggaaaaggtcactttaaagaatttgagaagcatgacaccattttatttaatgaataattgaagcctctattgagcatttatcagtgtacaatacaatcagccttctgtctcacgggttctgtatccatggattcaaccaatgtggatagaaaacactttaaaatcaataagagcatacaacaaaaaatacagtacagtataacaactatttacctagcatttatattatattagatattataactaatctagagataatttaaagtatactgtagagtatgcattaggttatatgcaaatactacactatttcatataagggacttgagcaagcatgcattgtgctatgctgtcctgaaaccagtcttccatggatacagaaggcaactatacataagttcttattttatctcagttccatggaaataagtggagcattcacacactaggcactattcaggagctgaggattctgtattaatcaataacaaacattatatgggaggtatacgaatacaactgaagtaaagcactgtctttgagggtcagtcttacagaggaacatacatatagagatatggcaattgtaatgaaggaagtatgttcaggaagctgagtcaaaggtacacatcatccaacccgtggaagcagggcagacttcctaaaccaaatgttacctgtgcctactcttaaaacagagtaagttttgcagacaaagcagagagaggaagtacaaaagaaaaagactttacaggtagagggtgagcatgatgaaatatgggagatactgaagttttgtctactaaatcccaataataaataatgatcttatagttaaacttcatttaatatattactatagtaattctgtattaaagagggcttctcaaattccctatgagagttaagtaaatgaccatgattattcttggtttcaattatagcaaggtacatatacatagcaaaagtaaagttgccagatttttccaaattaaatccagggataaactatatcttgcttaacataagtatacgtgttttacataaatttagatgttgcttgaagctttctgtggtatagataaaatagaaattattacaactgtaacactcaatttttagggtcattgagataattccctgaggactgtatgattttttttcgtgaggctgcttgttattctaaaggcagttctaagaataaatgtacttcgggaaaacagggactaatatcagaacttctgcttcctttcacatttattctcatactaaacaataaatttttttaggacagggattatatctattttgccaaccactgccagcacctggcatcatgcctggcagatatatttgctaaacaaaatatatattaaataaaatgtttaattattatataaacaaatagaattgtatatccttatatatcagcacttttttatatccttattatctgctgaactacccaaccaaaaaataaaaatatatcaatgtcaggaaaaatgtgataactttgttcactttgcaaacacttaatggttacctgtaatgtgtacagcattaaccagagtatggttgaataagaccaggccagtgtcacccttttacatagagctgtttgtctattaacagatagatggacctttaaacaactatttaacatgataagctttatagtattcagatattatactgatgagagaaataaactcgaggagaaatttgacttaataaataggtatgtcattagcagaaaagcttgttcttacaattaatgtttaattgaattcaactaagctcattactaaaggttgttcaaccaactagcataagctaaggtaataatctgactgataatttttgaattaccttaaaatcaactctttttctttatataccttacacattctataaaaccaaagaatttactattttcaggcaaaattagataaaataatttagattgctttaccagtgaagatataacattactaacttgttcaaagacatcttaagaagcctcactaaaactaaaaaatactgcattttatcctttctaactactgatagccccataaataaatatattatatttacaaaatttgttttaaagtacctattaaatatagtgatagtatttcctaaaagcatttttgaaacctgtacttcaattgccattatttatcatttgcaagaaaagttaaatacttatggctttccccaaaataagggaccctgtgacatgctttgctcactgagctcgtcacatcactaatcattccaacagtctgctatggtgtctctggtgtttaaaattactgtagctctaccatgttaaactgcaaacatttcaatatcatatgacaatatcaaatgcttccatttgctttgtaaaataatcaggcaggagaatttaaagttcatttttgttgctaactttttttgggttttgcccacattgctgtttccaaccacatttagtctcataccaaaattctgactggaataactcattagtctgtctcatttttatattttaggcattgagatttaaatatttttagaggaaaaaactacatttaagtatcaatgaataccttttgctcatctgctgtaactataggaaaggaaataagaagttgttatcctaaatatatagaggtaagaattaaatatggtctctatcaattttcactacaaaataaaccttgcaaaaacctagtggcttcaaataaccatttatttagttcatgattctgtgggttggcaatgtgggttgggctcagccagagtacatctatgggtctcaccaagactcacgcatctgcaatcagctgcctatcaacttcaaggcattcatttcgggcatcatctggccattggctggggctgctggaggaagtgagccacatgtttctcatcatccaccaggctagcccaggcttgttcacattaaagatctcagggttctaagaccaagagcagtagtgctaagactccttaggcctagactcagaacttgctcaaagaaacttacatcacattttactggttaaaacaagccataaggccataccagatttaaagggtaaggaaataggctccacctctggttgggaagaactgcaaaattttgtggccatttttgcaacctaccaccatctgcccacaatttttacatttctccaacttgcaactttcataccagaatccacagaagtctcattcaatcatggctccaaatttactttccagttagcttttgctgcaaaacaaactgcccaaaatgtatgactcaaatctaatggtcagtggcttgatctggactcagttgagtgactgctggtggtctcagttggggtcataaatgcatctactgtcagcgatcaggtcaactgggagctgtttggtgaagggggcagctaggatggcttgtctctactctaagtggtcttctattctgcagcaggctagtccaagctatgtcgcgtggttatcacagaatttcaagacaggaatctccagtgcacgcacgcaatgcaattgtctgtttgctccatggtcacacatgtctcactgacctatccaagtcacttacagaagcacagagtgagtgtgagaggagattatataaggatgtggatccaggaccattactgtagcaatctaccacacaacctctaaatgatactttagctgtgatatcattttgatactaaactaaaatttagattttatgtgtggtgtgatgtggaggagagaggtgtaggagatagcctttcaaaaaataatcatttgtacaaccctaaaagtcaacatatattgtcactatcaacatgaactaggtaaactgctcttaccaaattaaccagccactatttgaatggatccttttttactgaattaagttcagccagacaaagcacttaatctggttaaagagagtcatttttccattttacatggttaacattctttttaacatgttagaaaattctaatcactttacttgttaatagaaaatcagcaacagttagaaattaacagggaaacattaatttctaatgaaaacataaatgggttaattggtttttcacaaaaatagcatgtctagaagacagtcataatatttgctacctcatctgtcctaaaataatccttgttaaatgtttctaccacatgttagttctagtgatctcagtgcctcagccacattttgataaaaacaaaagcaggtatatttattaataaactactataaagagactatgggcatatctgaagcaaaaataaagtatactgcatgttacatacacaaaatgaattcataggctcttttaaaccagcatgttccagttgtttcctcactaatgaataagggtattgttatttgtgttatcactgactttgctgcagagcttaactagtggagagaatgaaaatatttatgaacctgtagctaatctagaattacattaagcatttattatataaagctgtgataacagtaggttaatctaagaaaatagtagaggttaaaaaaatagtccagcctgcacacatggttcaagcctgaaatcccagcattttcagaggccggggccagtggatcacctgagcccaagagttcgagatcagcctgggcaacacagtgaaaacctgcctctatacaaaaaaaaaaaaaaaaaaatacaaaaaattatccaggcttgatggcatgtatctgtagtcccagctacaagggagacaggtgggaggatcgcttgagcccaggaggcagaggttgccgtgagccaagaacctgccactgcactccaacctgggtgacagggcgagactatctcaaaaaaaaaaaaaaaaaaaagtccagatttatattgttttcaacttctccaataattctgtttcctatgaaacttatttatatagattatatgggtggctttgaggtacaaaataggtatacacattttaggatgtgaatgtgtaactcaagtattagacttgataattcaaagatttaggagctttcaaaagatatttgaagataaaaacaaagatgactaatgtatattgattaatgcatttgagacttgacaaagtttataatgatgatagattacattaggcagttttgctgaatttcttgtattcaacagtaatgtttccatctgtgaacacaatgctagaaaatttgtttcccatgaggtaggtttttagctagtaataccaaaaaataatgtgaaccccatcaacgtccttcaagaaacctttcaagaatgtgtatgcagtcatgatgataatctcaatacataaaatcaaaaagactttggaaatcaacttaactatatggctcgatatgccaaaagataattcaaatatagattgtgtattcgtcttcacagaaacccaatgtgctgccaagataagtttgaagtaatataactatttctaggtagttgacacattgtacaatgtgctagattaagccaaaaataaaaactgtctgtagttagcttgagccatcctagttgcataaagctcgaatcaaacctttaagatccagagaccagttgtaaaatgtcatcctccatgtgtctagaagtccttgatcagccactgaggtttcatctatcattataagcattacatttactatgctattacaattacttttaacattaagaacttctggtgggtgatgcccaccagtagtaaaggtaacatgcttttgaggttttggaactcagttgccagcatttacgtatttctgctagcttgaaaaggtatgatgaatagttaatagcaggacaacatcgtagcagcttccccaagattaacaactaaaataagacttttgctaagcaactttaaaataatgtatgaagaacgatgtcaaatgaagaccaacggaattgagctatagattgtagcagacaaccacagtgctagatcagtctgatattgggaaaaaaaaaaagtggggatttttttttaccaatgtcttgggaaagaccataaatcatagaggcagaatcttaaacagactaagttctaaatagccatctgtagttataaatagaaggcaatcttcacttggacacaacttaagaagagctgcttatcaggtatggatcatgttagccatacaagttgattagtttataatctttagttgatggtaaacacttagctttgtacttctccatcataaccctagctttcagctctaagtcagtttgtttgtttttttaaccacaatgaaggtacatttaatttttctaacataaatttttaaaagtttattgtagatcatttgaacatattaaaacttgaaagaagaaaataaaaactacctggaaaattatgtggatatattcaccagtaatgtttgtaaccatgttttcatatgtcccttcaagcacatatagacacacactttacacaggtgagatcatatcatggatgtttaaaatgctttaaaaggatgactttccccctacttttatctccccataatggcatctatcacacccagtttagtttgctaatatcctcatgtatgtccttctgtattttactctgtcctactgtagtcctgggcagatttacatatgaatgggaatatttttataattgttttataaaaattaaatcatattttacattctttttctgaatctcataattatcactcaataataatcttgaaaattgttctatgtcaccttgtatagctctaatgcattcttttcaatagatccataataatccataatgtgactatacttcaatgtatttagccatttccctattaaataccaactttgtttcctttgttgagagatttctgaacaatgctacagaaaacatctttaaacatctgtatctttgtatatcaacaatttcctttctgtgggacagattaccaggaatagacgacagggtcaaagaacaaaactatttttaatttaaatgggtgctgccaaatttttgttattgcataaaaatatgcagcatctaattacattactgcattacagcattatgtggtaaaagttactagacagggggcaagagttctttgtgtaggcccaactttgtttctagttagctgtacgaccttggggaagtcatgtcccttgtctaggtctccatcttcaaagttaaaaggctagagtagatgattcctaatgactttatctagttctaaagtttggtgatttttttcatttatattcaaaaagtaaaatctcagcaactctccagatataatgtccaataacttgaaatcatgaaatgatctaaaaaaattttagtggacaccaaccatgttttaggagggattactgctagctctaaaatcatatttttctctcataaatattgcaaactttcttaatcttggaagatgtttcagtctcatggcacccttagtactgggaatttctcaatgcaggaggaacttcaaactggaaaaaaattcaagtcagaattattccccatggcagaaacaacatttgtatctgtaatatcttactaaataataaaagattcctgtaaagttaaagattttctctaaaagcaacgataagcttatagaatgaaaaaatgccattctctctgtataatagatcagcatcctttattttgtataactagttccctccaaatttcacatacaatgaaacaatcaagccctatcaatatgaaatcttggatcaaatatataagcatatatgataattggtgttgcaataaattcaaatgtgtacaactttgaaagtcttttaaatataattctaaatgcacctgtcaatgacttcagttccagcatttacatatttctgctagcttgaagacaataatctacagggtctcttgtaatactggaagctgtattatacagttagagaacaatgagcagtagtagaatatggtctcgatgatttttcagtatcaatctgacttgactttgatttttgaacattcaataaatggtgaatcctctttcataaaattcaatgcctagctaagacttgttatttaaaatgagttttctgtggctgtgtcttgactcactttcaaaatgtcagttaaatttgactgagtgtccttgaccttgaacttttcatagttggttttgattgacacatctattcaaattgacctttttttaaactgaactattcttctatttgaatgttcattggaagattgttgctgtactctacaatgtaagcattgctttgaatagttagctttttctgacattgatgtgttttaattgcctcaattctaagtatttttgaagttgatgagaatcttcctgattgtgaaagatagtgttaaaatggatgctatcacccattttcttcttttgcagtcaggtattttttcattcagaaacttgtttctaagcatcagaaactttcaaagcaagcttggcaaaagaatactcagtatttggtcttaaagcacatagttgaaataatacagctacttgttgaagactatgcttattaaaatatttactagtattgccaaaaaagatgacaaatatgtatctcataaacttgaattgtgaaaaagtttgaaagatccaaatattaatttactggaaaatagtctttagaaatgctgatataaaattaattatttcattagtaatattaagttttgtaaaaaaaaatgtatgaaagttcttctaccatttttgttcatttctttcttttaaaatgtctgccaatatgcgtattccatagaaaactgtgtatttccatagcaaaagcagttagcctaaaatatatccctgaagggtaggggcattaggagcaaaatggagctagtcgtgctaggccttctttccactgctacaattgtgcttgaaaaatgagtaattctgtctttacaactcatctccctaaatacacagttaaaccagttggcaccatcagtcttcttcctgaaaatctccttacataaacccaaagttcatccatgatgaataatgtgttgcccacatgacctcaggtgacaatgttgccaaactttccaacactacgtggaaggtcaccttttcttcaaccatgaatacccatgtcctcactgtccttcagtccctgttcaacagtctccttgaggcccttccagctttcactagtagtgtcatcatgacccttccaacctttgcacacctaaccccgaagccaacgtcaagtgttttggctttagttaacagcagtaccccacttgtaggtaccacattattttatggttattctctgctgtacaagtactccaaaacctagcagtataaaactacaaagattttactctgcttcccattttgtgggcaagtaaatcaggcagataacagcaaggatggcttgaatatgcttcacagttgctaagccttcagctggggtagccaaatggctggagatggctgggatggctcagggggtgctatatgccagaagcctcagttgtggatattggataggttcccgagatcttctccatgttgcttctgccaagtctagaatccccagtgtgattttgttattcacaagtatagctgggctagaatggttaaaataactggaaatgtctggccttctctctttatctatgtaatctcccacctcactagcttagcctttttcacatgacagtctgaatgtagtacaatttttcttacattccccagaatagatgtcccaatgggcttagaaagaagttacaagccttcttatgatccagccataggattttcagtacctcactttttccacatgatattggcataaaaagttaccaaggccagtccagattcaaggagtaggaaattagagtatacctcccagtaagtcaaatggcaaaacatatgtggacattcttaatctaccacagtgaacaagtagttatatcctaggccgaacagattctttgtacaacactgcatacaagtagtgttaccataaagcacagcaactaatgcagtgtaaaacagattgtgaatgattcattatgcaatagtgtcatgttcagccgtaataaaatagagtatatctcaccattggctctagagataaattttaaataccccataatgcaatgcttagtcactataatggaaacaggaaagaataagtaataggaaagaataagtatcagcaagcagaaatgaagagaagctggggatattaaatgtaattcatatggagcattgacattccattccaagtattggcaggtattgtactctagagagaggttgtggattacagggcaggggcagaatcaatgccctggaaggaataaaaggcaaaataatatgcaaattggtcattaatcaatgagaggaggaaagaaatggaagtagaatgaacaggtggagctcttctagttttatgggacttagcatcagcctccctcctctatgagaccagagatcgaaggtgaaaaagaaattgcttttatctgtgagaccaaaccacaaaggaggtacacaaacaaactggcctcattccatgctaattcttagagttccatacaaaaatcaatgaagcacagagtggtctactacaatcccaagattttggatttttcacaataccaggtcaatactcattttaactgatgagtgagatgaagctactcatactctccgtggctgggctctgcttatttcaaggaggagttagaaaacctacaggcaggtatctgagtattcttccacacagccaggaagagaccagatttgtgttaagacactgactattctgcaatgtaaaaatagcagcagaataaaatgtaatttatcctggaagccagtgtaacaaaataatattaatcttaaaagataaattggaaatatgacaaaacaatctctaaattagaataaaaaagatatatcagtaaaatatcaattcatctaaattatgcacttaggttaggaagtaaaatttggccaattctttttccactaaagctgtgttattataaattacacatgactaactgaggacacgtcagttgtgggtcacatattgaaaattttcttgatactagataagtgtcacaataaaagtaaatgatggcatgagcaaatgaactaaatgggtcttgggtgttatcggaaaggtgatactgacatttcatagagctatgcagccttttatgcctagatgcggttgatgaaaacagtcataaaagcatgagcttttcaaataaacctatggttcattgaaataatttctaataatagttttatggtcattactactcaatgaagccattttatattactacacttgccaaatttgaattaactagtgcaagtgaatgaaattacctataggttcaagcaaaacaaggaggggtttcctagatggcacaggagaatagaaggaatacctgatcaaaaatcagatgcccaaagctttactcctgcctccacacttagcttgcccatggacaagttacctaaactcttcagccccattttctcaactgctatgggaattggttaggctacataatttatttatctttccacactaaaatcatttttttctgcaatgactttttgtactattacctatttcaacaaaacacatcacattacagctggttgttacctctaacattgtgttgtgagtttctcaaagccataatttatcttttctctttatcttgtagcatgtgtagatcaagtatgataaaaagatagcatattttatgccagcttcttttaacacagtgacttttatgctagtcactgtgttaagaagaatctattggttgggtcacagtacagccatgcttgctatgataaagaagaacatagttgcaaaagtgtcacatatttgtgattttctgtctagacaaaatgacagtctaccaagttcttgttaaataattacataattgtgcatgtgctataagcatccataaaatgtatagctactgtagaatgttataattctagacctttcctggtggtcatgtattactagctatttacaaagcacaagctaatgcataaatgtacaatttttttctgactagttctatcgcctttgtgtaacttcaatgagaggtattttatggagcatagacttagtgaaagatagtaagattattctattactagacagtgggataattcactgcaagcaaaaatgtgtattgtctgtcacaattgctaaaatcttcttacctaccagcgttgcctcattgagccaacctatggaccagctgttattcagcttagaagatgttattactgaggagatttcaagagaaagttgatccatcatacaaacactagagaggaatttctcataactttaatgatgtgagtttaaatactactcctgcctagaattctcttaaactggtttgccattgtacttacaaaactgccaatttaaaagtgaggttgagagtcccaacatggtcccttctacctctaggactgtaaagtttagaggagtcctcacctccattctttcaactgagatactgtcctctttcctttgtcattaacaaaccagtataaagtgaacaggttgaatctaatgatatgcgtcaatgagctttgtatttgcattggaggtccaagaaaaaagtagaaagaatatttggagaaaataacacataaatataccaacgcctggatagccttacaccaaacattcagtataaaatgtaacatatatcactgtagtttctaacacaagccttaagaagatgtattctatttctgtatttacatatcagcatacgctaaaaaaagacttcaagtcaataaagcataaaagagaaagtataaacattaaagcaggaaaggataagtgttctataatttacaaagagatgcataccagctcctcgatatttatctcaaagaccaatgtttcatagaatgggctaatgtttcagaagaccacaggaaatatcaatgtggattggagtggtgagcaggaccaacctcatgggcatgtaacccactgggcaccatactgagaagggtctcatacttgatatagtgcttgactgttaccattttgaagtcttcattttaaaacaaagaatcctgcattttcttatgcacaggggcccacaaattacgtagccagtcctggtggtctgtgaaacctttctgaaagagataagacttgaacaaggtcttaacatatgagatataatttgtagattttggtggatcactggggaactgcttgaaggttcagagactgcattttccaccatggtgagagacaagataggttgagtctagcctcatatgctagattaagaacgtggaccatcttgtaggcaaaagggaaccagtgatgatttttgaggtggtaaataaaatcagttttaaaggattaacttagcattggcatagcagatggataagcatgtgagacagagagttgatcacaaagaggatataaagacctcatttcaaagctactattaaaaatataaatttaggaatcagtgctcatacaatgattgctaaaactatataaggcacacaaaaagagaaaatacttttctccggactaagcctgagtattgtgctatcaaataacagatccatctctccccatgtctcttcaaagctcagatgtaggtatgaggaaagctggtccacactccctgccaatgtgtcttctgtcaaagctgaattagacaggaaactccttgagcacagattctatgcctgtatccacaaatcttagcacagcacaaatgaataccttttgtaattagtaatatactgaataaacaataaagggagatgagttaaacagtctcatcatcaggtaacacaaacttttgccatcagattgaatggagctacaagtcagcccaggaaaacatgagattgataaattatgtgaccttatctatttcagccctctctttaccttggaagcactagattaatacagaaatgctaccagcccttttgcattactcacttgtgttaatgtcagataaagaacttcccatttaccttgtggctagggaaaacacaattgtttctcctctttaatctatgtcaacaaatagaactgtttctgcatttttcttaggacttaaattattagaatatggattgaaaattaaatatcaagatcccagtcttgggatgttacagccctatttactcattttgagtcttcaatgtgttgttggctatgtttaatacttcatcataatacacataaatgttttgtcaaatattattttgactattttcttcactagtagtgattaatagttttacttctgataacatgttcagttattcaagcatgtaggttaaatatcatctattttctaaaaacaatattaaaacccatatcatccttaaaccctattctatgagtagtaaagaaaaaactataaaaagactgtctatgtattatttccttatcatagtagggtactttaaacaaattaccagctgggcgtggtggctcatgcctgtaatctgagcactttgggaggctgaggtgggtggatcatgaggtcgagagatcgagaccatcctggctaacacagtgaatccctgtctctactaaaaatacaaaaaattagccgggcgtggtggcaggcacctgtggtcccagctactcgggaggctaaggcaggagaatggtgcgaacccgggaggcggagcttgcagtgagccaagattgcaccagtgcactccagcctgggtgacagagcgagactctgtctcaattaaaaaaaaaaaaaattatcctcttggaagaagaaatactgttactaggaaaatattttaactccaagtttttacgtcagtaacattaaacttatctaaaaatctctgtctcatggctgatacccagttatttatgctagataagatttagaaaactaaaaatgcttaatacataaaatgcttaatgcttttctacaataagacagaaaggatgtgaggaatatttatatctaaaataaagctaggtatttccatagcttactctagctatggaaaatattgatacccagtttgctaagagagtgaataccaatttaaaaaccttcctcttggctaagagtgcaattatagtgcccttcaacagataaattttatcagacacttactatatgccagacacactgctatgggctttactcacattatcatattgaaactctgagagaagctctgagcaatggagtgattttcccaaggtgaatatctaataagtggtagagcagggattcacacaattctgtcattctagaacccacatatactcttgaggtgttttttccactgtctttttccatagtctttttctcttttcctaacttactagagaggaaaaggggcagcagggccagaggtattgtcagctacacacaggaaaggaagcaagccttcatgcattcatcatctcgcttaatgatccttggctgcactagtgctagctcagctttgggaatgcccatcgtggaccttgggggagacatctacgaatagcaagtgctgattcagagacatgaacaaagtgacattggagcataaacagagggaaagctaaggaagcctagggagagagagtccagaaaaacctctgagctgtgtctaaaagaatctttccaggaaaagaaaaaagaaagagcacctgcaacagaacaaaaaagctatgcaaacaggctatgggaagtatgcctatgtctaggtgaatgtaaggttggtgttgtagaatgacaggattaagttgcaggaggtagaatcatgctctaaagagctacgtcaaaataagaagtttggactgtattctaaaggcaacaagagccagcagacactttgaacagcaatgctaaatgagctttcattatttaggaatataattggcagtcttacgttggatgagcaggatacttagtcaaaatgcgagctaagaaagaattcgacttgggtggaaagacagcattttcctgttttatttcagtcattagtaaatgtcacagtaatctagcagttgctctaatgaaacgatctgaccaagatatgtaaatgacatacccctgttgctgctctaacagagagtgaacatacatcctgtttcttaaaaagccttcctttatttactcattcaacaaatagttattaagctcccactatgtggcaggtactatgcaaggtttcggcgtgttgtgttaagcactggttgtggcaaaattcatttgaagcaacaagtagcaggatttgttcataaggtcaacgaaagcagaaaaaaaaaagacagaaaataaagcaagtgtcaaagaaagcaagaaaacaaagggtaattcctaagagacaaaaagtgaaaatgaggtttaagtttaagaaagcaagcatctgctttaagtaaccatttcattaaaagtgcactaaattgtggaggttctctctcaggaactgcatactgtgagctgagatttagtataatgggctcccacatgaattcctctcattacttctcttgaaagatcagtaaatctactgaaagggtaatttaggtttagtgttcacaatctattctttttaacttttaatctttcctgtttaggatgttaaaaatatgatgtagatagaatctaaaagagaagaattgggcccaaaatgagacgattttaactcctcaaatggtcttgatattgatagctatgccacaggctgtagagtttttgcttctgatagatggtgatgtaactttggccagtttatagagcactgcacactgttaatttcaagaaccaagtaaaggacaacatagaaaagataatctatatctcgctctcctgaattccttggacatttttgtaattttaattacatctcttctttatctgattaaacttatttttcactgtaattccatggaaacaaacaggtttgaggaattttgtccaggagatatataaataaattatttgggaagacaaaagtctggaaaatgagactatcagttattaattacaggaatgtgattttatgacatttttcaaaaatgtgagcctgaaaaatcacttataatcagtacttttctactaaactgccaccagtatggtttgtgatattaaaaaacaagcaagcaaataaaaaaaaaagccacaaaacaacatcaacaacaaaaggcactatctttcagacagtgctatttccaggaaaaaaaatcaaatcctccctgatttgtgaggcctcaccttagatttacctttagacataggtcctattctgggcctgtagtgtgcacagccattcctgattaactgagtaccccattaaaagacctaagaaatccagagagaaagaagctaaagtgggcccatcttacccacagtggcaaatataaaaaagctcattcatacagtattaaattatattgatttgaaactaaattattgtttattaacatttagagtttgcttttatttccccatttaaaaaaatcaaaggttttaaagttgctttttctgatttgagagaagtaagcacttagtctagtgaagaagagaagatgaattcagttaggatttaaaagtagcaatttatcccaaagaaattagcagtgtaggacatttactggacaaatatcacattccttgaaagaattcttatgacattttaatgcattctcactatgaagcatgtccttgtaaatgactaaaccagaccatgtcttaacaattatttcatgagagaaaacttcaataccctcagaagttcagattataagactaacaggaaggcaaaaagcaaaacacaacagaaattaaataccagaaagaaatgatctaaaacatagtatatagtaattcactgaaataaatatttatgatttgagtgataaaaagttcacaatgactttgcaccctttctatgaaagctaagagaaaaagaaaattcaaaagatatctggaaatttgtctagtttttatgattttcataaaacccattggtctatctcaaaataaaggcaaacaactaaattcttaaataattatcaggatactgactactaagaacaaacacatcactttttaaaggtctgtaatctgggatgcctctctatgactttcattacatattatttcatgtgctcaattactgttagagaaaatttttgagttctttgatgtcatttcaagcagcatgcatcttatcttattccagtcatcgttagattacaaaatggaaactgaagggaatattggagttttgctatgtcattacctgaaaaataaaaacctcctgagttattgtaaatatcaaccagatctttacatgatcacgataaaggaaatccatctttcctgatagagtaaattaaagacaacactaagtaatggaaggtttgtaccagccattttaaagtataggaacatcacctatcccatgaactaaaacatttaaaagatatcctccatggtactcattgatctccctaactgcagtttttcttcaactgtgttctaatcatcttgcccccaacaagaatcaggtatttggagcttcctttgtgttttgtaactgcactgattaacaaagattcaggctgaccctgatccatgatggtagtggttatgggaggaatatgtctttgttaagtaaagacacatggctttgggaccagcactctttcaactgagcactgtctcattctgttgcctacagtgttcttaggaaaagagctattcaataaagtcacgagataatattttgattgctatcttttcacaattcatttcccacaagttgctgttcctttcaatacgattttcttgccacaaaatacacctgtctctgaatagcaaagcaacatttttgctcacggattatttctcctatacttttaaatatatgagtttgtgcatacttaaatatttttaaatatcttagctgctaaatcattatatgcaatattaaatgttcaacccctttattagcaattgttaaaaacaaaacttctatgtgttccttaaaaaagggcatgtttgatttctgaattgttgttagataaactgtaaggccaaaaatgggcccttttactgaatatgcaaagttcccccttaagccaccttgaactaggcagatttgcaacattttaaactggcacttcatccctctttcagcaagcatcctctgcagatttaatgatcaggaacatccttctgatgcatgctgggagatatggctgcagggtacagaccacagcagacagtgtgtcagatgaggcagaacttcttgttaggggtgagtatgctaatagtgcagtctgaagacatgatcaccataaattatcatacaaaggaatttaaatgcatggactttgagcacatcagtactgtgcattttactttcaattttacaatatatgttattttcgcttaaccttttgcctttgaaaaaattacatggaaaactcctccttagtaacagatgaaaaccaccaaactaacttcagagtccaaaacacctttagtagtaagttgtcactaagtgtttaacctaatgccaaggaaataatctaaacagttgagctactaagtcacttggactacagagataaaatttgtgtgtgtgtatatatgttttgcaaatgaaaagctagtggaacccccaggcatttttttcttctactacttctaagttgggcttccaaaaacagaaaaactgcatgtgtaagatggtggcatttgcaattgttaagtgacaaggatttttttaaagtctgaaaatgtcaacatacaacctctctatgcagaaatgacagttaaatggtttccagttatgaaacagtacaccaaattctgcaatcctaggaagctacatcttaagcaaatgactagagcacccatttcctttagcacagtattccacagtatgggaaatagagatcatagcatgcatttccttccttctttccttccttctttcttccctgcctctttctttcctttcctccttccttctttccttttagctttgtttgaagtacaatatttctacattttcaccaatcataagcatacagatgtataacttaatgaacaatgacaaaataaacacaccatataactatcattcaaagtaaaaaccagaacattaccaagatcccaccaagtacctcttcatttttcatcttatacgattatattttgagtagtatgagtattgcatgcttagatcccttgtatggtctgtacagataaaaacattatcatctatagcaagaaactatattttagattaactggtcttttattcatctggactcttacaatttaaatattaaaaatcttgaacagtaaacataaggcatagagtgagcctcatcatctctatgttttagttatatatatcaccgaatgtatatgggttttggtagtgcatccatcattggttcaagtaaaatgttgtttttaaagaagtgtgttattgggtgattggtagtttgttcattttttgtgtgtttctgttcagaaggctacttgatcttttcttcaaatttatatctagcatgtatatctgtgttaccttattataaaacaccaactttttaaagtattcatcctttcaatacattctattccatttagctaaaaatttctctttgtgccttctgaagttacaagactcatggaactgcaaaccctacactcagtcaaattcatagaaatttgctttctcttgctatgatctgttttagattatgtatatttattgtctgcacttgcctagtaatttagaatgaagctcttaaaattggagctttccaaatcaatatcacaatttagagactgataagaaaccaggtatttttactggactatagggggtaaatttaagtggcaaactaacattctgctttgtaagtaaaattaaactcaacagggtttagaatataattcaggttcagctttcatgttctgctcttttagcctttggctttatgcctaggagatgataaaatgcataaattttcggattatacccaatagcaatttcaaacaggttgctattgtctgaatattcatgtaacattcagcccaagctttcacttgaagtgagtttgatcaagtcaccacttttctattatatatttgcattacttttctaaaattagtaaaaatatcttgtcatttcttcctggtgagttttagacagatttaaacactgaactaagagttctggttctcttttaaaaaattttgtaagtttacagctcctggtaattcaacaagctttgatgtttgaatattgctgtttttaatgttggcttgcgaaataaaatttgaaatagttttactctgccagtctcccttctcacactcctccatttgttggtctgtaaactcatggtattctaatagtatatgccacaggaccaaagttgagcattctagatggagcttttctgatgatggctacaattctggcagcagaatacttaaagcacaattattcaaatatgtgtcacagagagatgggaatattaaaaacaatttccccattcatcttttagtagaatactaaaagtagattggctgagcagttcactttgctcaatgtcttcatcacaaggaacgtacttggatggcaaggattatgttcttatgattctatttcagtggaaatttaagggaaaaaatctatgttctctttgatggacgggaacaacttttttattgtcttccttcccatgagagatagtctataaaattattttatacattttaccaaatcctgcaattcttcaaccttgccgctcatgaacactaaattggagcacaggtgtgtagccacatggcctcatcattgcctatttagaatctgagtgtttctgagtagtaatgttccctgatactctccccattcactactttaaggactattttttcctcaactgctcgtttgcactttctcctcattttgcttgtgaatgtcagtgccattattcacctctattccaccatgatcacctttctccaaagattgcttttttcgtaaataattacctgaagcataaagtcacttgctttcccaaatttaatattcagtgaaccagcattatcacagcaccatgcataatctggagaaccataatagaatgaatatgttagaaaaaattattttgctgaaatataaaaggaaattaaagccacacctggacatctgtgcaccattttagtcacttaagtgtgctataacaatagagaaagcatgactaaatactgctatagggaacctttttaaagatgagtagaactcgatcatgctattaaggaaagggaggtagatatgtaagagataatctcactgaggaggatatacaaattgttaagaaccagtattcccagacaatatcagaagtgatcaaacacaaagtaaaagactctggagaaaggaatattagttttttgttattttattttatagaaattaatgttagaagtatgttttctaaagtaattataagggtaggaaactaaagaataatatgtgcttagctaaactagggtaactaggagtgatagcactatctttctattcagaagaagtgataaaaattcactttctcatacaacttctctatttgtattactctgcttcttagtacaaaacagtaggtcaagaaactttgggaatagtcaaagaataatcaataatctctcgagtccttctgaatacacagcctttcctcaaacttgaacaattttcacttcctgaattacaacttacatgatgaatccaaagtgtattaatagttgaatttgaaacgaatgaattaagctcaggatgtcacttgttgggagacatctaactgctttcaaccatccaccttgaaccccaccctatcacttcctattgctaacagatttcaacctgtctttcaattgaacttccttcatctgtccaatcaattcagttccatttattatttccaataattatttatttccttgaatatctaactttactctctcccaactcaaccacttttcactgcaaaagtaaaatcattaaaattttggccgttttgtcaataaaataagtctacaggtatttgcttataatttgctattcatttgttcacccacctattcattcagcacctgctctgtgtcgggcactgaagtcggcactcagagtggagagatgaggaagctgaggtctcagccctcggctggctctacatcctctagtcctccagtgtgagatgcctttggaattagggtgaggtgtaccatggaagttcacctgcgtacattctcagtgtcacagaggaaatagtgagagactaagataaaacataagcagagctgtggggctggatatgtaatctgtgaagaacaatgccaaatggaaacacaggaccccttgttcaaaattattaataatttcaagacagtgacagaaaggcattaatctaagcacagggccccgaacttgcaagttcgcagatcttgaactacacagctcacacaccaaggaagctagcgctaactaattatatattcatctacagaaataaaagcatgttagcaaacagagggggcaaatcacaacaaagtaaggttttttcatctataaaattagaatatcaaagcctacatcagcagtttattagctttttacacacacacacaaaatatttattttaccccatgagtcatatgttgaaagattttgttcgttgtgttgatgtaatcactaatttatgtttctatttgaattccagccaaagccttctatcatcataagatagataatgttaccaaactatataatttaattccagccaacatcaaagctgacttaccttttagctagttgtaaagtattattggtttgtttgtttcaaatggttgaaagtaacctgaagacaccagtttttacctggatagaaactaatttaggaatctttgattaaatatctccaaattctgtccaagtgctaatctttagtgattctcactagcaagagagaaaagtttgacttttctgcctatacccttggaaaagatgcaagtactatcactttcccaaatgcaatgggaaaataaagctcagtgaaaaccttgagcatgtttctaatatattgttagtttatttgagagttaaagcagtattaatgtgctgtatcttcacatctctcactgcactacccttgtgatccaattagattctaaattgatgtaaatgtctatttttagcatatggccacttctgaatgtttccaagctttaaaatgcacaaatactcaacacaaacatctttggagcatagaggttgcgtagttttccttttccaccattgatctaatatgtaagagcctattgtgcttggagagtgcataagccttcacatggttgagtaatgatttgaacgcaagagagtctccagtgaaaaagacaaaatccagtagttatgaaaaacaaagcttgttttgctaatatgctggtatttggagtcaaaaagacaatgacaaatgttttcagtataactttttaatcctagttaatattaatactaaatacatttgcaaataatattttagagaagaataaaatttattcagctaacataattatttttcaatatttttgaaaactataaaacacagctataaaatgtccttcctcttaaagaaaagctaatttcattcacgctatctcttattggaatattctgcactattgtagaaatattagatcactattattgctattattgtatgggattatttaaatagcttataccaatcacttttctatcttagactttctctaattagtgtgattgacacttataaaatttcttttagacactgaaaagcagttgtttcttttctcttatgcttttcatatggttgcttgctaacctgtagaactcttaaactgacaaaaaagtaacatttttttgtcagtcagatgttcagattttctgcaccagctttagtttggctcattgaaataatagttacctgaagtgatctgactggccaaaatgattaaagcagtttgcatgcatgtacatatatatctgcaaatatgaaatgagcaaacagatgaattgtcattgcacacagacaaccaatcaatacaaactaaatctcttgtattttattcccccaaatactgagtgcctgccaaaagccagactcttttaggcactgatatctccgtcaactgactgagacattctcaggtttcttgatgggagtattttgccattttgaaacaaatattctgacttcactcttcaaatttgagaaaagttctaatcaactgagttttatgtaatacacatttggatttataaattgtaagatgaaattgtatttcactatattttgtcccacagacttaacctatgtttcttacacatccatcctaatataaaaatacagtcacttcacatctgtgtaagtttgtggagataaattcttagtgtgtgggcttgtattttaaaatccaatttcattcactatttagtgagtgcttaccacatgccaggacagttctagagtgcgagagggagacacggtgggacaggattggaataaatgctttctgatgctatgggaaggagtttaactcttatgctacaagtgatgcatatccatcaaaggatcacagcaggaaagggacaggataagatgtgtctttaaaaagaccattcaggaaaatgttgagtgttttagaggacactgtgactagtggcttgctaataaagcagatgggacaataacggtaatcttgacaagaaataagaagggtcttataaaaggcaataatagagacaggaaggggtgtgtatatattcaaaagataggaaggaggcaggatctatagaacttgatggcccactggttatgtaaaatgagaacgagaaggcaaagaagattgccaattgcaatgcttgagtggcccatcagagggacaccgtatactctagttagttagactaacagagttccaagttatacttagagtgtcaaagtagttattaatgaggcccctttatcctcaaaattgtcctggtttagaagataaattttgtggtcccctaatagagaatgatcatgcaatcatagtcattcatgatcacgtttatataatcagaaagatgtggagataagtggatttgtagtaaaggaataacatttagggttctccattctattctattctaagcaaatagttgtgtagctgtggagctcaggagagaaacactggccttgacatccagatttgagcattgttcacattttaaagtcgggtgggaattaaattaaagagcctgtgaaggccaggcacagtggctcacacctgtattcccagcattttggaaggcaaggtgggcagatcacttgaggtcaggagatcgagaccagcctggccaacatggggaaaccctgtctttactaaaaatacaaaaattatctgggcatggtggtgcacacctgtagtcccagctcctcagtaggctgaggcagtagaattgcttgaacctgggagggggaggttgcagtgagccgagattgcatcactgcactccagcctggccaacagagtgagactgtctcaaaaaaaacaaaaaacaaaacaaagagtctgtgaagcataggaaggggaaaatgctggaatggaatgctgagaaacattaactttgaagaggaagaggaatttgaaaaggagatgtgaagttgctgtcagagaccaagagctactgtgtgaaaacccaagtaaatataaatcatggggacaaagagacaagagaaatagaggaaggagaaaatggacaacagtgtcaaaaccaagtgaaatacgaaccaattcacatatcagtgaattaagaaacttggaagtaaatgatggccttggcaagggcaagttcagaggaatgatgggtgtaataaccaaattatggtagatggagagatgcaagcaattatgtgtgaaaggtagcgcagaatcttaagaaaatccttggcttttaagtccaacagactgggtcacatacccacaagctcttactagttgtgaaactttgtgtaagtcatttaatgttaaccttgttatcccttcgttcattcagtacttactcatcaaacatttatagagcacatagtatgtggcaggcatcgagctatgatctagctaaacatgaacaactttattttagggaaaaacacatctttttacagcataatgtgagatgtgctgttacccatgtatgagcagcacattttgctctctgaccatcagcttcattactaataataaacatagctaacatttatcaggttcttcctatatgtcgggcactgcactaaaggctccatattataataattatttcactttatttagcatatcacataaaaacaatatgaaaaacgtactatttttagttccattttgaagataaggaagtcatagagaggtttaagaatgtcacttaaacctctctatgttaaaccacaaaatgtttgaatgtcactaacaagtagaagaatagtgagtagactccaggcagaccagcattttaaattactatactgccttccactgtcaattgccagattgtttcaatttcattgatcatgatatcccctagaaccatttagtttctgatacactatagttcctgaaaaataatacatgtttgtggaagggaagaaaaaaaggaaaaagagagaggtagggaaagagtagggtaaaagggaggaagaaagaaaggagtactgtaagaaacaagagaatggcgtgacaaactttgcctaggagtcagagaatttctatcaagatgatatactcaccgcaacttaaggatttgttgtcatttggtagcccaagaaagaatgaagatattctacattagcttgtaaagacagcactttgtcattaccatctatctctaaggataggtctcacattcacaaatcctctaaaagtaactaatctttgaccacatgaccatgagacaatagtattagtaatgactttctatgttacaccttggcctaaatgaccacaaaccttactgaaaagtctgaacttcctctgatggcccatatcttgccatgcatccaaaatagtaaattctactgactacttcctcagaacatcttgtgggacttcttatctaggtgccatgggttttgctagaaaggaagaacttcgttgccattgcttttggtgttttagtcaaaaagtctttgcccatgcccagatgggatctaattaaactaaagagcttctgcaaagcaaaagaaactatcatcagagtgaacagacaacctacagaatgggataaaatttttgcaatctgtccatctgacaaagggctaatatccagaatctacaagaaacttaaacaaatttacaagaaaaaaacaaccccatcaaaaagtgggcaaaggatatggacgcttctcaaaagaagatatttatgcagccaacaaacatgaaaaaaagctcatcgtcactggtcaataaagaaatgcaaatcaaaaccacaatgagataccatctcatgccagttagaatggtggtcattaaaaagtcaggaaacaaaagatgctggagaggatatggagaaacagggacacttttacactgttggtgggagtgtaaattagttcaaccattgtagaagacagtgtggtgattctgcaaggatttagaaccagaaataccgtttgacccagcaatcccatcactgggtatatacccaaaggattataaatcattctactataaagacacatgcacatgtatgtttattgcagcactagtcacaattgcaaagacttggaaccaacccaaatgcccatcgatgatagacttgataaagaaaatgtggcatatatacaccatggaatactatacagccgtaaaaaaagatgagttcatgtctttgcagggacatggatgaagctggaaaccttattctcagctaactaacacaagaacagaaaaccaaacaccacatgttctcactcataagtgggaattgaacaatgagaacacatggacacagggaggggaacattcacacatcagggcctgccagcagggtgggggtggttgggggctaggggagggatagcattaggaaaaatacctaatgtagatgacaggttgacgggtgcagcaaaccaccatggcatgtgtatacctatgtaacaaacctacacattctgcacatgtatcccagaatttaaaaaaaaaaaaaaaaaaaaaaaaagaagaagaaggacttctaaataaaatgccaccaggaaaactgagcaccgatagacttctttctgcataatctcttctcattctctcatttttaaattttttgcaattgccccaattctggggcaaaaccaaaactcccacatgcctgaaaatgtgcctgaccattcccattgctaaaattctttaactctttgatatttgttgtttttgcctacttatctgtaaattataccaagtgtcatgaaaacaaaacaaaatggcctttaatgttaaaaaagatggtcttaaactcacaaatattaagcaaaatattggaagtacattgtatctgttcatttgtttgaattgtttggaaaaatcatcccatttatttatatattttgtacagacacatctaaaatcagacttttttttctgaacgcattctgtttcctgtgactgtcacctagactgctttggcgtgccttttgaatactgagtagtaatttactgtcatgtgatgtaggagatcagtcagagtgatggagaaactatagggaaaggagcaggccttctgaaaggttggaaggctctgcatagcttcagggagaatagctgaaggcagctgttctctgaccctgaggcagagggcgaggagtatgctgagggaggaggaggcggtaaggtagatgatggttcttcctcccctccctttttaggctcttccgtgtagagcagggccaaagcagccctaactaaggcccataatgttaaagatattactgggacccattgcccttgtacattatgtcttttaagatttcttcccacttgttcccagagctctaggtctagtgtgccttcttctgggaaccatgggttatggaaaaacaacagtttgcattaggtcgcttaattgggcttcagagaccaaggctctgctagctttaagcagctgtttcaatacttttatatactgttgtcccatgatgaatgccctcgaacttggaaatccccagtgggtaccaattacttactgcccactcacttcactttcgttttttgagggttccgtcacaatccattgcagcattcctcacatggggcaccacctgccaggtctgtcccacagaccctggcctacgaatgaaatgagtactcagacacaggtatgcagtgtaagagcagctaggtgattgcctgactctagtggccagagaggagccctgagaagctggagctgcttgcttttattcagtgcaggcacaatgccaaaaacctggagtccatataacctgtaggtaattaacatttatttttccctgttcagggaacatcacgtgcacggatgatcaaaggtcaattcctagtcaacataaataaacaaggctgtttaagataaattcccccacactcccttgtacctactccttctttaagcactcactcattggggcagcgttaagtccagtcctgcactcccagagctggctgctctgagagagaggactgtgggccttccatctgaccgaggaaagccgctggcattgccccagtttggaacaggacatggaggctggcccctcatgaagtttcccgcctgactgcttaggggattgccatttttatcaaattttgacttgcagagatttgcccaatgtttcccctttttacattgggggcatataaaagggggttcttttcctgagtgactttggtctttactattggggcattcctgcttcacatgacctggctctcagcatagaaaacaatttgggtttttctcccatttcactttaggaggctttaatgccacagccaatatctggctttgtgtgtttcagtctccactagctgacatgctcctataagttccccgactgtagctgcctttcctctgattgcctgcattgccttcagctattctcccccgaagctatgcagagccttctggcctttcagaaggcctgctcctttccctatagtttctctcacctctctcactgatctcctacaattgtaaagcctggaatgtacagccttttagggaatatacacttcatatggcctgtttttgacaacccaaatgtggtcaccaagaaagaactccgctgggcgcggtggctcacgcctgtaatcccagcactttgggaggccaaggcgggtggatcacgaggtcagaagatggagacaatcctggctaacacagtgaaaccccgtctctactaaaaatacaaaaaattagccaggtgtggtggtgggcgcctctagtcccagctactggggaggctgaggcaggagaatggcgtgaacccgggaggcagagcttgcagtgagccgagatcacagcactgcactccagcctgggcgacagagcaagactccgtctcaaaaaaaaaaaaaaaaaaaagaaaagaaagaattcaagttccaagtagaagttactctgaaaggcaacccactgactgactggtcacatctcctaagaagacaaaagtaaaattggtaagttcactctagtctctattccccaatcgtactttatttcagtctgtgttccaaaatactaaattcttaattattttcttgatttggtgtaacactacatacgatgtagtctggtcccagaatgcttcttcactgaacaatacaaaatccatgcagattgaacagaggaaggactagcgttaattggaagaaacttttgctgacttttactgcagattgaattttgtcctcccaaacacctggcaaaggtaatgtctccgtttcactaagtactccttaatttggaattacaaagacgattagctctctaatgagttacagcaagtgaggtgaaagagtaggggaaaaaaactgaacaccagatgattctttttaatgccaagaaaaaaaaggctttttcttggttaaaaatcttttaaataaatttctctcctctttcattttacaaaactaaaatatataaatattattgcttagtatgtatgggaaaaatctgatttcatagaacattacatgtaaagattggctgtcatgagtacataggtctctactctgtattattgattgagtatatcagtaaatttacctttagaaacttatgaatctgctggggtacctaacaaattaggaagatgggaaaaatagttcctagctttagaaaaaacagttcattatgaaagaaacctctacaagattcaaaatgggtaggcattgtaaagatgagatataaagggtaattctcaggttatttatgggagtggaaaagtaaaggtgcataaattcaaggtgagcaaaaagtagtggagaaaaggtctgcttgtatctttgctgcaaatgtagaatcaaggtctttggattaccagaacatttagcactgggtttagtctattgctgatacttacttagtaaatattagttgaatttcagtagtttaattaaaaaatgactcaaaatttttaaaatgcctgataatctgtttacccaaccaatcagtatagcattagaaaaataacccaggatgggattttattctcactctggcactaactaaataatcaggcaagtcatcctacctcttttggacttaatctcctcacttgtcaaaaaaaaaaaaaaaaaaaaaaggagaaagaagaaggagaaggcgaaagagaagagggaaaaggaggagaagcagaagcagcagcagcaggaggaggagaagggggaagaggaggagggggtagaagaggaggaggaggagggggaagaagaggaggaggaagaaagaggagaggaaaaagaagaagaagaagaggggaaaataatatttaattttctggtttacataaaagaatgaaatgaggttacaaacagtaaattggtttttggtaactggtagatattgttgatattctcaaatctaggaagaatttccatgtcccttatctttaagattaaatagctgaaccattgttctttatggtattcataggagggaaatagtctatatttctccaataggtgatctaagctcattatctattgacagaaatatccaataatattctgattgttgtgtccatcttatttaattacaatttgataatacattctaatggtgatagagtacattttgactacctctccttcctcaggcatttgaatactgaacatgtctcagattggcacgttgataggcttggcataattgggttctctgtcagtttgctgtcattaggatgagctgtgaatcaccattagggccatctcagtatattcagttaactgagctgatgaaatcttgcattcgtttcctgaagttggttgcacatattaacatctatttatattattaaatattccattgtgttgacatccatccttgagcaaaattgtaatggatatcttagtttacagaaggacttttcatgtgtgaagtaaacactgaagagcttcaagtgtagttaaacaaaatcaccaagaagatataattgagtaaaaagaaagttaaatatataaattatatttcattctagataatatgtgtagaccacgtcatatttagaggtcatagttcaagggtactgctttcatatcagtgataatcatcactatatgcctatgtaatagtcatcaggtttatatcacataaaataagaaataaatatttattataaaatggagctaaatcacagtattcaatatttataaaatgtaaatatgcattctgttaatgtttacataggactttgccataccttcagttgacagtaaagcaatgcaaaaattataataaagagtagaaagcctttcaaaacaccaccaatgacactaaaagatttgaaaataattgcaaagtagaataatcaaataaaatagtcagattttttaaacaataaaaccgaatagtgtgaatgactttcaagttattctagaattgtctttaactgtaaaacattctaggacaaacatacaaaatctcaagaaaaggaaatattttgcaagttacatagggtaattatactgaagtgtcagcattctcatttgtcagcactctgatttggttaatttaaatgttcattaatcacaaaaaaagaatggcataaaacaagcctgcttgaattatatgttttgctcaagaggttattgattcatataattatttctttcatactaactcaagaaatagaactgttattagtaaacttcatttgaaatacttaatcactgttgcaaagatgttttatcacctgatctgtatgaatcagtaaatcaaagctcacatatttgtttcaaaacttcagctcacagatgttaagtcaagataataagcagcatcaatcatacctcactgaacaagatagtctgcattacagacactctccctgtaatccatccattatatggaacatctgttacaaattatcaacaccccgccccacaccccccgacccccgccagggactgctctatttaagtgcttctgcaataacccactgtctccatttctccaaatgagttagatggtggcatcgggatagtaccaagttcactgtcaccgtatgacagcagtcatctttcagtctgtgctgaactccaatggcacactgcataatggtaaatgttcttcctacagttgtatagcagaaatcctcagagcataagctagtagccatcaggaaaccactgacagttctttctccactatatatcagtcattgcctaagttaagcacttagtgtgtaatattcattgtttttcaagtccttaggagaatattgatttgctcatttagttaaatataaaattaatgagcccagatacatgtttgtcaactttggcttatttccatgatcatgaaacatgtcttgtagaacatgttggtttccagaaaaatcatgagaatctaaataaataaagcaagtacaaatttatactgcagaagaagaatattttttaaagtgccctagagtttacccatatattgtcaaggttgcacctgtcttaaagagaatgactttataaatgtgttgtcctagtgtgtcattggaaataacaatttcaaatttactctgtgataggtttgtgaaaataagttacaaggatatctattaatcattaataagtgaatagtgagactgaacaaatgtaaaagtccatatagccacactttattttcttgatgttagtctgcattgcagaattctaatgacacatacacagtaaacccaatattggatttatagaaaactttgtacaaacatggtactttccatattttagcacctcatatggtattttcctacaggatttcattagctcatctgttcttagtgtttatgcaatagtagtttaataaataaatttcaggatagcatctaggttgcgtgaagttttaaataaacaagttacctatttgtaattattcgtaccagtttgtaaaaatacatcctaaaatatctgttttccatttcaggatcaccttcgatggatggacagcattacttttatagtggactatataaagtgtctacaagtgtctacaacttcaactcatgtaaaactacattaaatatttatgcctactttactgcctggaaatcttgattaatttacctttcacctgaagtttgtgataactgaccaggaagtgtttgtttttataaaaaggaaaaaacattattaaataaacttttaaacatagtgctctagggagtcttacgttggcaattaaaagcttcagccaaaaatgacacaagtccttttggctcacaactcactagtctgaacctattacagagctacatacaaaatgaaggcatcagagttcaagtcttcaaacgacaatcacatattcacaaattatacttatcaggatcaatgtcattaaatttctttgtataaggcttgtgtggggaaaggatggtttaatttttgcttttgcttacaatgcaaatggaaaaataatcatgctctaagtaagaccgcaagagaccagcatgcaaaggatcctcagaaactatcactgtcattgaaaccatgctgacagaatctactgaaaaagtaactgcctgaagcatcacaatttacatttgttacaaaaccttactgctaagaaaaaatactcatatgtttttaatgatttagattttccccaaaacagtcctacagcctttgagagctttcatcaaatgtttgccttatcgtttcaatggcttctttctttggacttctctcatatgctatccagtggcttctgattcacactcaaaataaaatccaagttccttgctattgccttctaatccctgtataaactggcacttgctaatctttctgacattatcacctccactctcctcttgctttgctatgctccaattgccatactcattaacacttacaaattttgccattgctgttctctgcctggaaaactcttgcccatattgtttatgtggctggctggctccttcttatttatttctcaactccctatcaaatgttgcctacctcttccccatccaattttcaccacttttttttcttcattgcgtttgttactatctgaaattatctttcacttgtttattgactttcttctctttaaaagtcataagcagtcaccttccctatcttgtttactaccttaacctgagaaaagtggtttaattggctcacagttccacaggctgtacaggaagtatggctgaggaggcctcaggaaacttacaatcatggtggaatgcaaaagggaagcaggcacatcttacatggccagagcaggagtaagagagtgatggcggtgctgctacacacttgtaaacaaccagatctcaggagaactcaccaccacgacagcaccaagggggatggtgttaaaccatgagaaattgcctgcatgatccagtcacctcctaccagaccctacgtccaacaatagggattacaatttgacatgagatttgggtgaggacacagatctaaaccagattaactatacaaatgaatgaatatgtaaccccttttccccaaagagactaattacatttttaaaaatcagacaaaggaggaaacatggaaagaacatggagcagtcattgaataaacaataatcataggcatttaatattaaatgtattgtcatgtctgataacttgtcaataagacagaccagcagataccgcgaaataaaagggtaagatacctgagaatggtgtggtaggagagggtttttaggaattccctttgaagcttggcacttccacctctgtaatccttcagaattttctcacgctgcatcctactttccacctcaccctgttctttgtagtgtgcacgtgcgtgtgcacacacagacacacacatatacactcactcccacaagaaacatgatccaaatattaaaaattaaatgcagatagcaaagaacgattcagatgctgaattctggctacagggagtgtatagcaaagaaattagaaaatctaaaccaaaggcttcagtgttcactgacattttatgtgcaagaggggagttgctatactatcagttgatacatcaaccagctgaagaccttaaaatcttgcccaatttgcagctacagtggccctaacttgtggcctagaagccctgccatgtataccttgatctccaccttgggacaggaaacctctgacaacagcttctttaatctacttcatcaggtgctgcttctcatttatggagccttgccctgagtgtcacatagattccatttaatttgtgtggtcaccagctacacctaattaaattcctacctgaaactgctgacttccatgatacctctcatgccaacttttaaactcaattacttctgtttctgcacatgagcaaaccataaggcataaagaatcaaatgaaacagcactgactcagcaccaataaaattgtgtttttcacttcatatagattttgatttctgttcatcaatatctcagttcatgactgattccccatcatgtagtcatcacaatgattcctgaccttttgaaccctcttcagtctccaaattagcatcttctcacccctgtacttcagtatgatcagaatgtatttcaataaaaattaattttattaaattgaaaataaaacttctgagatcctcctccagactctccctttattctgccaatattcttccaatttatccaagtatgaaattttggaataatgtttcattctcattatttacttttcctttattaagcctaatgtctcagtccacctccagttcaaaaaaaaatgtactggtttccactatctacataattaagtaccaactcattgctgtggtgtttaaggtcttcccttaaccaactttcctacacctttatggactcttggttctctgatcaaacttaagccatcagcttctcctctcttcaaaatgccttagatttttcagtcttttggaatatttgtttacttattccctttttctaccaacaaaatagtcatctttttcctctttaactgctagcccagagcaactgttttcttggaatcctcactgaaaaactcatccctccagcctcaatatctaacaaactttttgagtccaagagatatggagtgaattcctaagtcacttagctggaaaatggcaaggcctgaatgaaaacctatgtttcatggtagctactcagccttcatctttcaaaaccttcaagtttaactttttatttctatcttcacatgatagttcctacaatccttttaggccttttttaaaatgaaggtagcagtggggagcacacaaaatattcagtcatgatttgtgaaatggggatgtttttgctctaaaattctttttctggtttccaatactttgttgaactttgtggtcataggaatatattgctataataggatatctgtaatatgtcccaagtgtctatctaaaagtgataatttcattatcctattggaaaattttcaatcatttaagaaattttactgcatattttgtttacctatctggctgtttgtttcggctagcttttctgtcagttttcccagttgatttgtcacttttaaattctaatggatttatctggaataattagataattggagatctttctttcaggttacttatgctaatataaccagtcttagcaaatataagaaattaccacttttaatcctttatcaactaaaggatttctcagttatcctttatatcttagaatgtgtccacttgtagataatataaagcctaactcaaattgacttaaacaataaagaaatccactgattttcatgacaggaagttaagcaggtgtttgattaatctagtggctcaactttttatgcaagggcccacaggtttgttttgtctctccactccatcatctacaattttggccctacactaaggctggtttccactgtaatcacagattgacttccaggaataacagaggctaaatctttcttgttcacatacaacaggagaaggagctagtgtatttctcccaaacttcatacaaacttgcatcgaaccatctggttataccattttagagaatgtgcttactcctgaacaagtctctgtcacaagaagattgccgtgatctgattggcttaggcctagcttcctgaaccaatccttagcaggggcacatgagattggcaggactgatataggctaatcaaggccattcatataatgaggaggaggcagaggggttaagtccttataccacactgagacaagtagagtgaatattagggagtcaaccacaaagtctactttatctttagcaagcagaggtagaaaagctacctcgaaattcattttcaatcaataaaaatattatttgcccctgctcataatttttaatcttctgaaatctacatgtcctgtctgtgctgaactatgtaaagcagttttatgtagtaatgaaaatcatggagttaaagctcatattcatatgcaaataagaatcagaataaaaccccggagccacttaaggaatgttgtttgacattaccttaggtgagttatctgaactttctgaggctttgcttttcatttttggaaaaggggtatcagtaccaaattaactataaaaattagaaaatatataacacttagcacaatgccttctacttgatagatgagcattaagtcattattatttcagtattttcccccattccattataagctccccagatggtagagattattgaatattccaatgatagtacattttttcatttttgaatgtttcacatattttctattttgctaaaatcaaatgtgatacatgcgttcttgttttcattgatttaaaaaaagggagcagtttgagattgatattgtcaaagttacagactagtgagaggcccagtcagtgctaaaatagtatttgtcatttagaaagtactttgtacatacatcaccctatgtatttttcacaataatgatataaggttgacattatcattctctttataaaatgcaaggaaactgagacttaatgaggttcagaaattttcttaaaccttttgcatgaaatagtactgaaataaaattattctgactctttgtccaaatctcttttctttagatcattttttcttgaaatatagagtacataaacattttctaggcatcttgtacaaaatacaaatcctggggctctagtcatagaagttgaaattcagtagctcttgggtacagctcataaaatttacattctttttttaaaacataccagaaattctgttgctcatcacagtttgaaagttactaagagtctattcatttttgtttaggaaaacagcatagaaaggtggatatctaattagtaacatttaacaaatttgagaaagcagcataatataatcctatttttaacataaatttagagtcttctttcagaataatgctgtaattttgtaaagatgtattactttttctcagattttgattggccaaaagtaaaaacatgtataaaaattaagtcaacgactacactaatctgttaagctaataaaaattattaattcaatgacttattataaatctatttcataacatactacgtgccatgcactgtcccctaggacctgagaatacaatagtgagaaaaaaatacaagcacaattctagccttcttgtacctaaaatctaaagaggaaagccaccactagtaaaacagtcacacaaataaatagaaagttttcactgtgatttcaactactgtatgaatgagagggacatggtactatgaatgtatgcaatacaggaattttacttaggcaaggcagtcagagaagtctgctccaagtgaaccctgagcatagattcaaaatgtgaagcctaaataggtgttaaataggcaaagtaaggagggacaggagtttcatgccgaggaatcaggttatgtaggtgatagattagatacaggaatgggcagaaggatagataatgatgatggtaacagatgaatagacagataataaaagttgagctcgatcaaattaattgaaagcaaaattgcttttggaaaaaaaggaaagtataactgtttgtttctcatttccattcttgactacccctggtataaagggttggttactctcatgagactgaaaacagtaggaagaggtcacttagattagattagtaaatagcaaacaaatgtaagaaagccctctaggcttcatgagtaacgtaatggtggtcagaaagtatctgaggagaaggtaaagaaggaatgacccaatcccacgtgaagttgaactctgccagcccgggatgtcaagagtatatcaggagacatcatcttgtataaaaataaatattctatcaataataccatacttcctaaataagggtataccataattcttcataactttattataaaggtgaatacatcagctttgcaggtattaatagctaatgtactatgaaaagtctagtcacattattaaatattattttttattgaaatattttttcatgactatttctacatatccttttccattgagtcaacacaaactggtcctttgtactggatggttcattgtagatgagtaaaccgcatgataaaaataagaattagtcaccatggcctgagtttttcaatttatctctctgcattaatctaatcttccagacagtagctaaacctccttttcacttggtattaggatgtgtttaggacattgcttccatgattgattgccatgcctgcttcccttttctccagagcatattcctgcatgtgtttggaagtgtctgtcctcaaacagtatttatagggttaaaaataaaacaactggataacgagcatatttgggatcaaaattctcactttaattttaaatgatttaaaacaaagacctgtttaatgttttgaataccagcaaatttcacttttcatttaaaactactatatagcagaaacaacaggggtcaggtagggtggctcgtgcctgtaatcccagcactttgagaggccaagtttgggactgcttgaggccaggagtttgagaccacactggttaacatagagagaccccatctctataaaaaaattaaaaaattagctgggcatggtggcatgcgcctgtgtctctagctactcaggtggctgaggcaggaggatcgcttgagtccaggaggtcaaagcaagagtgagctaggatcatgccactgcactccaacctgggcaacagaatgagaccatgtctctaaaaaaagaaaaagaaaaacaaaaaagcaggaaagtccttaaaatcaaataaaaatgaaaacaaacaatagacgtataaagcaaacagtaatgtataacaataggtgtatttgttgaatcagcaagtctcagaatttcacagaaaatatgatgttatctatgtgagaaaaagccagaaaagttgcttggcacggagaattcatcttagcattgtgcagaggctctaagaagcactcctcatgaaggactgaacaatcacaccataaggactctacagcctggcaccactagttgctgtctacaaggagaatgagcaataatttcacaagaagtcaatacacaactttctgtttgttagcacatgaatttatcataattggacaaatttgacccgttatcaagactaaagcctgttcttgcttcaatgattttaccttcaaagcaagaagactctttttgcctctgtttctgagggaggaattttccactttcaagtactacttcctcatctgaaaaataatatggtcaaactagatgactccaattaatttaaaaattctatgactctgtaacactgctaaattagtatatgaaattgtaggtctttatttcatattaccagtattatagtaagagctttaaagattccaaggagatatatatatatgtacacatatacattttattcacttttcagctttaaaagacaattgcttctcgaaggaagattttctaactgaacattaaatcaacagaaagagttgatctggtatcagtctgcaatgctggggaaccctttattgaggctagattgaatccatgagaacatggcttctgctcagggcttttgatttgtcatttgctcagcagtcctccccatgaagaaatgaacacactgtgcccatttttcaaaattgactatttccaaatacagtatttaatttagtgatcctttataatagcattgtccctgaggaggaaaaaacagttgtcagattactggccatttgacactgaatcattataaccaagtataaaatttaatgagatttctactgaatgagtggcatttgtgtatcatctggactgtcacacatttgtcatcactgagacgtttgcttattaatctatcttcaatgatgccttatgtaaattagctgaaaaagccttttaggagaacctttcctccctgatttattttaaaaagtcaaaaaatagcaaaagtagaatcattaacaggccttaaaaaacaaagatactgactatatcaataggttgatgtaattcactcctaaatatatacaagaagcttatgccaggcagcattcagtatatgatgtataaaaatattttttcagaaataaagtatcgataagccaattctaatattataacagtaaatcttgttttcacctttttatggttaaaatttaatgtctcttagaaggtaaatcacgctgccaattattcagaatatctgtacgttaatatgttcataaaagtatttcagatttaccatcatttagaaaagttagctgtccagaggctataacgctctcagtttctaataaggatcatccttattattaaatcatatgaaaggattattttcttcattcatggagcttgtctgtcatttttattaccactctaaacttggatgaaaaaaaaccctgttaacccaaatatagtttgatttaacaaaaatgaaacttaaatcgcatctccgtctaatataattatattttaaaacattcttttacttgttaattgttatacaacattccacactcaaaatataactcctctatcctttcttcctttatttatttttccttctttttttccctttcttcatctttccttctacaaatatttattgagggtctaattgtatgtcaagtaccatgttggacgttcagataagtggaagttacagaaaaataaataggcagtttaatggctgcctaatatttcattataagaatttagaatttaaacattacgtgattattgggcaatttgttgtttacaatggtttataattataaataattacacagccacaatcagtaccttggttatataaatctttgtccctctcactaattattttctaagaaccatatttgggcaaatagacaaatatcaaaaagaataaagaggatttattatgttgtaaattatatcttttgttccagctgaaagtttaaaaattatttaattattacctattatgaaagcaatatacccttctttaagatggctaatttaaacattttcatagaactttaatactcagagaggcaaattattttatttaaattaacaaagagttgtcttccacagtgtctcccactgagccttgcacataggcggttgttaaatgctctttgaagagatgaataaatagaatggagggaatgaaacagaataaatgtaacaacatagaagagcttaataaatgagtttgttggcaattattcctatatggacacgttagctaaatttcaagtctttttcataatatttgagggtcctcctgacagagtttcatactgatgaaaacactctttaggcaagttccagttagccattgctgccccaaaacttattagcttaaaacatcaatctgttattttctgtcatgattttagcagctgacaggccaggcaattcttgctcgattttctcatgtagatgctggctgaagctggagtcatctgaaagcttcttttgtttatttttttaattcacaaataataattgtatgtatcccaggatgtacatagtgatgctttggtacatatactgtacagtgatcagatcaaggtaattagcatattcatcatcttaaacatttatcttttctttgtgttgggaacattcaatatcctcattcttgctatttaaaactatggatattgttaactatagtcatcctacagtggtctatagccctagaacttattccttctgtctagctgtacttttgtatcctttaacaaatctctccctatgctattctccccctttcccttcccagcttctaatgtcctctgtcctttctacttctatgagatccttttttttagctttcacatataagtgagaacatgtggtgtttaactttctcttcctggcttatttcacttaacataatgtcctccatttccatccatgttgccacaaatgacagaattacattctttttatggctgaatagtattccatggtgtatatatatcacattttctttatccattcatctgttgttggactcctaggttgattccatatcttggctattgtgaataatgctgcaataaacataagggtaaagaagtctctgatatactgacttccttttctttggatacatgcataatagtggaattgcgggatcacatggcagttctctttgtagttttttgaggatcctctgtactgttctccatagtggctatactagtttacgttcccaccaatagtgtgtaagacttcctttttctccacattctcaccaacaatcgttatttttgtcctgctgatgatagccgtcctaactggggtgagatgatacctcatggtggttttgatttgcatttccctgattatcagtgatgctgaccatttctttcatatatttgtggtcatttgtgtgtcttcttttgataaatgtcttttcagatgtgactgttttttaatagcgttgtttgtctatttgctgttgaaatgtttgagttcctcatatatgctgcacattaatcccctttcacgtgaatagtctgcaaatattttcttccattctgcgagttgtcctttcattctgttgattatttcttttgctgtgaggagctttttagtttggtataatcctatttgtttatttttgcttttgttgcctgtgcttttgagatcttattcataaaatcttttccaaaaccaaggtcctgaagcacttcctctatatttttttctagtagttttattgtttctggtcttatagttagctctttgatacattttgaattgatttttgtatgaggtgaggggtgagaagtctagtttcattcatctgcatgtgaacatccaatttttccagaaccatttattgaaaagactgttctttccctaatgaggtctgatctgaaggcctcttcactgacatgtctggtgcctggacttggatggctagaatagctggatgcaagttggatctctctctccacagacctctctaaatagctaatttggacttcttcacagaatggcaatttccatgtaattggactgacaactgtcttttcctataaaaagcattccaggaaacctgtggtaaagatgcaaagcttaacctcaactcaaaattcacacacagtcatttctaccattgtctactgagtcaaacagtcacaggccagctcagatttaaggaggtgaaaaaattgactccaccgttcaatggcagaatggcttgcatgttcagggagtaaaggaagtgatagtggccaccttacacacaggcagacacaaagtgattaatgctttcttcaaatgccatctctatctctacaacataaagtgtggctgtatgtgttccctaacacatactttttctctttctttcttcagttgaagatactttctaaattaacagtgaaaacagtaaaggtctctgtactccttgcttccttccacaaattaggatttacaatcacatccaaatttaaatctcagctgtgctgttccctagcagagtgatttgagcaaataacttctcattagaatgaactctctgatacccagtgcctaccataaaacttaacatataataaggttattgactaaataatttattattatttattaactaagtaatctctttgagattctattacctcctctatgaaatggggataacaatgcccacctcccagtgacgaagaagtaaatgaacaatttaatgtttgcaaacacttagtaagcaccttaatacagtacaatacagtgagattatcacagctattagtattattatagttaatattcttctcactattaaatcattataatgtattgtagatgctcctctacattcctgtcaccacagtctaaaaacttgttagacatcttcttcaacacctggatctcatttattttctttaccttatccttagtcgctattttagtggcttcaacattgatattgggtgatgcaatagacatattttttcataaatcctagaccttataaaccctgtaataatattctcaactttgctttagataaacaaaaaccaacttcttactcaaaaccaccctacctctaaaatcacaaatctgtcaattttctcttgcaacacaattcctactcttatattttcctcccataacaatccagtctccttgactccttttttttattctagtctgtcagccccattctggcttcctctgacttgactccatggttacccacagcattgtcatatttgatgataaacaatatcagaattacaaactcccaagcctgaatggaccctactgactgctttcctggtcttggtcctgactttcctatctttactgaattggtcagtttcacttcaaaatgataccgtctaaccaaatttgaactctagtactattctagaatatttgtattttctcttcattgcaccctttcacttttatcatgtgctattccaaaactttcctgttatatcctccagcccccaatctaatttcccgcaatcaccctaactcttgtagacagtattatattcttaagtttaaaaaatgagtaccttccaaaatgagttctctcaacgtttccccttaccatctcgaaaactttaattattttgcttccttcatttatcttagaggaaaaaattgtcatttcttctcaaggttgccctctagacctttgcccacgattccaactttcggtcaccttcctgatagaatagtctctatcttctatatctttagtctcttgcatctgctggtggttcttctcaggtaacaacgacaacaaaaaaagttcgttccttattttctaaaaatgtcatttgccccaatgaggcttttaaactttttctccatcttactgaagctgtattgttgatactctctattcaaaggtcttcaccaactcctccatctgttcagcatgcaaccatttcttagggtttagctcatgtctcttaatcaacaaatccagagagcatttgtacataaagaccaactcagaaaatacttaaaatacttaagtttttgaaattcaaaataaaacattattgtgactttaattgtccatactatggaatggaagaactggcattgctttgtagccactaaaatataaatacctgtgcatttttaaaatactattcaaaatcaccactagaaataaaaacacaatggcacatttctcctcaaatctggttataattcgttcttaaagatgaagtccatatgcacacagattagtcaataatattctataccattctttcataatcaaaagggaattaatcctcctttattcactacctccccactcctaccaaggaaaaaaggaagctaatcatagatcacagtctcctttgaactccctacagaactttatgtatgtctcaggtctggcatatgtccttaccttgtctatactatcattatttcagaaccttttgcacctcccctgttagagtctaagctatgtgtacttgatagtacacatcatagggcttgtacattgtatgttctctgaacatgaacattagctctagccacttgtagtattttagtaaggatgagattttttttttgtctctgtagcactgcctatcattttctgttgctgcctctgtaaactgattgatttcagcagctgcatttgatactggcattcacatctttgtgtttgtttctcattattttttctttttctataaaatataatgctaattggtaactgcctctgggcacaaagtagcagaaagaaatcaaatctacaattaagtttcccccagaaatcctagactccaacttgcatccatgactttttgttgtcaattttaattactaaattcatatttcattaaggtgattacatagttggatgtgctacatattggaaatataatttctcatggctcctgataataatttgtgcttaactttatccattgcctttgacctataggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacaggtaagaggcactaaagcaacatcagatataaccagagtggccttctatctcataagctatatttggctaaggtcttactatgatttttttggattctgaaatctctttgttatttcttacaatattgacaattctttgcttctttttatgaacctgagaagagcaaggtaccttgctttcctcttttcagttcccaaagaggaactatatcatgttggcttatttgtttgttgaaataaccttaaactcacatataagttgcaaaaatagtacagagttcctgtggacccactccccagcttcctgccatgataaaatcttacataaccatagtacaattaccaaatcaggagatgatgttggtgaattgatgttaactaagattcagaccttattaggatctcactagttttgatatgcaattgttttagtgtgtacttatatgagattctatgaaattttattatgtagactcaagtaaccatcaagacaatcaggatatagatcagtttcattagctcagttccttttgctactcctttctagtcatacatctcttttatttataaaaagaaaatctattcagctggcaagatggctgaataggaatagctctggtctgcagttcccaatgagatcaacgcagaaggtgggtgatttctgcatttccaattgaggtactaagctcatctcattgggactggttagacagtgggtgcagcccatggagggcaagctgaagcagcatggggcattgcctcacccaggaagcatagggggtcggagaattccctcccctagccaagggaagctgtgagagactgtgtcatgaggaacagtgcacaccagcccagatactacacttttctcagagtcttcacaacccacagaccaggagattccctcaggtgcctatggcaccagggccctgggtttcaagcagaaaactgggaagccatttgggcagacatccagctagctgcaggagtgttttttcataccctagctgtgcctggaatgccagtgagacagaaccattcactcccctagaaagggggctgaagccagagagccaagtggtctagctcagcagatcccacccccatggagcccagcaagctataagattcacgaaattctcaacagtctgaagttgacctgggatgcttgagcttggtcaggggaggggtgtccaccattactgaggattgagtcggtggtttacccttatagtgtaaacaaagccacctggaagtctgcaatgggcagagcccaccgcagctcagcaaagctgctgtagccagactgcctctctagattcttcctctctgggcagggcatctctgaaagaaagacaacagccccagtcaggagcttatagataaaactcccatctccctgggacagagcaccagggggaaggggcagctgtgggcacagcttcatcagacttaaacgttcccgcctgccagctctgaagagagcagcagatctcccagcgcagcgctcaagccctgctaagggacagactgcctcctcaagtgggtccctgacccccatgcctcctgactgggacacaactcccagcagggagttgtcaccgacacctcataaaggagagctctggctggcatctggtgggtgcacctatgggactaagcttcaaggaggaaacaggcagcaatctttgctgtcctgcaccctctgctggtgatacccaggcaaaatgggtctgaagtggacctccagcaaactccagcagacctgcagcagagggacctgactattagaaggaaaactaacaaacagaaaggaatagcatcaacattaacaaaaagaatgtccacacagaaaccccatccaaaggtcaccaacatcgaagaccaaagatagataaatccacaaagatgaggaaaaaacagcacaaaaaggctgaaaattccaaaaaccagaacacctcttctcctccaaaggatcacaactcctcgccagcaagggaacaaaactggacggagaatgaatatgatgaattgacagaagcaggcatcagaaggtgggtaataactcctccaagctaaaggagcatgttctaacccaatgcaaggaagctaagaaccttgaaaaaaggttagatgaattactaactaaaataaccagtttagagaagaacataaatgacctgatggaactgaaaaacacagcacgaggactttgtgaagcatacagaagtatcaatagccaaatcaatcaagctgaagaaaggatatcagaaattgaagatcaacttaatgaaataaagtgtgaagacaagattagagaaaaaagaatgaaaaggaacaaacaaagcctccagcaaatatggcactatgtgaaaagaccaaatatacgtttgactggtgtacctgaaagtgacagggagatgggaaccaagttgtaaaacactcttagggatattatccaggagaacttccccaacctaggaagacaggccaacattcaaattcaggaaatagagagaacaccacaaagatactcctcaagaagagaaaccccaagacacataatcatcagattcaccaaggttgaaatgaaggaaaaaatgttatgggcagccagagagaaatgtcaggttacccacaaagggaagcccatcagactaacagtggatctctcagcagaaactctacaagccagaagagagtgggggccaacattcaacattcaacattcttaaagacaagaattttcaacccagaatttcatatccagccaaactaagctttataagcaaaggagaagtaaaatcctttacagataagcaaatgctgagagatgttgtcaccaccaggcctgccttacaagagatcctgaaggaagcactcaatatggaaaggaaaaaacccatacagcctctgcaaaaacataccaaattgtaaagaccatcaacactatgaagaagctgcatcaactgacaggcaaaataaccagctagcatcataataacaggatcaaatttacacataacaatattaaccttaaatataaatgggctaaatgccccagttaaaagacacagactggcaaattggataaagagtcaagacccatcagtgtgctgtattcaggagacccatctcacttgcaaagtcacacataggctcaaaataaagggatggagaaagatttaccaagcaaatgaagagcaaaaaaaagcaggggttgcaatcctagtctctgataagacagactttaaaccaacaaagatcaaaaaagacaaagaagggtattacataatggtaaagggatcaatgcaaaaagaagagctaactatcctaaatatatatgcacccaatacaggagcacccatattcataaagcaagtccttagagatctacaaagagacttagactcccacacaataatagtgggagactttaacaccccactatcaatattggacaaaggaacaagacagagaattaacaaggatattcaggacttaaactcagctctggaccaagcagacctaataaacatctacagaactctccaccccaaatcaacaaatgtacatttttctcagcatcacatcacacttattctaaaactgaccacataattggaagtaaaacgctcctcaacaaatgcaaaataatggaagtaataacaaacagtctctcacaccacagtgcaatcaaactagaactcaggattgagaaactcactcgaaaccacacaactacatggaaactgaaaaacctgctcctgaatgactactgggtaaataatgaaattaaggcagaaataaataagttctttgaaatcaatgagaacaaagagacaacatactagaacctctgggacacatttaaagcagtgtttagaaggaaatttatagcactaaatgcccaccggagaaagcgggaaagatctaaattcaacaccataaaatcacaattaaaagaactagagaagtcagagcaaacaaattcaaaagctagcagaagacaagaaataactaagaccacaatagaaatgaaggagatagagaaacaaaaacccttcaaaaaatcaatgaatccaggagctggtgttttgaaaagattaacaaaatagataaaccactagccagactaataaagaagaaaagagagaagaatcaaatagacacaataaaaaatgataaaggggatatcactactgatcccacagaaatacaaactaccaccagagaatactgtaaacacctctttgcaaataaactagaaaatctagaagaaatggataaactccaggacatctataccctcccaagaataaaccaagaagaatttgaatccctgaataaaccaataacaagttctgaaactgaggaagtaattaatagcctaccaaccaaaagaagcccaggaccagacagattcacagccgaattctaccagaggtacaaagaggagatggtaccattccttctgaaactattccaaacattagagaaagagggactcctccctaactcattttaagaggccaacatcatcctgataccaaaacctgacagaggcacaacaaaaaaagaaaatttcaggccaatatccctggtgaatatcactgggagaatcctcaataaaatactggcaattcaaatccagcagcacatcaaaaagcttatccaaaatgatcaagtcagcttcatccctgggattcaaggctggttcaacatatgcagatcaataaacataatccatcacataaacagaatcaatgacaaaaaccacatgattatctcaatatatgcagaaaaggagtttaataaaattcaacaacgcttcatgctaaaaactctcaatgaaataggtactgatggaacatatctcaaaatagtaagagttatttaggataaacacacagctaatatcatactaaatgggcaaaaactggaagcatcccctttgaaaactggcacaagacaaggatgccctccatcaccatttctattaaaaatagtatcggaagttttggccagggcaatcaggcaagagaaagaaataaatggtattcaaataggaagagaggaagtaaaattgtctctgtttgcacatgacatgactgtatatttagaaaaccccattgtctcagcccaaaacctccttaagctgataagcaacttcagcaaagtttcaggatacaaaaatcaatgggcaaaaattacaagcattcatatataccaataatagacaaacagagagccaaatcatgagtgaactcccattcacaattgccacaaacagaataaaatacctaggaatagaacttacaagggatgtgaaggacctcctcaaagagaactacaaactactgctccaggaaataagagaggacacaaacaaatggaaaaacattccatgctcttggataggaagaatcaatatcatgaaaactgccatactgcccaaagtaattaatagattcaatgctctcctcatcaagctgtcattgactttcttcacagaattataaaaaactactttaaatttcatgtggaaccaaaaaagagcccgcatagccaagacaatcctaagcaaaaagaacaaacctggaggcatcacgctacctgaactcaaattctactataaggctacagtaaccaaaacagcatggtactggtaccaaaacagagataccgaccaatggagcagaacagagacctcagaaataacaccacacatgtaaaaccatctgatctttgacaaacctgacaaaaacaagaaatggggaaaggattccctatttaataaatggtattgggaaaactgactagctatatgcagaaaacagcaactggaccccttccttacaccttatacaaaaattaactcaagatggatttaagacttaaacgtaagacctaaaaccataaaaaccctggaagaaaacctaggcaataccattcaggacataggcatgggcaaaaacttcattactaaaacaccaaaagcaatggcaacaaaagccaaaattggaaaatgggatctaattaaactaaagatcttctgcacagtgaaagaaactatcatcatagtgaacagccaacctacagaatgggagaaaatgtttgcaatctatccatctgacaaagggctaatatccagaatctacaaagaacttaaacaaatttacaagaaaaaaacaaccccatcaaaaagtgggcaaaggatatgaacagacacttccccaaaagaagacatttatgcagccaacaaatgtatgaaaaaaagctcatcatcactggtcattagggaaatgtaaatcaaaaccacaaaaccatctcatgccagttagaatggcgatcattaaaagtcaggaaacaacagatgctggagaggatgtggagaaataggaatacttttacactgttgatgggagtgtaaattagttcaacctttgtggaggacagtgtggtgattcctcaaggatatagaactggaaatatcatttaacccagcaatcctattactgggtatatatccagaggattataaatcactgtactataaagacacatgaacatgtatgtttactgcagcactattcacaatagcaaagacttggaaccaacccaaatgcccatcaatgatagcctggatgaagaaaatgtggcacatatatgccatggaatactatgcagccataaaaaaggatgagttcatgtcctttgcagggacatggatgaagctggaaaccatcattctcagcaaactaacacaggaacagaaaccaaacaccacatgttctcactcataagtggaagttgaacaaggaaaacacatggacacagggaggggagcattacacactggggcctgccagggagtggggtcctaggggaggaatagcattaggagaaatacctaatgtagatgacgggttgatgggtgcagcaaaccaccatggcatgtgtattcctatgtaacaaacctgcacgttctacacatgtatcccagaacttaaagtataataaaaaaaagaaaatctgatataaaattacactgcacagcattttaatgcctacttccaagatgtttgcattatagttgcattattttaaaaattttttcatctctaatcattttcttttcattttacaacttcccatctctctccaaatgtggctgtccagcagggatatgtaaaatcacacttactggatagttactagacacttatttaacatactggtatttgaaaagtgtacagtaagtctacagaagagaatctttagaagcaattgtccatactgagtaacaactgtgtttttgttttaaactctaatgacctctattgacctgttttgaaatatagaaatcagtaaaatatttgcacgcagtaaccttaaaactcaaccagaatattatgagggtaaagtggttcattttattgtgtaggtaaatgaaatttgagtttttgtatgaaacactgtaatatcagaaggagaaaatttgtttatctatatgcagaatttaattcagaatttatttgatatttaggctcctgcattgttagacctcagtttgatcattatagtgtctataaacatatttattatgcatatatacatatttattttgtattatagataattgctcatatcagcctcattcctggatccattataaccctgtgatacctttaaagacctcaaaattggagaatttctaggtatggtagttaattcaggaaggacacatttaaaccacatgagcagatttactcaaaaattcttataaccttcaaccctgtgcttcaatcttattcttagtatgacagcttaaatctttggctctgcagccaggagatgacctcaccttcagatctggtgttgtgcactcatctaattcatcctcttgcctacagccatgctccctgtctgctcttgccacactatccatgcagcttacttttggagaggttttccttgtggatacattgcaatacatgtgtgttttactactcatcctatgcccatagcaatccagtacctatcttctacctgctacatccatgcttcgctagttacacttatgttctgattctcacctatggttttctttctcagttcacctgtttttactttttgtttatatatatacatatgtgtgtatatatatatgtatataaaaacatacataatcatgtatgtggaggatttaggcatttgaattatttttgtgtttgttttagaagtccctactgtaaagttgcatctttatctttctaatattatttgaatgctagaaatatttttaaatttttattttactttaagttctgcaatacatgagcagaacgtgcaggtttgttacacaggtatatgggtgccatggtggtttgctgtgcctatcaacctgtcatctaggttttaagccccacatgcattaggtgtttgtcctgatgctctctcctcccctcatcccctgacagaccccagtatgtgttgtttctctccctgtgtccatgtgtcctcatttttcagttcccacttatcagggagaacatgtggcatttggttttctgttcctgtgttagtttgtcgaggatgatggcttccagtttcatccacgtcctggcaaaggatgtgaactcattcttttttcatgactacataatactccgtggtgtatatgtgccacatttcctttatccagtctattatttatgggcatttgggttgcttccatgtctctgctaatgtcaatagtgctgcaataaacatatgtgtacatgtatctttatagtagaatgatttgtattcctttgggtatgtacccagtaatgcgattgctgggtcaaatggtatttctggttctagatccttgagaaatcaccacactgtcttccccaagggtcgagctaatttacattcccaccaacagtataaaagtgttcctatttctccacagcctcaccaacatctgttttttcttgactttttagtaatcgccattctgactggcatgagatggtatctcattgtaattctgatttgcatttctctaatgataagtgatgttgtggggtttttttatatgtttgttggccacataaatgtctttttttgagaagtgtttgctcatatcctttgcccactttttgatggtgatatttttcagagttcttttttaattcaattcagcaagaacaacacttctaaaaacccaagaattgtgctgtacttatacaaaagttttccttcagaaaacgatttctgcaagtgatcaattgtatttacccttcatggtgctagggctatcactagatgtgtcctcttctaactcatttctccaaaacgcaccattaattgcagctattggcagaggcatgctgtcctcagggaaagcctgatgaggagctgtccacaaggtttgcatgctccaaaatagctcttttagatgcttcctggttttagtaccatgctcattctcacaatttctttcatgcctgtgatggggaaataagtctctctggagccacaccagctccactaggtcatgggccttttggtttcatagttgctccctcattctaaattaatttcaatcaaaattaactctaatttaacaatatccattagaaaaaaaatgaatctggagtttaaactcgctgacacagttaatgcaattgataatctactacttgaaaagcatttaaaatataccaaaatgagcataaaaaataatgtctcatttttggcaaatgaagtgagaggttccacatgaaccctctagctgagcacatcttggatttaacgtatgaataccgcctcctgcaaatgagactaaaatgtaaatgggaataacttgtttattttgaaaaaagtatgcaaacagccataacatctcacttgcagacctcttttccactcaagcaaatggcttttgacttagaaacctgactttcttttttatattactgagaagcattagctgacatagtttttgattatgtctacttaggaatataaaattgcctataatcatagaattcattggtctttgtttacttaactcagatatgcttcttaaatattctatcagtggatatgtcttctatctgtggatatgttttgcacagattggttacatttttcaactgaacagatttatttggtattttattaattaaattggtggctggatttgggtggctcatacttgtggtctcagcactttgggacatcctgaggtgggaggatcacttagggccaggagattgagacgagcctggacaacagaaggagatcttgtctcaaaataaacagtcttagatgtgattcttttgcttggaaaggcagttcaaaaagatgctttccctgagtcactataaggtcttccactgtctttcgttgctgtcatgttctctctgatgcacaatgttttctttgaaaccaagttgtccctaaagttctggaaataataactttataaaaagatgctgcaagacttttaaaatacttactttggtataaatcctccattatccttaatctccataatattgcatttcaaatcaaaaccctaattgtataaaagagaaagtttttactttctttcatattgcattatatttcaccaaaaataataataccttcaattaatacttataattattttatatctcttacaagcaacagggaatttagaatttccaaatctttttttttttttttcactttaaagagaggaatgaagggtggtggaaaggatatggacttggaaagggagtctttaaaatctctagttatgaccaagaggatataaatatgcataactttggaaggaagattatttttatatgtattttacataaagcttataataattacatcaagattcaagcagaattaattaatattgccaattctgatcacactaggcaatttgaactctcattcatttaataaaagtttaccaagcgccttttaggaagtgttctaggcacatgcagtgtatcaatgaacaacaccaaataaataaatccttgcccttgtgaagactgtattcttacaggtgaagacaaacaataaacagagaacataataagaaagtaaattatatagtatcttagaagttgatgagtactatgggggaaaataaattaaatggagtaagaggaatcagaagtactatggcagggtcagtgtatcagtcaactcaggctgctataacaaaattccatggactgagtggattaaacaacagaaatttactttattacagttctagaggttgggagttccaacatcaagtggccttctttgttttcacatgaatcaaccacacacacacacacacacacacacacagagagagagagaaagagagagtgagcaagctcaagtgtcccatcctataaggacactaagatcacagccccactcttatgacatcatttaactttaattacttccttagaagctctatcaccaaatgcaaccacattaggggttaggactttaatagatgaatttcaggaggacacattagtccatagcaggaaggttgtaatttgaaatagagtggtcagggtatgccttaccgagaaggtatatttgcatgaattttataagaggtatgaacttagctatcccaatatctaggggaaggcagcccaggtataaggagcaactagagcaaaagtattaggaacatgatatgcaagagcattagaggatcagtgaggcaggagcagaatgaggtttagggagaaatgtagatgagttttgagagatattggcaagaccagatcatacagtacttgggttttcaccgtcagagaaataagacgtcggaggattgcttttctaagtcttatgttttaatacagtcattcaagctatgtgaaaaaatagacttatgggaggggtaagtgaagagtgactaaactatttaggaagctgttattatgattgagagatgatggtgcttcaatgtgacagaagcttggtgacgcaggtcactgatgcttttatgacagaggtcataaaaatggtcagaatttgaaactatttgggtggtaaaaccaacagcatttgctgaaaaactggatgtaaacagtatgagagaaaaagaattcaaggatgactgtaagatttttgacctaaccaacttaagaatggagttactgttaagtgacatggagaagcctgagaaaccttcataattggaacagattgggtaggaatgagataaagagttccatttgagacacattaagttgatgtatctgttagacatccaaatgggatttcaggtaggcatttggatatataagtatggtgtttaagtgagaggtttagcgtaaagttattggcatataaataatttaaaatatgagactgtatgtcaactccaagaaagtaagtataaaataaagaataaaaattatgaaaataacaccctggagcattgtaacagtaagaagttgtggagaagagaaccagccaaaggcggcagaatgaaagcaatcattgaggtaaaaggaaaaccaaaataatgtcatgccatggaaaataaaggaataaagcctatcaaagaaaagggcctaatgagctgtgtcaaatgctactgagatgtcaagtaaaatgaagactgagaattgatcattagttttagctatatggaggtcattggtaaccttgacaatagcagtttttatgtaatggtaggcatcagcatcaaagtccatcaagaatgagttccagagacaataggagaaaaattaatatagacaactcttccaagaaatctttctgccaagataagtggagatatcaacatagtttgaagtcatagatgccataattttctaatggattggagtgagacaggggagaaagaaaggagtccaggacggcccgaagatttgggatacaacatctgtaagaaagcaattgtcattccccgtataagaataccgcagaaatctattcaaatagtaatgtctattaataatatgccactgaacatatgagtctgaaatctagggaagaggttcattaaaaatattagttaacagcatagagagtatctaaaaccatgaggctggataaatcaccatggaataagaaaatggaaaacagtagagccatttgcatcaggaagacaaaacgaaatcagcaatggagactgataaggcgtagtcaggtgggagagaaacagaagttaagttttgaaaagtgtttcaaaggatgatcaactgtgtcaaaggatgatgatagttcaagtgagatgagtaatagagatctggccttaaggtttcagtaacagagaccattcactggtaatcttgacagaagccagtatgatggaaaactggaggtaagagtctgaatagcatgggttcaaaagagaatggaagaaaaataattgcagacagtaagtaatagcacaaacagttctcaaaagagtcagagaaactgagcgaaggctggaaggagaggaaatgttaagagaccttagttttgtttttcagagaaaaacacctgcatgcttgtatgctgatgggaaacatccattagagatgtgggagagagaggaaaaaagggctggttctttttctccgtgatatcttaagaggtccaccccttaataagggtaaaatttctttagtttctattggagtaaaaagttgtaggaatgcccagagaggagattaagtatataggggattttgctaatgacagatcataaattccaactgtcacagtggaagaacttcaagaatgagggagagatatgtgctgggcagaagaggaaattggcagaattctcaggaggttagaataaaagggctgagcatggtccagatgtctggagttacttgagatgacttatataagtaaatgaaacagtgatgttaagtcctggtgctcccaatgcaagtgttggtgatacagtgtaggttctgggctagagaaggctgagcatgatctgggaatgccttcttctcttttgtatgtttgtcaagcatagctcggcatttcaccaagctgtggtctgacagtggcctttccctcacccacctcttagactccaagcgtactgctcagttgccagtgcagcaagagggaacagagttgttttttgtttgtttgtttttttccatgtcttcatgtcactgctttaaaaaaacacatcagccctgcagtgctgtgagatttgtcgggcagctcacactgcctatgctctgagcattcacctttcacagagctacttatttggtaacattcttttggtacctttcagaagagattttcatggaaaatccaaggcgatttcattccaccttgctgtggtaaaaacagaattgagtcctcaaatcaaaatccccaactcccaccccggctctactgccatgcctacaaagaaatccaagaatgatataaatccagaggatctttgcatgctgtaagggagattctccacattctgccttttcactcctgtaacaaatgtttagaaacatttcctagacagcagagatgagtgaacaagaaaagcagtcccaaataaagcatgcatgccatgtaaaaatacttcactaatggtaattgtattgacaaacaatgttatgccctgacaaaaatttaaatgtagtacaaaaatgtaaaggtagtacaaaaatcactctaagaattcaatgtttctactcagatatcacaaactgtgtttttaaattagagagatatattcttaatttgctgcttggaattaccaagtgactaaacatgtttgccagaactgggagagcaaactgctcaagaaatttcctagaaaatgaaagaaaactgtttaaattatagttctaattggccccttatctggggctgagggattgatgaaataattattagtgtacataatggtgaggtttgtgtaaagataaaatgaaagagtcctaattaactccaacaaactttgacatatgtaagtgcttactccctgaagattgattttcattttactaatgacactggaggtgacaccatgaccacgtgtcgtgaggaaatatgcattagccttctgattctgtcagtagcattaatattcttgattgccatttgtagcatttttctagtcctcataatgacatgaaatttccttcctttctatagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcaggtaaaaatttggaagagtcagattggatttggtatgcttctaatcgtcttgaaagtgagttgaattaaccatgattgctccattgcttgctttagcataatttgtcctgattcatttacctaaacatcataaaattattttctttaaaataattatttcattttatttgttctcagaactttttctccctgtttccacaaatacagtcatctaaatgcttcaattttctcccaatccttgtactcatcttcaggttaccatgaaattaaagcagttcatttattcttctaataatatactcattcaatatagcatacacttaagatttagaataaatcggttcaccttctttttttccagtgatactttacttgaattacagtgtacttccttagaactcttttatgttacccttcaccacaaaacccatataaattacactttgcaaatagtaaacattgcccttccttgacctactgccttcctgaagtctatatgtaaaataaataccaatctgctccttgactttgaaaacattacattattctcagcttttagaaaaagcatatctgataaaaggtttctaatgactgaggaattaacagctctatttgaattttaagatatcttgcctatcacctggaaggtgcagaaaaataaagaaataaggaatacagaaattttctgagtagatttttatgactttggacaaagtctcattgaggtcttttatgtccctctaatgttgtatattaagaaagtatctggttagacatttacttaggggaacacaaacatgaatgttgataagaacaatatgaaaacaatagaaagaggaggatcagggataggtatagggaggaagaaataacaaatgctaatgtttttatgctcaatgataatatatgagtctcaaataaaagtgcactgaaaatgaaggtttgtcatatatgttcactgccctatactgaaacctagaacagtgtttggtactggtactcagcatgtcatatttttaaagggaacaattttttcctttatgtccccctacacacaccagtacataggtcagatacacatatacatacaagactaagaattaactgtgtccattgtgtattatagttatagaactgaaccaaaaatatgacttttgacctctaacaaattaaacaaagcttataatcattaaaataaactctcaaaacagttgactttttctctaaaacatattatggccctctcagaaggaaggaaggaaggaaggagaatggaggaagggagggagggaaaagaaagaaaaaaaaatcccaagatggcccactagactcaagacaaatggaacagctcctactgagggacccagaggactagagtgctcctaacagatcttcacagggaaggcactgagagtggacagagggaaaacacagaggttgggctgattgggggaaaacgttgggacccctacgcggggctacagcacacccggatttatttctggcccccaacagctctgggggaattggtgagttgaactggcaaggagcaacccactcttgccacaggcctctggaaccccagcagaaggagaccccctagaccaccacggactctggacttggcagggagagctgcatacagaagtggtaggagctgcaagccagctgatgtggagcccagagggtttggtgcaagagcatctgtagtgaagcatggtcagggatggccatccccctaggttcgatttgctccataggagactttagccctaggggaactttctgtctgtcctgaactctgtaaggcagttttgcccatcagatggggccagtcccacctaagcaacaccttagtctgctggcctctccccgagcctcagtatggccacacctgcttgcagggcgccctcgggagccttgagaggcctcacaatagcttctcctctggcagaccctgactgaaaggcagagagcttaagcagggcggctcctatggccactcaccagcctgcacagtctttccccacactgcagccgcagcgtccccgacatccctccatgggacaactcccacatgagtttgctgggcgtgtctgcttaggggtaggggtggggatttgggtttgctttccttgccctgacagcgcctggtagtacagtctgctccccttcccctgccaaccaccgttgcagacagagtcttagtgggtacagagccagcaagccctgtcccaacaagtaccccacccttgctttaagaatgcgcagatgacagcggatcctcccccaccttgagtgacccctccagcttgcagagcagagaaggcacccagacctgcacctgtcagtgccctgcccccagccaacaccacctccagtgcaagcaggcacacagttgtcatcaggcacccgctaccaccaccatcgctccaggcccaacctcaactgcattgcctccgccactgtggtgaatgtccccagggagacaggcacccaggaacccgctagcactcaaaaatagaaagattcaatatcattaaaatgaacatactgcccaaagcaatttatagagttcatggtatttctattaaactaccattgacattcttcactgaactactaaaactattttaaaattcatatgaaccaaaaaagagtcaaaatagagaaggcaatgctaagcaaaaagaagaaagctggaggcaacatgttacccaacttcaaactatactacagcgctacagtaaccaaaacagcatggtactggtactaaaacagacatacagatgagcggaacagaatagagagtgcagaaatatgaactaactcctacaaccatctgattttcgacaaatctgacaaaaacaagcactggggaaaggataccctattcaataaatggtgctgagataactggctagccatatgcagaagattgaaactggaccacttcctttcactgtatacaaaaattaactcaagatggattaaagacttaaatgtaagatacaaaactatcaaaatgctagaaaacaacctaggtaatactgttctggtcataggaacaggcaaagatttcatgatgaagatgacaaaagcaattacaacaaaaacaaaaattgacaaatgggttctaattaaacttaagagcttctgcacagtgaaagaaactgtcaacagagtaaacagataacccacagaatatgataaaatttttgcaaactctatatctgataaaggtctaatatccagcatctataaggaacttaaacaaatttacaagaaaaaaacaaacagccccattaaaaagtgagcaaaggacatgtgtagacacttttcaaaagaagacatacacgtggccaacaatcatgtgagaaaaagctcaacatcactgatcctcagagaaatacaaaatgcaataacattaaaaccgcaaatgagataccatctcatgcctgtcacaatggctattactaaaaagtcaaaaaataacagatgctggcaaggttgcagagaaaaaagaacacttatacactgttggtgggagtataaattaggtcaaccattgtggaagaaagtgtgacgacaactcaaagacctaaaaacagaaaaaacattcgacccgatactcccattactgggtatgtgctcaaaggcttaatacctgggtgatgaaataatctgtacaacaaacccccatgtcacaagtttacctatgtaacaaacctgcacatgtacccgtgaacttaaaagtttaattgccaaaaaaatccacatgatcaaattatcacattaaaagtaaataacaatacaaaagatgttcagtttttttccatataaaaattaaacaaccaaaaaaaaaaggtaaaatggcttaaatatgttggaaaaggttcatccacagaaaatccaacttctccacttttgtgatttgcctattataagttgtttttttctgctaccttttcaatagcatgaattttaaattaaacattaattgcctggttagattttcatgcatccataaaaccagccatgctttcattgtgtacaggtgttcattaattaagagcataacaggttagttgttcttcattttatgtactcactgtgcagctactgaaatgactgccaatagtagtacttatgctcacatattttctaaaaagcgctgccttactttgcatattgttaattgtgtttaaacaaaggcaaagattactgactaattcagaggctctctataaatattcatttcaaaaataaataatccatttgggatgaataatccttttcaactttttatggtatgaatctccttgtgctattaaaaagcattttagcaagatcacttttacatttcaagctaaagtgtattcagattgtgcattttaaaagaatttctatttctgcagctacctcaatcatgtattgcctgtctctattttatcatgagttctatatacatgacatactttagtccattaaaatcttatggaagagaagtagcatgaaaaatgcacgaagtactctcctttgaaagtgagttgaggaaggtttgtattgcatcctttatgcttcctgtactgtggtactacatagggttagagctactaatggtgttgagccaagtgttgagttatgtgcctgttttgtcaggcagcacagatttaaagagacaccaatgtctggagacatcctctcaaatgatgcactctgcctctattaagtacatatccagtattttaaaagataatgctgctctaaagagccaactaaactttgaaaatagagctgcttgggagaaaaaaggtctcacattagggatgttgaattgaaagtggtatgcctctttaaggttcacttatttaatagaatattctaaattccaaagcagtgcagtgaactattctgtcatagaattgccccttttctgcatgccaaaaaacagaatttttctttacaatttttctgaagagtatattttgaattttccggtcatcaagaaatactcggtcaggcacggtggctcatgcctataatctcagcactttgggacgctgaagcataggtatcatctgagcccaggaattcaagaccagcctggccaacatggcaaaaaccatctctgctaaacatataaaaatcagccaggcatggtggcacacacctgtaattttagctattcagatgactgaggcatgagaacccgggaggcagaggttgcactgagcagacattgcaccactgcactccagcctgggtgacagagtgagactctctcaaaaaaaaaaaaaaaaaaaaaaaaaggaaagaaacactcttgatagtcagcaaagctaagataaattggttcagtccaatttcttagtattaggatgtcaaaatcataatacaaatatatatttttatgcacacatttcacttttaatttatgtgggtatacagtaggtatatatattttggggttacatgagatattttgatacaggcatacaatgcttagtaatcatatcaggataaatagggtattcatcccctcaagcatctatcctttgtgtttcaaacaatccaataatacacttctggtcagtttaaaatgtacaattaattttttttttttactatagtcaccctgttatgctagcaaatactaggtcttatttattctttctaatttttttttatatccattaaccatcttcccttccccccaacccccactaccaactacacttcccagcctctggtaaccaaccttctactctctatttacatgagttcgattgttttaatttttagctcttaccaatgagtgagaacatgtgatgtttgtctttctgtgcctggcttatttcacttaacatgatgatctccagatccatccatgttgttgcaaatgacaggatttcattcttttgtatggctcaataatactacgttgtgtacaagtaccacattttctttatccattcatctgctgatggacatttaagttgcttccagatattggctatggtgaatattactgcaataaatgtgggagtgcagatatcacttcaataaactaatttcctttctttggatatatacctaggagtgggattgctagatcatatggtagctctatttttagttttctgagaaacctccaaactgttctccgtagtgttgtactaatttatgttcccaccaacagtgtatgagtgtttccttttctctagatcctcactagcatttgttattgcctgtcttttgaatataagccatgtaaactggggtgaaattacatcttattgaagttttgatttgcattcccctgatgatcaattatgctgagcacattttcatatgctcagacttatatgtcttcttttgagaaatgtcttttcaaatcttttgcccattttatgaattgggttttttttattttttttcctacataattgacttctttatatattctgtttatcaatcctttggcagacaggtagtttgcaaatattttctcccattctgtgggttgtctcttcacttgtttactgtttcctttgctgtgtagaagctttttaaattatcctatttgtctatttttgctttagttttctgtgcttgtggtatattgctcaagaagtctttgcctactccgttgtcttgcacagtttccccaatgttttcctgtagtagtttcatattttgaggtcttagatttgaatctttaatacattttgatttgatttttatatggcaaggtataagagtctagtttcacttttctacatgtagctatccagttttcccagaactatttagtgaagagactgtcctttctttgatgtatgttctgagaatttttattggaaataagttcattgcagatgtatggatttatgttggaggtcctctattctgttccattggtcaatgtgtctgtttttatgccagggccatgctgtttttatcactgtagctctcaagtataatttaaagtctggtaatgtgattccaccagttttgttctttttgcttaggatagttttggctattctagctcttttgtgatctgatataaacttaagaattgttttttctatttctgtgaagaatatcattgttattttgatagggattgcattaaatctctagattgctttggatagtatggacattttaacaatattgtttcttacaattcatgaacagggaatatctttctattattttgtgtccttttcaatgtattgcatcagttttacagttttcattatagagatatttcatttatttggttaattcctaagtgttgtattttatttgtagctattgtaaataagataagtttcttgatttctttttcagattgttcacagtttgcatataaaaatgctactgatttttgtatgttgattttgtatcctgaaaatttactaaatttgttcatcagttctaattgttttttgatggggtctttagattttcccaaacataagattatatcatctgcaaacaagaaaaagttgatgtcttcctttccaatttggatgccttttatatatttctcctgtctgattgctctagctaggacttccagtactatgctgaaaaatagtggtgaaactgggcattcttgtcatgttccagatctaggaggaaagactttcagtctttccccatttaatataatactagctgtgagttcatcatatgatttttatgatgttgagttatattccttctatacccagtttgttgagaatttttatcatgaagagatgctaaattttatcaaatgctttttcaacatcaattgaaatggtcataggtgttttgtccttcattctgttggtataatgtatcacattgacttatttgtgtatgttgaatttgccttgcatcccagggataaattccacttggtcatgatgaatgaactttttaatgtgttattgaattcagtttgctggtattttgttgagaaattttgcattgatacttaccagtgataccagtctataggttttttttttcttttttgatacgtctttgtctatttttggtaccaggataatactggcctcatagaatgaatttggaagtgttccctccttctctattttttgaaatagtttgagtaggattggttttagttcttctttaaatgtttggcagaattcagcagtgaagccattgagtctgaggcttctttttttttccctctggatgcccatttattacagcttcaatcacacattatcgatctgcttaagttttgaatttattcatagttcaatcttgataggttgtatgtgtctagaaatttgtccatttcttctagatattccaatttattggcacatagttgctcatagtagcctctaatgatcctttgaatttctgcagtgtgagatgtaatgtctcctttttatgtctgattttgcttatttgtgtactctctttttttcttagtctggctaaagatttgttcattttaactttaaaaaaacctttttgttctattgatcttttgtattgttttcttcatttcatttatttctgctctgatctttattgtatttttcttctactaattttgggtttggtttactcttgcttttctagttccttaggatgcctcattaggttgtttatttgaagtttttctttttcttttttttttttttttaatgatttaggcacttatagctatgaagtttcctcttaggattgcttttgctgtatcccataggtcttggtatgctgtgattccattatcatttgtttcaagaaatttttcaattcccttcttaatttcttcattgacccatgggtcattcaggagcattttttttgtgacctaacatatggcctatccttgagaataacctatgtgctgaggaaaagaatgtgtattcagtcattggataaaatgttttgaaaatattaggtcgatttggtccacattgtaaattaaatccagtgtttctttgttgattttctgtctggaaggtctgtctagtgctgaaagtgaggtgttaaagtctccagctattattgcagtgaggcgtatctctctttccttacctctcataatatttcctgtgtatatctgggtactcaagcattgagtgcacatgtatttcaaattgttatatcctcttgctgaattcacccctttatctttatatggtgaacttctttatgtcttcttatagtttttgtcttaaaatttatttttttctcatatgaatatagctactactgctcttttgtgatttccactggcatgaaatatgtttttctatccctgtgttttcaatctatgagtgtctttataggtgaagtgtgttgcttgtaggaaacaggttattgcgtattatttttttgaccattcagccactctgtcttttgattagagaggttagtccatttacatgcagtgttactattgataagtaaggacttactcctgccattttattatttgttttctggttgttttgtggtctattcttccttctttcctttcttcctgccttcctattagtgaaggtgtttttctctagtgatatggtgtaattttcattttttgtgtatcccttgtaagttttttgctttgaggttaccacgaggtttgcaaatactggcttataaccaattattttaagccggtaataacttatcactgtttgcaaacaaaacaaacaagtaaaaagaaaactagtaaaaaatctacatcttaaatttaatcacctcctttttaactttctgctgtttctatttatatcttattgtactgtctatgtatttgaatgttgttgtagttattattttttattggttcatcatttagtctttctgcttaggataagagtagtttatactccacagttacagtgttataatattctgtgttttcctgtgtacttactattaccaatgagttttttacattcaaatgattatttattcctcattaatgtccttttctttctgattgaagtattctctttagcatttcttgtgggacaggtctggtgttgatgaaatccctcagctttctttgtctgggaagcctttatttctccttatgtttgaaggatattttcaccagatataatactctatggtaaaagttttttttcattagcactttaaatatgtcataccgctctctcctggcctgtaaagtttccactgaaaagtctgctgccagacatattggagctcctttgtatgttatttgtttctttctcttactgtttttaggatcttttctttatccttgagctttggaagtttgattattaactgtcttgaggcattgttctttgggttgaatctgcttggtgttctataaccttcttgtacttaaatgttaatatttttctctaggtttgggaagttctctgatattatccatttgaataaacttcatacccctatctctttctaccttgtctttaaggccaaaactcttagatttgcccttttgaggctattttctaaatcttgtaggtgtgcttcattattcttttttcttttgtctagtctgacgtatattttcaaatagcctatcttaaagtttactaattctttcttctgctagatcaattctactattaaaagactcatgctttctccactgtgtcagttgcatttttcagctccagagtttgtgttggattctctttattatttcaatctctttgttaaatttgtctgatagaattctgaattctttcttggcattctatttttttttttttttttttactttcctcataacagctattttgatttatctgtctgaaaggtcacatatctccgtttctccaggattggtccccggtggcatatttggttcatttgctgaagtcgtgttttcctggatggtcttgatacttgtggatatttatctgtgtctggccattgaagagttaggcatttattgtagtttttgcaggctgggcttgtttgtaacctgcctttcgtgggcaggcttttccaggtatttgaaaggacttgcgtattgttatctagctgtatctgctttaggggacaccccaagcccagtaatgtagttcttggagactagtagaggtactgccttgataatcttgaagaaggtctgaaagaattctctggattaccaggcagagactcttgttctctttccttactttctcccaaacaaatggagtctctctgttctgagccacctggagctggggatgaagtgacataagtaccctggtggccaccaccactggaactgtgctgggtcagacctgaagccagtccagcagtcgatctcacctatggcctgctataaccacttgctggtgactgcctatgtttgctcaaggccctggggctctacaattagcatgtggcaaagtgagccaggccagtgtccttcctttcagggtggtgagttcccctagggcctaggcggatccagaggtgccattcaggagccagggactacagtcaaaatccttagaagtctacttggtgttctattgtactgcagctgagttgacactcaaaccacaaggcacagtccttcccattcttccctctcctttccaaaggcagaggagcctcaccacgtggccactgccaccacaagcccacaggtagtactgccagtctactgccagtgttcccttaaggcccaaggtctcttaagttagcttttggcgaatggtgcctggcctagaactcacccttcagggcaatgggctcccttctgtccctgggcaggtccagaaatgctgtcaaagagtcaactcctgggatcagggaccccaagagccctcttagttctctacacctctgtggctgagctggtacctaaggttcaagacaaagtctcctttacttttcatagcagatgattaatcctgccaagactgggtctttcccttcaaggtagtgggttcctttcttgcccaggatgtgtctagaaatgtcatacaggagctagggtctgaaaagagggcttcacaactatgaccagtgccctattctcctgtggctgagctggtatccaagaagcaagaaaaagttctccccactcttcctccttctctcctaaagtgggaggaaggtatctcttatggatctgcaagctgtgcagcctggacttaggaaaggggtggcatcaacactcccctagcactctaccccagctcacattttagatgccacatattctccaagtccactatctctgagcccagttcaacacaggacttgcctaggagttacagtccttgtggcctagactacctttcaagtttatttagggccccagagcacttgagcctgtggtggtgaggctttcaggaattcaagttctgaccactgatatggaagatttccctctggctagggatggtttaaatattccctccgggccgggcgctgtggctcacacctgtaatcccagcactttgggaggccgaggtgggtgaataacctgaggtcaggagttcgagaccagcctgaccaacatggtgaaacatcgtctctactgaaaatacaaaaattagccgggcgcggtagcgggcacctgtaatcccagctactcgagaggctgaggcacaagaatcacttgaacccaggaggcagagattgcagtgagccaagatcgggccattgcactccatcctgggtgacatagcgagactctgtctcaaaaaaataaaaaatttaaataaataaataaataaattccctctgtgggtgggcatcagctgaatttggtctggttttgctttcttctataaccaagcgacactgaatttaatgtctcacaattgttgcactctccctctcccaagcaaacagattttctcttctgtgttgtggggccactgctggggaatggaggagcggtggtctcagtgattcaagactgtttttcctacctcttcagtgcatctttcagcaatatgaagtttaaaccaaatactgtgagtgctcacctgatttttggttcttacaaaagtgagttttatgtgtagcagtgtccttgccaaggggacaatcagtggagccttctattctgccatcttgctctgccaccatctcctatatttaagctatattttcttacaagttttagttagagattagatagattgataaataaagatagacagccctgtgtttaatttttgaaatctgttaatatcatcaaaccaatatataaatttgggatagcataatgtaaatactttctctattatttaaaaagatgacactcaggacaaaaaaaatcacatttggggaaatgaatctgaaatacacactgtgggtgaaatggaaaaatacataaagtaaatacagcattgtcaattttgtcatttaattgaattttaatattctatacgttacatgttcttaatacggttgaaaaataaatgaaagggagaaaagatatagttaactacgtaacttgtcattcagaaaggtctgatcttctctgtagtataaaatttcaattatcttcaaagctactggtataaatctcaatatttgcagtttatttcaaattttaatgaattatatatacacacatgaataaatatacatatatgcttatgtgtgtatgtatcttttaaagaaaaagaaattgcacctataatgaaaggttggagtttcaacctggattaacgttctactgtgccacttaatagcagggtggacataggcaggaagtatgtcatttaaggcttgaatttctcactcataaaatggggataccacaacctactccttttgaccattctattaaataagattttttaaatgcatgtaaagagcttagcatagtgcctggcacatgataaatgctcaatattattggaagatattttattgtatcacctccatcattaatttaaatgagttattactttattaaatggaaatttacaaactagtaatcatgaaaaagtatattttttcatattgagaaaacattttcagagttaaacacgtttgttgatacagtaagaaccctacggtctcttgacttgcagctctgcagtcaacttcccaagataccctcactgtgagaagtctccactgcagacagccagcgttccatcatgccctatcatccagcccactagaacaacaggagagtcaagagaatgttttagcacatggcacactccacagagcatgcatgccttctaaatcatccttgcaaacccgtggctggccttcccatgatgccttttcatcttatctaattagtactatttctcaatatgtagccattttctttggttcttgtagcacagacaaggcgaaaggagtagaggaaaagaagtgttgaatgaaagactatgctaacacatttttccacacattcaaatgtctttgctttctagttatttttttcctacactgtattccgtcccttcattctcttctgactcaaatggaaaattatacacatatttctggccacaaaaggaaaaatactgaggagccaagatggccgaataggaacagctccggtctacagctcccagcgtgagcgacgcagaagacgggtgatttctgcatttccatctgaggtaccgggttcatctcactagggagtgccagacagtgggcgcaggtcagtgggtgcgcgcaccgtgcgcgagccgaagcagggcgaggcgttgcctcacttgggaagcgcaaggggtcagggagctccctttccgagtcaaagaaaggggtgacagacgcacctggaaaatcgggtcactcccaccctaatactgcgcttttccgataggcttaaaaaacggcccaacacgagattatatcccgcacctggctgggagggtcctacgcccacggagtctcgctgattgctagcacagcagtctgagatcaaactgcaaggtggcagccaggctgggggaggggcgcccgccattgcccaggcttgcttaggtaaacaaagcagcagggaagctccaactgggtggagcccaccacagctcaaggaggccagcctgcctctgtaggctccacctctgggggcagggcacagacaaacaaaaagacagcaggaacctctgcagacttaaatgtccctgtctgacagctttgaagagagcagtggttctcccagcacgcagctggagatctgagaacgggcagactgcctcctcaagtgggtccctgacccctgacccccaagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacacaacagaaaaactggaaactctaaaaagcagagtgcctctcctcctccaaaggaacgcagttcctcaccagcaacggaacaaagctggatggagaatgactttgatgagctgagagaagaaggcttcagatgatcaaattactctgagctacgggaggacattcaaaccaaaggcaaggaagttgaaaactttgaaaaaaatttagaagaatgtataactagaataaccaatacagagaagtgcttaaaggagctgatggagctgaaaaccaaagctcgagaactacgtgaagaatgcagaagcctcaggagccgatgtgatcaactggaagaaagggtatcagcaatggaagatgaaatgaatgaaatgaagcgagaagggaagtttagagaaaaaagaataaaaagaaatgagcaaagcctccaagaaaatatgggactatgtgaaaagaccaaatctacgtctgattggtgtacctgaaagtgttggggagaatggaaccaagttggaaaacactctgcagaatattatccaggagaacttccccaatctagcaaggcaggccaacattcaaattcaggaaatacagagaatgccataaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaaggaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccttcgagactaggaagaaactgcatcaactaatgagcaaaataaccagctaacatcataatgacaggatcaaattcacacataacaatattaactttagatgtaaatggactaaatgctccaatttaaagacacagactggcaaattagataaagagtcaagacccatcagtgtgctatattcaggaaacccatctcacgtgcagaaacacacacaggctcaaaataaaaggatggaggaagatctaccaagcaaatggaaaacaaaaaaaggcaggggttgcaatcccagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtgcttagtgacctacaaagagacttagactcccacacattaataatgggagactttaacaacccactgtcaacattagacagatcaacgagacagaaagtcaacaaggatacccaggaattgaactcagctctgtaccaagtggacctaatagacatctacagaactctccaccccaaatcaacagaatatacattttttttcagcaccacaccacacctattcgaaaattgaccacatacttggaagtaaagctctcctcagcaaatgtgaaagaacagaaattataacaaactatctctcagaccacagtgcaatcaaactagaactcaggattaagaacctcacccaaaccgctcaactacatggaaactgaacaacctgctcctgaatgactactgggtacacaaagaaatgaaggcagaaataaagatgttctttgaaaccaacgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttccaaaaattaatgaatccaggagctggttttttgaaaggatcaacaaaattgatagaccgctagcaagactaataaagaaaaaaagagagaagaatcaaatagacacaataaaaaatgataaaggagatatcaccaccgatcccacagaaatacaaactaccatcagagaatactacaaacacctctacgcaaataaactagaaaatctagaagaaatggataaattcctcgaaacatacactctccaaagactaagccagggagaggttgaatctctgaacagaccaataacaggatctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgagggcagcatcatcctgataccaaagccgggcagagacacaacgaacaaagagaattttagaccaatatccttgatgaacattgatacaaaaatcctcaataaaatactggcaaaccgaatccagcagcacatcaaaaagcttatccaccatgatcacgtgggcttcacccctgggatgcaaggctggttcaatatacgcaaatcaataaatgtaatccagcatataaacagagccaaagacaaaaaccacatgattatctcaatagcagcagaaaaagcctttgacaaaattcaacaacgcttcatgctaaaaactctcaataaattaggtgttgatgggacgtatctcaaaataataagagctatctatgacaaacccacagccaatatcataccgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaacaacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacagacaaatggaagaacattccatgctcctgggtaggaagaatctttatcgtgaaaatggccatactgcccaaggtaatttacagattcaatgccatccccatcaagctaccaatgcctttcttcacagaattggaaaaaactactttcaagttcatatggaaccaaaaaagagcctgcattgctaagtcaatcctaagccaaaagaacaaagctagaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctataacaccaaaagcaatggcaacaaaagccaaaattgacaaatgggatctaattaaactaaagagcttctgcacagcaaaagaaactaccatcagagtgaacaagcaacctacaaaatgggagaaaattttcacaacctactcatctgacaaagggctaatatccagaatctacaatgaactcaaacaaatttacaagaaaaaaacaaacaaccccatcaaacagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggaatgtaaactagttcaaccattgtggaagtcagtgtggcgattcctcagggatctagaactagaaataccatttgacccagccatcccattactgggtatatacccaatggactataaatcatgctgctataaagacacatgcacacgtatgtttattgcagcactattcacaatagcgaagacttggaaccaacccaaatgtccaacaatgatagactggattaagaaaatgtggcacatatacaccatggaatactatgcagccataaaatatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggaagggggagggatagcattgggagatatacctaatgctagatgacgagttagtgggtgcagcgcaccagcatggcacatgtatacatatgtaactaacctgcacaatgtgcacatgtaccctaaaacgtaaagtataataataaataaataaataaataaataaataaataaataaaaaatataaataaataaaaaattaaaaaaaggaaaaatattttttctacatttgaaaactcaaacgccaataaatagctgtagaggttaaaacaaacaaacaaacaacaacaaaaaaaaggttttttcttctcccgccattgctctccactatgctcaatgtgatcccaaacctcagcctcaaataaatcctaagcacttttacgtactagagcagtcgcattttcaggtatttaaaaattccagtttaatttaattaaaaaaatttaatctcacatctaattccatggtctctcattccttcccagcacagacctgacccaacagctatgatctgtcttttctttcttctttccactttattttgtactttccagcggtgctctggtactttccaggtcagacaagaaggagaaaagcttccacttagatggtacaatttgtggttctcacatgggtgttaaatgttcaacatgatggcgtttatccacatactgctgctttctctcatggggtgcattgagttctttgaagacatcttgccccctagcaggcagccttattgggtgtgatcctaacaaccctattcaaacctatcttcatgaccacttggttcacagtaaccatttcacattcctgggctgccaaaatctagaattataggatattctcaggaactattatttattgttcttcatttgaagtttcctcaagtagctcagtatgaaattgaggtattctagaaaactccgaaactcagtacaaggtgtgataggtaagcatctgaacttctctatagtggttgtcttgctcctgtccttatttaccttgatgaagaaataatatccccacttctctattgacagctggggttggagggagatgccatagcaaatccatcttctaaactgacaaccttgttttaagacagcattacttgtgcatgtatgtatatgagttggaggcaggcaatgagaaagagtcataaaattggtttccctaattcgtagcgagactagttttcttcagccactctcaattcagcatctgagattacatgtgactcattccaagttcagaaaacagtcgtttaatgtcctcttacaatttcttaagttgtacattaccttctgacacctacaaaggatcctgctctgttgacatttgtattttcacagttcttgtccatgatggtgacttagaaaattcccttgagttcaaaaattatggaagagacacaatggaatattattataagatgggctggattagttttatctgggggtatgtgaataggctttgtatatatttcttcttgccttttctttctcccctttttagcaacaaatcttatacaaagattattttacctattctttgcatttagttcattgtggatccatataaacaaagggaatatgagttgagataaataccattcattttgtacactcacctcctatcttcttgactattgccacttacaaggaggtttataaatcagaaaattcttacatttcctgaaatatcctagcaatctctttcagaaattcaaataggtattttgcctagatttccagattgaaacaaactatggcaaaactgaaagcataattcctttggtactaccaaaacaatattattggaatatccaagaaggatattctgtttcaagattgcgtgtgtatagactcacgatgaactttcagcacttctcatagaagacttcaccactttctctttttcgaatctaaacagaaaataatattaagtaatatttattgattataattccgggtactgtgatgaataatcatgaaaataaccttaagaaacaggtataattagtatctccatgagacaatggaaatacacgttaaaaaatattttcagccaagcaattagaggggtagaactaggattcaaacccagatctttcttactcccacttctcactcccacaagaaaacctttaccgtttgtacataccactttatctaccctaataagaataaaagcattatgtaaactcttaaggaaataacactggtttttctgggcgggttgggggatggtgggcaaggggaactccttcaatttaactctttctgtaaactaagcctgagttagaatcaattaattgaaattttcctgtgctacatacttcaatttgagtagaaaaaaaaattattttttaaatgttcctcttgacttctacctttgctatataaactccctcccttccctcttttcattcttcagcacctttctttccaaaccaattgccagataaccattaagctccaaaattgtatggcctgtcccaggtctcgaaaagagctgtattttttaatgagtggggtaagcgcttactgtaatataaattggaaatttttcaggtaaaaaaagattggtaaatgatttcattacattttattttagttaaacgctaattaaagcatattattagtgtgactcactttgttcaacctactgagaagtcctttgatattctgccgtggctaaactaaggtagtacactatatttttttcattctgtgtttacaagaatgctttcaatgtttaagaggaaaagagacatgagtttatatttcaacatgccaggtaagacttaaaacagctaggcatttgtagcttgtggataaagtatcaattacattatccactaatggatgagctttgctcagaaagaaattcagaagaatcagacttaaacctgctaaccatatgtataaacttgattctctaagctaatatgctcaagacatttatcagtagttgactgaggaagaagagtctagctgcttaatcctggattcaaattttattaattatatttaaaatatattttgttttaaagtaaatatgtatttctctggactcagcaaaagcatttattagatatttgattatattaattttgtgcttctagcaagaattatagaacttttacaccataagcgctccgaaagattaagtcaaatcccttcagatcaggaatatgttgttttataaagggatataattaaaaccagtggactccatcagtgcagagataataactgtgtgccaccaacttgaaaagaaaatgaatgtacatgggtttcgctgattagctgcatgtaattaggaaatttaagccaattggaattagagtacccaattcaaacactgtgcccatgacaacaaaacactgcgtgagctgcagctattacagcctaaagttttccattagtgaatccgattatatctagtaaactttttttaaaatttgagtagctgttacttatacacatatgctattaaaacatggtgagccataatgcctctcttgtcagttattgttcattaaaattggaggtaaggtaagagaaggatgatcttatttctttacattaagttgaagatgggctatcttgtcttgaaaataaattagcagcagtaagaaaacctcacggagctgatttcaagtagtaaaacaaatgtttttaaaacttagatcattagttgaaatttgaaatcacatactttcaaaaaatgaattaaatagaagtgaatcaaatcatagaagaaagccctcttttgctttcttagtttctcaaaatggaaattttccccaaaatgttcacttgtttttttttaattttttactcacaaagttaaaacttttaaaaatctaaattggtaaattgtttttttaaaaataaaagtatcaatggatgtgaaacaatactaccaaagcttcaacagttttgatttcaaatagttactttgttttattctattaatatcttttaaataggcttctagatgttgactagagagcctagagcctactctaaaactgtaatctagagtttctgagcatcctttttttttagatgatgttttagggttgaacaaagtagaaaaggatcttcaatgcctagtctttccacagaaacttatgatcataggaatgatgtcctcaaagaagaggattcaaagccctaaatttagagtacagatttagtccaatttaatagacaaagtactgggtctggtatacattacccataatgttatttaaatgtgagttttcagagataaatgtgaggagtgtatgtgtgtatgtatgtgtgtgtatatacatttaaaaaaacaaaaatactaagagaagcagtaatggcatgatatcactaaattattaatatattttatccactatttatttgactatgctttgatggtcacaatattcagaagtctgagattagcaaaaaaggcaatgtttgaaaatttggatccctgtccttttacatatacagttaaactagctccattcttgtgtgtcttacccgtaacattgagcagaaaataaatttagactaatactacataacagtggtttttcagacatggttataaggcatactgatatctcacagtctgttacatgtggcaacaactatgactactaatacgtaactcaataaatgatttgtttgctgttcatataaattaggtcatatttacagttattgctctaattgcatcatttttctcagttgaattccatgtgatttcttgaatgagagaaaaaaagggtatccaattccatgcaattctgagggaatccgtgagatgaactccacatatgaataatcctcagtatgtatgtaacagtgaaagaataaagattggtaactgctgctgcataatcctatattggtagcagctgcatgtgcctgagcaagagaattgtgttcatggagaaaagggccaaacgatactgaaacgtagaccctgacaaaggaaggttatttatttcaatggagccaattatatattcacaggttttgctcaccctcttttctggcccaaggagaatttgttttcttcctttccaggagtatataaattccacttcagtttttctggtgtataaaaggctgtgtgaatacctaccagtaattaatagcctttcattccaagtaagtaatatataggagtgaatttattgtttatgagtatatcaatatcgtttaaaaatgatatgccggaatagaaaggcaacactgaagtgtaaaattgttaatgcaggctcatagcctgtaaaatgatttcttttaatagttttcttcatttaaaagttcttcatttgaaaatgttccctttcaactgcagatttcatggtttggtgcaatgaaggggaaatttattcctttgacacatttattcttttaatagttattcatttgaaaaagtttcactggttgcctataaattttgcagtttgcagagagattcattcttgacagattttttaaaatgtttattcatttaagtagtttctcactccatggaattgttgctaaggtttaacaacaacaaaagaaatgtactgaagcttcctgggggttctggtaaggcagtaatgctaatcttgacctgtggatttttcagtggctctgcaagccccgggataacaaaaaagagtcacgtcattagcaaagaggataacagtgagcaattttaaggacaaaatttacctaatcattattagatgttcttagctatagtgttaattattatttagaaatcactaccacagagcattttcaagaggcatggtgcaataagtggtcatgaaaaaaaaagtgtatcaaaatctgccacatagatttgaaagcagggtgtttctgtcaccaatattttgttttaatctttaatatgaccattctgacttcaaacaaacttctgacttatctcaggattttatccaacgtaggttgggagtttttttctcctcactctccacccatttttatccacagttccgaagacagcacccaccaatgtaagcggaagaagtggaagaaggcatgagttagtcattgcctgggaggtaagaaaaacacatcctctcacaaattactccacgtgtttgtttggcttagtgtgatatttaattattttatgattaagcagtccacttgattcatttagaggctaaaaacagtgggaggaaggaatgaaccactgctgaataaatgccacgttaccctggttatctcatttaacccatacaacaatcttatcagttggaatgattttcttcattttacaaatcatgaaactgaggcactgttacatattttcctaataaacagaattgtgactttgattacaaaatttgtgtcattttatctatctcatcatatgcctccaaagtatcatttgtcaaggaaaaagagtggagatgaagggggagggggtgtgaagaatacatttattttccatgaagccaccttccttttttgatgttaaataaccttattattaaatgtaaatagctcacagagatcttagaatatatagaaatggaaatgcctgttagagtaaatagagcaactccttgacaatctctaagaacaatgagaaagtatacagagatctctttttccagtaagaattattccatgagcacataatctgtcctattttttttgtccattcccccttttcttcgataaaacttcatatatttttttgatgtctacagaggtattaactttccaatagctgaccttcactgagaccagatctctctaaatggaattgcctttccatgtaagctttaatataacgggctttgtttctttgccaccactcaatacatggcttttcttcatatcaaaattcaaggaaaaaaactacttagcaaatatttattgagtatctagtgtgtgtgaagcactgtgctagacagtggctggtaacttttccacattgactggtcaatcacaattactcctttctatggtgtgcagttgaagcccatgtaaccaatttaaatctaagccatatagcacaagaagcttcttgaataccatagtccaactttttcatgtcagtaaccataaaagcaattgcaaagcacactacaaaaaaggttttaacatcattatatcttacttttgtggtctaaagggttctgcagagcattaccagtgacaagatattcccgaccaccagaccataggacaattttccccaacatgttaatccaaagatcttcatttcatatacatgactaattggagcaaatttgtttcacttcaaaagttttcaattctcttgagagtttttgtacatttcaactgatacaatttttcttcttttacctttaaagctttttaactttcaaagaagtgccaaagtgattgtactattttggcttccaatgtagtataaagatttgagattctccctttctctagctatctataattttttttaattaagaatttggagaaagtggatttttaatcaatcattttgctgataattaattatatttttcttctttagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggaggtcagtttttttattcctattatttttatttaacattttactttgttatacaaataatcagacacctttgtacacatattagaaaatacaaataaggcaaaataaactcattcataatctcactaaactttttggatatatatttcccaaactttttttaattttttaaattaaaagttgattattccacatatgttgctttaagtttttcacatcctaacaatatatggcaaacatatatccatgaaaacaacaatatcagtaatccctgcagtgtattcctttctctgggtggacattaagccaatcctctttggtttgaaatttagatacttttatatttttcaatatatatgtaaagtagatttaaataaatgcttcatttatgtgacaaataaatatttatttctaaccctatgcataaagcactgtactaataaggaagtttcagacagggctttttcttggaaccttttcaaacacatcattaaatcctatggaaatcttatgaaatagacattattgcctccgttatgtagaaagagaaattgactttcggaaaagttaaagaacgtgctaaaggttacactgcttgtaactgagaattaaatccaggtttgtctaaccactaactccttgatttttgtataacttgctgccttcatatgcatgaccatgtttaattcacaagatagaactcataggtaggcagtaccgagtagacaatatacctattttacagatgagtaaactgtaaagtggttatactcaatacatgatagagctacagtggaaaccctgcttcctacatcaaagatactgaattatttcaagttttaatataaaaatgcaattttctgggtgaaagtataataatagatctagccccctaaagttagcttttcctcttagtccttcttttattcaaattcaggatttcagttaaccttacaagtgggggaaaaaaatgagaaaaggaaaagacagccttatgtttcttaaatttacaaatgactgagaaaatgttctaccaaaggcagcattcactttccccataccaataagtgtggtaaatataaactaacccttatacttcctctgtgcccacatgtaggacttgaacagctcaagagtattattcataattaattattatatccccccatgaagctatgagcttcacgggggatataaatatagtcatgtgaatatttaaaaacaaagataatgtttgatttaaggaagatgtagtttttcaatagtaagctgcctcatatttttataatatagagccaaattttaaagcagaatcagaaagtttatcttagcataagaataaccagggaagtgaaaaatcaagtaatggcaaggaactagaggtattctgatgagataccaattgcacttagcatctcagatttctgatgtgttttcagataaagtccatataccatgttacttatgttatctaatgtaaaggttaaaaccaaatatgaaattggaatctcaaaccttaatctacatttcaggaaactgagtctcagagaggttaagtaacatgctcaaattcacaccagtaagtgacagttacaagaaatgatagtaagtgacagagctaggattttaaccaggtctatatgactggaaagcacattttttaactactacactatactgcctcatcaggaatgtacacaatagtgatattttctattatttattgctcaaaagatctattttgaagtatatgtgttattcagaaagtacatattctttttccttttaaaatgttggaaactaattatcaattacatagcaccaaaggtcgcatgagagattaattggagaagtttttgaacacgctttgtatagtaacaacagtgctgcctttaagaaattcagctttgtaatttctttgtcaatctttgctttgaaattaatttatagcagccaccatgggtttttttacattgtgttttcttaaacttgaaatggcttgcctttggaaatttctctttcaagctagatagaaaatatgcatattttcttttaaagacactgaggttattcctgtaacatatttcatagtaatgtaacacttcatttattttaatcaactgaaatatgaaatatattaggcaaattaaatctggatagagtcctttgttctgacactgaaattcaagcatatatttggcattcgcttactaattaagtttacaaatgtggaactttatatgtaaatatgagtaaagtgttagcatcattagagtgtgtcaaccaagaaaggcaggacaagggaaaagaaaagcattaacctgagctcaaatctgatcacactaactagaccatcttgggcagtttattcacctctctgaggcttagcttcctccactttaaaaatgaaggtctcaaaatagaacatctctggaatcctatacaaatctaaaattaaaaccctgtcaatttattctatattctaaaacattattttagctggagcagtggcttatgcctataatcccaacacattgggaggttgaggcaggaggattgcttgagcccaggaatttgaggctgcagtgggctatggcaatgatggcttcactacattgcaaactgagtgaaagagtgagaccttgtctcaaaaaataataataataataagtggattaaaataaaacattctttgtaacaattgtcctaacatagatagcaataatagatcaacttttgctatacaataaaaagggaaaatcaacattcttttttagtcacttcgcaatttgctttacttaaaaaggagtgagcatttcaaaaattaaaccattttaaaaaagagtaaaggcctgaaataaacttgtaaaataatatattatactcttgccagtgcaggtttctcccctcagtgtctatggatgttcatacagcttcacagtgtgtcttttatcattatactcttgcccaaagcccaactaatctgagcgaaattgtatttctccaaaagacaaatcctgcttccttattcttccattaacccaatccacttgtttatcaccttgaaattcctccacattcttagatacagtaaagaacaagaggagtgagactgccttactatttctgtttatgggcttagttcctcctcttcctttcaagcttaccagatacatgccttaagcactgtgaaaaagccaccttttcacagccgacaccaagctgggaagaaaaatgtcaaatgcagctaccagaatttatgttattgggagggaagcagagaacagaaaaacttacaaggcacaccttacagtactacttctcaacctatttcccaatggaacatggataatagatgacattcatacccagaacatgcttttataagtgtgtatgtgcattctccactctatccctttcttttcctcccaataaagcgtatcagaatgcaaataaaattaattattttagagaaaaccttgaattgacatgtttttcaaagaaaaaatcatttgcaaatgttgatgcttgatcaataaatcacttgggatatgaccttaactctcacaactctgaggtttactattgccctagagtactgtcagaaaaagtttcaaatggtttttctgctaacacccgtaagcctttgaaacctttcaatgttgccacaagagaagcaaaccttaatgactctgtcagtgccaagcagcatctgacataagccctggaaaaagagatatttgcctgccaagatatccatgtaccctgtacatgtgtcaaatatctttgtcctttaaaccgagcaaggtttatgtgcattcctaatcctgacttcagacctctagggtatgatataattctatacaacacgctaattttggaaacaattccatttttaaaaaaaaagaatagtgaagtttcaaaataagttctcaaaatgcatggtaaaactgataaaaattaatttttttccaagataaaaaattaaattggctttttcttccacatttcaagaaataatgaatactcaaacataccattttccacttagttcttctcaccataacttcggaaatgaaaagaactggagcattcaattaaacctaatagaaaaacagaagaaaaattgatacagttaattataggttgaaagatttatttacttgtgatgcgctttatcctttatcctttatcctttctagttttcttggcttttgccttatctgtaaaaaaatgtcctgctcatatatttattaaacctaaaaagcctgtcctcatttgcagaatataatagacaattatctcattgcaagtggagctaccacagctcaaattaaaacctaatattcctaaggtgttattctccagatccatccttagctgaaactgagctcactgggatttatgtgaacttgaaaattaataaattgacatgttagttgtaaaatacaagaaataatttcctgtcttttccagatgatctatttggattagtgcctataaaagttcaactacagctgtcttcactgaatttttaaataatgaaaccataccctttctctcaaggagtttattaaagtctcttttgattaatgctgttgctctaagggtctcttgggaagggatctcttggaaagtcagatgtataatcaatattacaagcacatacccccatattacatgaagaactccagctgctaggtcacttaatacaaatgtatcatcgaaattcatgaacacggtaatgctgttcaacatttttaatctatcagaaacaaacgtatcaatcaacctgtccactacatatcccaagattacagtgaaggagttagccatggcctaattaatatcatcacaagtaacagaaaaaaaaagaggtttccctctaagtctttgattccactagatataatgctagtacagtctcagaaataagtttctaaacttttattaaattaccccagtgtaatagatgggagtgagagtggcagaaaacatactgtgatttagagatcagaagagttttagagatgcctgaatgtgacatgactgagaaggagctgtgcagctatggttcaaaattaccaaggagtcagtgaaacaggaatcaaaggagttaatagtgagcctgtggcagggttaagtgggtgatgacgggggtctagatggtttctggcaagatctagaaatagcccaaatggggagcccaacacaaacattcttgagagaagttagatgtggagtggcaaggggaaagagagaaatagaaaaggaaaaagcatcaggtaagtgtaacatagacataggcacagaagcagaacagtgtagtgctcagggcctgactacctgtattcaaatcctccctccacatttaagcagctgtgggatcttgagtaagtagcttaacctctcttctgcttgatttcttcatctgaaaaatgctagtagtagtaatatggttgttgggaagactaagacatggaaagaattaagaacagggtttggaacacagcagagcctcaataaatggcaattattagtatttcgagttatccccacatctattttgcctcttttttgtttacttctaatcttattctatccattcctctgtcagttatttggaagcaaccaggcaacaaaagagggaactatctatgttttctgtaaaacttattctgtgacttaaaatggaccctaggagatgaagaatgagccagcctctttctttatgccaatttaaaaacagaggaaagagcatttgagacccaagttctagctttttcacagctgaaagtagagtctggataaattaacctctgtacgttttacttttctaatctgcaaaatgagagcatggatttaaaacaggtccattactccaaagcacataggagtgaggtaagaaataaaaacaataaagtactccttgtgtgagacaattgtgagtgggaggaactctggcatatgtagaagcacatgcccagactgagggagtccaccactaaccctcatcggccaacactcaagaattcaggcttcatactgtctccttttatcccccaaaagaagccagaaattcttattttcaaatgttggcttaaattaatctaacacatgatgtagacaaacaaaatatgactaaagacccactgcccctgcatttgtgactttggagccaagtgacttctagagtcctttccatttgcaactttccatcattcagttacaatgggatgcccaaagcgaatggccagtttcaatgcaagccagatgttctgtgatccagttagctacttgtgtctgcagaccaatttttgacccagttgaaaatgttcacttgggtataaatagtacatactaaaatttctgggaaaatctgacagaggtcactatttttacatgctgaaatgtctaattcaggtcaacatagatcaacttctgataccattcagggatgttcaatctttggcttccctgggccacactggaagaagaagaattgttttggaccacacataaaatacactaatactaacgatagctgattagctaaaaaaaaaaaaaaaaattacaaaaaaaatctcgtaacgctttaagaagttcacaaattttggggggggcacattcaaagctgtcctgggccaaggctggacacacttgattagattaagagggtgaaaaaaaattaaaatgattcttcagttcttgtttgattgattcactgtcattcagttatatgaaattataacatgcagctccccaaaatgcaaatgtgaaatgtaggtgtggtatgaccctgatttaaaatccttagagcttttaaataaaagttaaggtgcttgtttgagaggcaggttcctgaacatttttatttactttaacatttttttaaactttctatttgagaaatacttaaacttgtacagtactactgaaagttgatagagaaataattcctttctttggagataaagagatatggaaaggttgctaccccaccacatgttttgtgcttctgaaattatttatccccctgcaatcttctttgacaaagatgtaattgcttcagcaatataaaagctgaaagaaggcatttggcacacaaatctctgtaatgcatttattctgaagagaagtaaaactgctacggaatagcaaacgatattcaaagtgtggtttcctttcaaataaactgtatcctaaatcccagagatcaagttgtacacacctcagaaacatcaacattctttcatttacttgcaaaatcaagaattttaactcccactaaatagcatggggaaaatgtccattgcaagtctggtaatcagaattctagaataagatagaagatttttccagaatgcatgttttaaattggacagatgcacaaataatagggagttggaaagtgagatgagggaaaccacggagcaaaagaaaataataaaaaatattcaaaaggtgacagaatgagaaatttcaacttataccatggcaggaattaatgtcagcttctgtgtaaaaattaatgtgaatttgccaaagcactttgagatgacacaattatagcaagtgtttttaacaaaggtttggccaaaagaaaatcattgcttggtgcaaaggtggaccaaccaagtcttttgcaggctccttttgcagtaacagggtagatatttttgactgatatatttcaattaataatatataaaagcgttccagacacatgtatgactagcttctttcagaaaaggaaagacctcagaaaatgattatgtcttcaatgttcgcctcttaacatttttatttagaactcaatctttgctatatggttccataaattgaaaaaaaaaattcatagatgaagctcaactctaatcagtgataaagggttagtaccaaaatctgtaccatttttatggggtagaattttaatagactttgtacagaactgtttgaactaatgtatggcctttattctgccatttcatttaacttgtgtttgtgacacagtatttatgattcagccatgtcaacactagaaatattttgttcctcacatcaagtgcagcctcgaataaagtacaccttttgatggatgccagtcagaaattgtgtatttcaaaaaaaaaaaatagtgtgaaaggtcactgaatgtagaaacaaatgaaaaggtggttttgagccacggcactgaacccttcggggacttttctttcccacctgcacctgtcttaaaagtcaatgcatgccttttaaatatcatgattcataacatattccttatataatcatgaaaatgtagtcttgtggttggaacaacaaaaagtatctaatgaaatttagatacacagaataaaaatttagatgcacagaataaaaaataaaataataataatatggtattttgtgaatgaacatttttaacgccaagcacagtactaaatattttatatatacattctaattaaagccaacctttaaatctatgagataaatactctcattatagtcatgttatagatgagggaactagggcttagaaagagataaaacaacttacccaaaggtaaataaatagctaaataaatgttttaaggccaaaagcaacagcagtgcaacaacaaaaaaaagcaaacactgactccatagtccatttttataggaattatgctagactggcagaaaatttaagttccccagaaatgtcttagctaatccaaggattaatgtctttgcctgtcttgctagatttgtcatttgtcattggtaaggtattgatgagatttgacccaagtatagaaatccaaaaggatcacctttatattttgttgtgttttttataactaccacagcacttcatttcaaaaataaggtaagaggaatttaacacctgacagactcaggcgcaatactttgatggacataaactttttataattgtggtttattttccttcatacagaacccagtgctgctcccacagatgtcaaggcgacaagtgtgtctgtgtcagagattcttgttgcatggaaacacattaaagagagtctaggaagaccacagggatttgaggtatgaacagaatgattgaaaataagccttattgtttcttctgacatcacattctcctaaagagaggttttggtgacacctcagaatttcaacagaatttcttagaaattttgctctatgttaaagaaactaagaaatactattttactgggatgtgttatgttgctcattaactggtttatttttcagtacagtagcttccgtagcactatgcaaagatgtttttaaaagatgaaatagagttttagacaaaagcaggagctacaggtagatatttaattgtatccaatttactggtcattttaaaagtttttgtgtcttcctttctaataatttaatgtataaatacaagttttccttttgtactttattggtatctcttaccctcagtgctgaattatcaaattttgcttggaatttaatgatctgtattgtatctatgtattcagatagtttttttggtcccttaaatgttgctatttttaaacatagttattccagccttataatggtgaacatttcatatcaaatgaataacatcaatgaaattttagcctccgcagagaatagcagattgtgagtagtctgtgaacatgaatattttatgataacaaggtttggcttctcacacagctcttgttcttgttcttgccttgcttggccagtcatggagaggaattagggggataatgtctaaaagaaaaaaagaattagcatctgacccaagactttagttgcatttaaaaaaatttattcttacttttcctctgcttcagttcccattaagagaaaatcatcttgtgtcttgaacaatgatcaagtataggacttgtatactaacatggtttccaggctgaaacatatttttaattctatttgagttttcaaataatgcccaacaattatttgattaacatacagctggcattaaataatgatttctatgataaaaaaatttatacaatctttctaagagttacagcaagaacaatttatgggaaaccattacctacttatacaatatcatggacttatttctacaatcttgcttcaattaattatttggaatgataatttagtatctcattatgattgcatgtttaatgtgatgaatatttctgtttctcccaatccatgcttcagggaccatgtttgttcatcattaaatctcagcaaatgataatatatatatttggcccataactgaccacaataaatatgttgaatgaataaatgtttgtgtggcacaattagcccctttctatccaaccgtagaagacactgtggtggtttgtccagtttcccttctctatggaggagggacacgtgcctcctccaactgctgtgagtgttgactgctaatggttctcagctcccactatagataattgccctccactgaggagagctacattgcttggaaagtgacctcgccacacttagtcagcctaagatcaatgactgactgatacttgtctcttacctcaaggaggaaagaactttatggtgtagtttatgatacagagccttgctgcgtgcatcaggccaaagccagatttcctggaaccacattcttgctcagctccccattctgagttcctccctttttaaacctgtaagcatcctcacagtaaataatatgcaccaaaatccctatctcaagctctgcttttggggacttcaactgaaaagaactacattagtgtgaattcactctaaacctctgaatcggaacatctggggcagacgtctggtgtgcatacctttcagaaagccacaaagtatattctggtgcacggaagagtgacaacccaggctcctatatctcaaagggatgttccccttatatagccagtcaccctcaagctttttttatacctgccctaatagcatgacactcagataaccattatgattcaccgtgttgacatctctctgtgaggtcctgcaaagatcacatgtgcacaattcttctcttcctaaatataaatcattcattctttaattcaataaatatttatgtagacctattaagtaccagacaatgagctaaatgccaggaacaaaccaatgagcaaaacaaagtccctgctcttctgaagcttgtattgtagtagggaaggcacacaatcaacaagctaagaaataagcgcatgattttttaaaaaaaatatgagatacaatttcagttgatgatacagactatgtagaaaaaatagggcaagaaggtaaagagagagagtctgatattttatagaggtttgagaaatcaacctttctgtggttgcgacatgtgagtagagacatgatgtaatgagagacggcagagagaacggcaagcccaggagctctgaagtactagcgtgctggacttcttcaaagaataggaagtgaatgattttggtgagagtagggagcacagggagagtgggagcaggatgatgatgaagagattagcaggacaaggaacaggtttctggggccttaggaaccatagaaagaagttcagatttcatccaaagtataagaagtcataaagtatttcaaactgggagggacaagtcaagatctgacatatttaaagcctctctcaatctggaaggtagataatagaccctggggagggcctcagacagaagagcagaggggcagctgttccaacctcagtgacaatgaggttgctttcaactagagtggtagcagtggagttgataagaagtggaccttttaaaatatattttgaattgaggtgagacagaatttgacaataaattacatgtaggctatgaaaaagatgagacaaagataattgcagagatatttgacccaagaaactaggtaaatggcattgtcattcacagagatgaggaactcacaaagaagagtgggttttagagtgaaaatcaaggattctgtttcgggtgttttaaattttaggaactttttttatttctaaaaagagttctcaagcaggtcttaagttaagaggaagactggggatggaactataactatgggaaatcataaggttataaatagtttgtatgcatataccagctaagatcactgaatatttggtaaagaaggtgcctgagaattgagctctggggtggcccacaatttggaactcaataaaggagaggagagggtctggctgaagaaactaaggaggagacactgaagaaattcagaagccaagagaagaatttcaaaatggagagaatgttccatgctgtcaaatgctgctggggaattcagaaagatgagacctgagattgccagatggattcagcaatgtggagaccataagtaaccttgatgagagagattttatggaatgctgataatgaaggcttaactggaggttaagatcaagattactcaagagtgacagtcaagaccatcagagcacaatgttttcactagatcagcttcattcaaaataacttattgcaagcaaaaatggaatatatttgaaaacagaaagttaacaaggatgaatcaaattctgaaataatcatcacaatgacatttttgaattaaaataaatcaacgaaaattctgacaatgactttatacaaacaaaccgggacagaattcatggacatagtaactattctatttcatagcgcattataaattgtagtttcaaaatatggcatcttgttaccagaaaataaaaatcaacatctcattaattgtgaaattctttactttttataaacagaacataatgaaaactttggctaaacatgacattaactgttattttaagtatattcagtgaagactatttttgatttatactgtttcataactgaatagctgcatgtagatttaacactaaatatgatataggtgaagctatcaggatctctcttttcctctcttttctgtattctttttccctcgaaagagagttctgcctctgtccttcaccaaacacatctggaacttactgctctcctcttctccccacttatttttctctatcaaaaatgtcacttagtaaaagatttccctaattattactaaaatataatgaacccataaagcttaacaattttgtttacttttatccctctttttcactctatccctaccacaattctacctatatttactgatggtcgaattcagagcatggtgacaataaaacaaatattgaaacaagggcatttgtcatcaaaaccaaaatgatcaatttcacattttatgtacttataatatcagtcctatgagtcacttttctagccataattttaacttcacatgcaaaatctaaaacagcaagctactacaaaagcattaactatgaaccactttgaaactagagaagacagtgttttcagctgcccctcttatttttcctgaatcagaacatcaataagatagataaggttctgatcttatgaatgttacatcctaatgggggaaaacattttttttaaaaatcaaggaaacacataagtaataagataaactctgataacaatacacatagagggtcaaaggtatagcaaacctggttcctgtgagaacagaaagaaagtgaagcactgggaaattaaaatagtttgagggttgggtagagacaagatatgtatagatatatgggttatgaaaaaaagtttgtcttttatttgaagtgcagtagaaagccattgagacaatttaaggagggaagtcacaatgtccgatttatgtttttcttttttttaatcactctggctgctcttatatgaagaatgaaagggagaggaaagaaaggtcagagaattgaagttaagagttatcacaataatccaagcaagaaatgatggtgacctagacttcagccaaagcagtggagtgggagagaagcagatgtattttagaggcagggctggcaggatttgctgattgatctgatgtggaggaaagagaaatgatgattcctgcatatctggcttggacacataggtaaattgtgccatttacaaaaaaaaaaaaaaatgaaggaaactgaacaaagaacagatttgaagctaggaaatcaagagttctatttaatcacattgaatttttgatgcctattagaggcatctaagagggtaagtcagataggcagtagaacatgccagtttggagtcaaattgagagaacagggctgaaaacatagagatggccattatagaagtggtatttaaatccatgctaccataggaaagcatctgaggacaaaatttcaagagaagaggagagaacaagagcagaggggaatgaggagggtcctgctgtgtcctggcacactcagcatttagaagttgagctgaagaggaagaatcagcaaggaggctggcaagaataaatcagttttgtagcaggaataccacgtatgaataaaaaaagttaaaggagttgaccaaaaagagggaactggtcaactatgcttaatgctgccaagagatcaagtgagataaagagggaaaagtgcctgtttggtttacaggttattggtgataacttccacaatcaaataaataatcaatatcccttatgttgtcaattagtaacttcaagttgtagacatttagtaaccttaataatgccactgcttctaaagaatggttggtggaaatagtttgagggcaagggaacgtcatttcagagctctcagcccatcagcaccttacttgatgtggaatttcctgtattttgtcaggacaccaacaggttttggtattcattcttgtgttgagaatcacagctctccagtgttggtatcagaaatggttaagagcaaaattcaacatctgaatatatttttgcaccacatattataatgtgagtataattagccactgcagaaaactcttttagcctcaaaaagagtgaaaagaagtcaaattgagactttaacatggtgtttcccttgatgtaccaggtattatagagcaggtaaattagaaacaagatatcatttctgaagtcatgtacacagatttatttccttctagaatatgttttctgtcaagtccatacccatgttccactttgaaattgatgactgtatccctggaatacatagcgtggtgttaactagtaacacctcaatgcattttccttaataaataatcaaactggaacctatttgtgattcacttgtctctgaaatctttgtattttcttctctactaattgagggaagctacacttgagcaagagtcatttggagagaagacggcatcattaagggcagtaaaggccttaaatctctaacagccttacctgatctccctcctgcaagttgctatcattaggctctcccttcccacttctgactgcaggttctcctgatttggctgcagcctgactctgattctgaccctaagttggcagtcaaatttcatctcacatttccctgacctggctttctgtatgtttcatttgaatctcatttattatttatttaactagtatttattaaatacctgctatgttttgatgcaatattcaggctgaaacaataaatacaactgagttcctgaccttatgaagtttgcagtctagcaagggagactatttctgctttcttgaatttttgtattttgcttcaatcctcaactagggtcttgatcctaacttctggtagctccttttgctgataacttggttttgataatcttttccctgatgcagtcctgcagaacagcagtaaggatctcagtcagaggcttcccctggtagcatttgtcagtaatctacttacacttggcattttggcctttcgcaaggaagcttccattacatcttaattggtttaagaaataataaaccaagcattttgacttaaacttttcatttttaactaacccaacactttcaagtacatgaaacaattcaaatcaaatagtgattgatttttgttattaaattgatgaattgctttatctaatagaatggtcatggcaattaagatgctaagaatagttttgcaaaagacaaggtcagaatgatgacagccagacaaagtgatcaatggtaaggggcttgaggacaatttagcaattttatccctttctgtttctgagtggatccatctttagacattttaaaaggtaacaattaggctacatgagaactctactgtacaaagaaaaatggtggtcttttcctttcaaccagctgcctcctgaaagaatggcagtacctcacaaaaatgaccatctgaagaaataagaaaaaaaaatatgaaattccaaatgtagacattaatccatctatttgtatctttcaaatatttgagaaattttgtcaacatccgcttagaaccacccatttgtaaattttggttacctacatggcattagcttgaaattttatggtagcagggactaaatgtagaaagcactgacactgagatatgtgaaatgtctagcttatgatatgcagcatgattgaaaattgaaagtgggctgtatttactgaacaactttgattcatgaataaccatgactgtcccatctggattgccatctctgtcactagcccatacaagtaaattattaggttcagttttgaatttatgaacccaccagcattaagtgtcctgtgtatggtaatctctgaatcctagagcagagtccctcaagcttttcagaacataaaaggatttttatgtgcatacaaattcagagaagatgccagtctggcaagaagggagggtaaaggataaggccaaatttcataatcatttctgtgattttcccagatcagcaaaacagacaaagtaaattgtgataatggaatgttggatgattcatttttttcactccttcactcatcaagcatttattcagtatcgggcactatgctgggcaatgggaatgtacatataaataagatctagtccttaccctcaaaaagctcacagtctaatattgagggaggtttatgggaagttgaagtaaacaaaaaagaaatacgttggaacaatataattctcgtgtctataattaccccaggatttcttagcatcctgatcctctgaagaaacagtgtgaataaatctgtgccaatgccttacatgggtgtaagcttctctgttttcatgagaatatgcttctgtcctgaaattttcctttattttctaaataagtcaacaataaaatagttatattaactgaataaaataaaaatgaaacttttttcactagaggtaatttttaaaacattcatatttcatattctgcctgtggaacaaagtcttccatgattgccaagtttatggtgcttgtattcattcatcccttcttgtaagataattattaactgtatttttatctttttaatagctggactcattttaacaataagcaacaatgtattttgtagcaggagtttaagtgcacactgtcctggtttcagttctgaacattttagtgcttattatcaagaaaaaacaaaagacaaaacagcttgtcccattttacaatactcactaaaaggcacctctagcaacttctttgtttgggctacgtgcaaggttcacatgtgttcattttaaaccttccagaggatatgcaactcagaagttcattttagacatgtcactaaagccatttccacttattgattgcactgaaaggacagcaattgtgttttgctctataaaagatgtcgtggtggggattccttcaggggagaagcgacaaggctgttgttctttattttatgatctgactctaatcattagagaaggagacaaaataaatgggcctccctgttctctgacaataactcatgctgggcagattgtatttactttgtatgggggggaggaaatgtatatgtgtgaagatggactttaagatacaagtaaaaggggaaaaagaagctaaaatgaagctagttaccagaaagctaacaaaggttgttttattttccatatgctgtgtgggtagccgccattttacagagcctctttggctttttattaatactacattaaagtaagaatataagaaactaaacaataagaaaaaataaaatgccaattttatcctttcttttctgaaattctgaggactctcatttaaatcaaagagcttttatgtcactatcattagatttctttcttggcttattttcatagactctgaggccaactaaaaattacgttttctgaaaatcatcaaatcaaaagcaaattgaagtaatatttcaattgtttaacctgttcttttcttgtcctattgaaacacaactctataatttttatcaaaaatagttactcactttactgtgtttttgtttcatttgattctagatgcatggcttcatggttgaaattctgtaactaaaacaactttaaaattttcttttctactgaaattttgacacaaaccattttaagactcttaggatattttcctgaacatattgttgaaacacaaatggaaccaaaaaagtattgatgatatgttttatcatatttagaagtatttctcggctgggcgcgatggctgaagcctgtaatcccaacactttgggaggcccagatgggcggatcatgaggtcaggagatcgagagcatcctggctaacacagtgaaaccccgtctctactaaaaatacaaaaaattagccgggcgcggtggtgggcgcctgtagtcccagctactcggtaggctgaggcaggagaatggcgtgaacccgggaggccgaacttgcagtgagccgagatcgcgccactgcactccagcctgggcaatagagcgagactctgtctcagaaaaaaaaaaaaaaaaaaaaaagtctcatttttttcactcttcaacatgaatgtgaatttattgcaccacctctaaacaggggtttctcatccctaaacccagccatccatgagttcatcaaatgtccatcctcagtttcactgtattatataatgcacatttgcacaagcagagcatccacgcaaaaatatgaaatcacaaatgtagagagcaatttatttataattgacattgtcaattactaattgactaattgccaattagtaaagtgctgagacattattttccaaagggcaaagctttttaacaaatctgcacacagaaaagtgcaaaaattattttattttacaaatatttgaacatttttggtgaaattttctgagaacagcccatttaaaaatttctaaattgtgaaaaaatcttcttcctcttgagggctgggtttataccttaagcacctgacaatgtacttgtgatagaggagtactaaatctatgagtgttgcacagatacatacagacatgggcttgcttaataaactaggaaatgaagaaattgtataaagtgtttaaacacaaaaagaaaaaggtttacaaaatctatatttagcattgtaagaattctaattgctaattgactaaatgccaattactaaatagccgagactttattttccaaagggcaaggcttttttctttaaatctgcatacagacaagtgtacaaatcataaacatatagtaatagctgaatgaattactatgaagtaaatacacttgtctaaccataatccagtccatgaagcagaacattactaaaccccagagacccagtttgggtctcctatagtcattatccttattcttacccccaaaaaaacactatcctgacttctgttttctttttcttttctttttttttttttttttgagatggagtctcgctctattgcccaggctggagtgccatggcgcaatctcagctcactgcaacctccgcctcctgggctcaagcaattctcctgcctcagcctcccaagtagctgggattacaggcacgcaccactgtgcccaggtgatttttgtatttttagtagggatcgggtttcaccatgttgcccaggctggtcttgaactcctgacctcaggtgatccacctgcctcagcctctgaaagtgctgggattacaggcatgagccactgtgcccagctgacttcccttttttctgacagatgaaattatatggatttatcatgtacatgctttgaagtatatatacatcatacaatgactaaatctagctaattagcatatgcattattgcacatagttatcatttttaggtgagaaaatccactctcagcatttttagagaatgcaatatattaattagagtcacaatgttgagcttattgatcttacctgaaattttgtattctttgaccaactgctccctagtcccagccctcccaatcattctcaccctgataaacaccattttgctctccacttttatgagatcaactttcttagagtccacatatgggtaagaccatgtggtatttgtctttctgtgcctggcttatttcacttaacataatggtctccagattcatttatgttgttgcaaatggcaggatttctttcttttttatagttgaatggtgaatagaatttcgctgtgtctatataacacattttctttatctgttcatctgttgatggacaagatatgattccatatgttggctatcgtgaatagtgttgcaatgaacatgagagtgcagatgtctttttgacatactgatttcattttattcgaatatataccaagtagtgagattgccagattatatagtagttccatttttaattttggggggagcctccatactgttttcaataatggtggtaccaatttacattcctatcaatggagtgcaagggttcccttttctctatttgttatcttttgactttttgataaaagttattctaatgtgtatgcagtgatatctcattgtggttttccttttcatttccctgatgattagtgagattgagcatttttccatatacctgttggccatttgtatctctacttttaagaaatgtccattcaagtcctttgcccattttttaatcggttaatttgttttcttgctattgagttgagttgcatatatattttgaatgttaatcccttatcaaatgtagagtttgcagatatttttgcccattctgtaggattttttttcactctgttgattgtggcttttgctgtgcaaaaactttgtagtttgatgtaatcccatttggtttttttgtttgtttgtttttgcttttgttgcctgtggttttttttgggtcatatccaaaaactcattgcccagaccaaggtcatagagcttttctctacattttcttctagtagttttacagttttatatcttatgtttacatctttcatacagtttgcattgatttttttacatggtggaagctgaaggtctaatttcagtcttctgcatgtggatatccagtttttgcagaaccatttattaaagagactatcctttccccattgtgtgttcttggcacctttgtcaaaaatcaattgatcataaatatgtggattaatttcccggtgttttattctgtttcattgatctatgtatctgtttttataccaatagcatgctgtttttgttactatagctttgcagtaaattttgaagtcgggtagtttgatacctccaattttattctttttgctcaagattgctttggctatttggggacttttgtagttctctatgaattttatgattgtgttttctatttctgtaaaaaatgtcattagaattttgatagtacaatgactctataggtccttttagatactatggacattttaacattaatttttccagtccatgaacataggatttttttccatttatttatgtcttctttgatttttttaatcaatgttttatagtgtttaatttagaaatccttcaccttcttgcttaacttattcctaagtatttttttttttttttggtagctattttaaataggattggtttcctgatttctttttcaggtagttcactactggtgtataaaaacactactaaattttgtatgttgatttttttatcttgtaattttcatgaatttgcttatcattcctaagagttttttggcaaagtcatcagggtttcctatatgttagattatgtcacctgcaaacagggacaattaacttcatccttttcaattctaaagctttttctttcccttgtgtatttgctctggctaggacttccagtactatattgaagagaagtggcaagagtatgcatccttgtctttttccagaccttaaaggaaaagccttcggcttttccctgtttagaatgatgttagttgtgtgtttgttatttacggcctttattgtgttgaggtacttttcttctatacctaatttgttgagaatttttaccatgaaaaaatgttgaatttgtcaaatgcttttttgcatttactgaaatgatcatatggtttttgtctttcattccagtgagatgatgtattacatttattgatttgcaaatattaaaccatccttacatccccacacttgataataatgaatgattatttaaatgtgctgttgaatttgccttgctagtattttcttgagggtttttgcatgtatattaatcagggatattggcatatagatatttttgtgtgtgtgtgtccttgcctggctttggtatcagggtgatgctgtgcttgtaaaatgagtccgacagtattcccttctctttcactatcctgacttctaacaacactagttggtttttaccagtttttgaaatcatctggagctttttatgtcttgttatttttcactcaacactatgttggtaagagtcacccatattgttacatgcaactgtaggtaatgccgtctttttttttttttagacggagtctcgctctgtcgcccaggctggagtgcagtggcgcgatctcagctcactgcaagctccgcctcctgggttcacgccattttcctgcctcagcctcccgaatagctgggactacaggcgcccgccactacgcccggctaattttttgtatttttagtagagacatggtttcaccatgttagccaggatggtctcgatctcctgacctcatgatccggccgtcttggcctcccaaagtgctgggattacaggcatgagccactgcgcccggcctcgtaatgctgtcttctaaactacatcgtaagagtaccccacaagtaatttatcattctaccattgacatacattaaggttgtttccagttgggtctgttatgaataacactatataaagcaatttcaggagaattatctattttaccatattgagtctcctaattcataatcatggtatattccacttttttttaagccttctttgagctttgtcagtatacaggtcttgatagtcttttcttagatttttctctgttttactatttggtgccattttaacttatcctgtatttaatttagatttaactttgtgttatgaaaatttttaaaaatatctgatatataatatacagaagagtatagtgaatttctataaacttagcacttaccttaatctattatgaatcaatgaataatctgttttgtgtataatgccacttagtcaatctcctatattattttgaagcaactgtcagccattatattgtttcacagaacatatctcattaaaaatctctaaagtatatgctttttaaaaattgccacctctctgcttcctgagaacatgcaggttagaaaatgtcctcagtgtaaaaagctgcgaactaaaaaagcatacctaatgtaactctgtcttcaatgtttctcttggtctctgcctacattactaggttctccaatgtttatctctgagcaagcatagtttatcattcagccaaggatttaacaggctttatactcagattgtggctcttatcctttctcgcttcttgaatttctattttgtgttttcaacggctctttctgattaacttcctttgctactccaactgatcaagctgcaatcttttgccaccattgccagagggattgaagaacattcacaaacaaaataagccacaaactcacaattcttactgttgcagtttcagactttcaagagtaaactctcctctagcttctgtctgcttttggatgcttgccatgattttaaaattctcatttgggtcggggtttgtataatcatttcactcatccacatttccatcattttcttaatatctgtaagatctgtgggatattttctttctgtcagtatttatatgtcctcctcccccccccttcttttcatcactcttgattaaaagagatttacaaaatatgtgatcttttcaaagcattaactttgtctttattcattttcttaatgtttctttttccaattcattttgttgttcctgtcatttttatatccttctttctactttatttaggtttaaaatttattgctctattttgaacatcttaagatggatattcactgacttttggcttttatttttttccagtatatatattaaggctatacatctccaaaattctctcttcccagcatctcatacagactatgtcatataatatcattaactagttagtaaattttaaagattaatattcttctacctgaaagtatttcagatcaaaacttttgttctttcattaaattaagatatattaaacaatattgtaatatgtcaacctaaaaggaagaagcttaggaaaacgaatatagataaagtgttcatttgggccaagtttgaggactgcaacccaggagtatagattcaagttgccctgaatatacactctgattagtagcagtaacaaatagatttttaaaggcaaagaaagggcagcggtgggaagggagtgggctgatacaaagtcctttctcaggaattctcatttatttacagaaatagcattgattagtgaatggctatacattgtgaagctatagggttatagtgtctgatgtggcattattaattagtagctacttgtagcaatagcaagcagtttcaaaagataaatacattgctcaaaggggaagtggggcatggttgcagtctcattttaatgtttctctggctataataatcaaaaggacttgcgttcctcaaataaaatttcttttctcaatttacaggtcatctcacaaaacatattcaagtacatcagttataattaaatgctcttagaattttttctattcaatattctctctttcaaaatgtttcaataaagaatatgaagaaggcaactaatatttgtaaaagacatacactgaactacatgtgttaggaaaatatttaattatatttatagctaatcttcagtatattttctttatgcagcaataacagcttctaggaaaaataaatacaaatttattcagtaactaatatccattattatgtttcttctgcattttaaactttctcacctcatatcatctaatcactgttgaactgcctcataaatattcaaaagtttaactaagcatcatttatttattttatgtaactcattaaattgcatcctttatggtaaaattacctctgggcacaaagtaactaatatgcatgcaatttaataatactgactgccagcatatctcaaagtattgattgtgaatagccaatttaataactatatctagtactaaattcaagagtttgggaaactggagatgaactaaattgacgcaagcagggactttgccaatcaaaacaaattcaactttcatggaaaatgtgctccccacatataggattttgaaactcttagtagaaggacatgcctgatcttagatgctgtataagacaggaagaatgtaaaaagcaatctaaccactaacaggaaaaaggtcatgatattccaaaatatatctgaaggtaaggaattagtagtgaaactatgctatcagtgaaatatctgtcctctaaccctcaatttaaattagttgcaacttttgtgttagaaatgacagtaaattgaacgaaagcatgtaaaaccaactttccttaattcccccttaaagcacccatgaaaccatcagaaaagacagtcctcactgcaatcacagtgagtggtataaaacaaagttatcagagtgttttctaggtttttctttcctttcatctttgtgcagtgacccagcctcaaaatcccattttctaggttcaagcaagcaatgaaatagcctctggccctttatcttttcttcaacaaaacaacttcactcatacatatgaagctgtggttttcagcccaaacctggttagatttctttgggttgtttgaaaatacgagtagaggcttataccaacaaccaataatctggcatctccctgcacagcatagactactggtctgggagataaagtctagaaatggatgtctcaccattcaaataatccttaaactcatttttagaacagttgaagatcagtcagataagacacaaaggtgatgagactgaaggaaaatctttgaaagagaaaaacatatagaagaaaaaccttagaaagaaggaaatgaatgattagctttagtatgaattccttttcctagaaaagattttcttgtaaatcagaagaaaaattttaaatatatagttctaacctcaatgagataaacgagaatagttcttttatatttaaagaacaattcagaataggaagagaatacaataaaatcaaaatcaaagtgactaaaatattcattggaagcaataagatgtaaacttgatagtattaactatttaaaccaatgcttcagagtacaaacttgagaaataattgtagaatgcaaagtaaatcaataagaaaattttatttttaagatgtgagagaaaatggtagacgtgaaagacagaatagatttggctcatacataataggtatctgcgaagaagatagaatatatggaacaaaaggaataacagaaaaaaagtgaacaaaactccaaaaacaaagcaacaaggaaaaaattctgacatttaagatagagaaattccaatgtttcaagaaatattaaaatcttaacagccccatctttgtcactcccataattaatccatcaccaaagactattgattttatcttctaaatatttattcatccatacacatccctatatcttccaccatgcccctagtttaagctacgctcatttctgaccaagactccagcaacatctcctaaaagctcttgatgtatccacactaacccgtttccaatctgccctttatatttcaactgtttattcagtaagacaaattattgagtgcctccatctgctaccataaagcaatcatgaataaattaggataatttcacatgtgatagttgtaataataattatattaaaaattaaaatgatgtgagagagagtgactaagggaggggtggtttctttaaagaagtggccaaggaggcttcttggttaagctgaaacctatctgaaaagaaggagatagccatttggagaactgtgaaaagagctttcagtcactgggcaccaaaagctcaaaaactctaaattgagaatgtgattgaacgtttgaggcccattttgctagaaggcagtggacaaagtgagatgcagaagtatagagactatatcaggtagagccttgaagccatggtgagaagtttggaatttattctaagtgcaaaaggaagcctttttaacaaaaggaagtttttaacaaaagaaggatctaatttatgtagtttaaaacaaaaactaacttgataccgctgtgtgtatcttttcaaaacacaaacctaattgtgccacaggcacactcccagcctcatcctgcttaaaagcattccatgtgttacacttgcacataggacatttttggtttttactaatcctagctccttaacatggccaactacaagatctggctccatctatgactccagcatcaagtgcaccacacacggatcaccctccacatctgcctaactgtactttcttcagccccacatccccctctttccagactgcacacaggatgcctctgccttccctctccctttgcctgctgaactcccaatcatctctcagccttcaatgtaactgtctctgccttagtgaagacttccctgaccagcccctgcccacggagtcctatccctcaagttagatctgtatcaatatatagcttcccataaacctctgatcaaaacccgagttttacatttgtgggtgtgatcatttattcaacagatcgtgccctaagtagactgtaactccaagagggcagggacttcatctattttgactcaccattgattctcagttggccctaggcacagtgtttggtaaataacactgagtcaaaaaataccttcgaatggatagttgaattaacaagtttttagaactcaagacctggtaaaatatcaaatttcaatatgcattttcattaaaaataaaactgattaatagaaagacaaaatttgattattaataaaaccaattagtagaaagacaaaattactctcaaagatgcaaaaatcaaaaagatttttcttctacatttaataaaagcagaaaatagagtggtgtctactaaatgcagggagtacaacattgagttagcagtgatcactgagtacaattaaaggtatagaagtaacagaatacaagtgctaagagttgtatttttaaaacctaacaagcaggccaggcatgatagctcacacctgcaatcccaacactttgggaggccaaggcagtaggaccgtttaaggccaggagtcctagaccagcctaggcaacatagcgagaccatgtcgctaccaaaaaaaaaaattaaaaattagctgggtgtgttggcgcacacctgtagtcctacctactagggaggctgaggtgggaggatcactctagcctaggagatccaggctgcagtaagctcagatcatgccactgcactccagcctaggactaatacaggacaaataaaatgagaccgtgtctcaaatgagaccgtcccttcttgcaatcctatgaagaactacctgagactgggtaattgataaagaaaaaaggtttaattgacttacagttcaacaagctgtacaggaagtccggctgaggaggcctcagcaaacttacaataatggcaggaaggcaaaggagaagcaggcacatcttacatagccagagaagaaggaagagacaggtgggaggtgccacagacttttaagcaaccacatctcccgagaacttattcactatcaaaagaacagcaagggggaaatctgtccccatgatctgatcaactcctactaagcctcacctccaaattggggattacaatttgacatgatatttggatggggacataaatccaaaccatatcagaccttgcaaaaaagaaaaaaaagaaaaagaaaaacctgaagatggcagataggtggcagaactagcttgcagctcctgctcagatggacagagcagcatgtgaaaactcacatggtgaacttgtgctccaagaactaccaaaggaacataccaggaaagccaagagaatccacagtccctttgaaggaactggatcaccactgaaagctccttgagatgctaaaaaactgagtcggcttggtttttcaacgaggaggcatgcagtctgggataagttctcagtcttgatcactggctgcccggaaataaactcagtgctattggaggggggcgtggtgggagtgagaccagcctttaggactgcaggctgtgtaagagcaggttgaggcttgttactgctgggttttccctacttccctggtgacctgtatgactcagcagaggcagctctaatccccttgggaatataactccactggactgggaaccacacccccattctccacagcagccacagcaagccccactcaaagagaggctgagctcagaaatggctatccctgcccctacctggtagtctttttctatccaccctggtagccaaagacaaaggtcttaatttcttgaaaactctaaggccccagccactgcctgagaaacctgaatacttaaacagctgtgcttagggcaagtttgcatcctccctataggactgcagctggtgtgctcttgaaagtgccaccacttggctggaggccaactaacccaaaaactgcacactaaacaaaagcacaaccaaggaccttcacagtgtccacttcactccccaactaacaccactggagcaggtgctgatatccaggctgcaagacctgaagatgactcacatcacaggactctttgcagacagcctccaatgccagccagaataccagtagccctgctgggtggctggacccagaagagcaaaaacaataactatggttcagttctcaggaacccttattgctagggaaagggagagaacaccacatcaagggagcaccccataggacaaaagaacctgaatagcaacgctttaatcccagatcttccctctaacatagtctacccaaatgagaaagacccggaaaaaacaattctggtaatatgacaaaacaaggttctttaacacccccaaaagatcataccagctcaccagcaatggatccaaaccaagatgaaatctctgcattgccacaaaaagaattcagaaggtcaattactaagacaatcaaggaggcaccagagaaaggtgaaggccaacttaaagtattcaaaaacatgatacagaatgtgaaggagaaattcttcagtgaaatacacagcacaaatttaaaaaaatcacaacttctggaaatcaaagacacacttagaaaaatgcaaaatgcactggaaaatctcagcaatagaatcaaaaagcagaggaaagaactctggagctcaaagacaaggcttttgaattaactcaatccatcaaagacaaacagaaaggaatttttaaaaagaacaaagccttcaagaagtttgggactatgttaaatggataaacctaagaatacttgatgttcctgaagaagaagagaaatctaaaagttttgaaaacatacttgagggaataatcaaagataacttcccaagcattcctagaactctagacatccaaatataagaaactcaaagaacacctgggaaattcatcacaaaaagatcatcacctaggcacatagtcatcatgttatctaaagtcaagacgaaggaaattttaagagctgtgaggcaaaagcatcaggtaacctatgaaggaaaacctatcagagcaacagcaaatttatcagcagaaaccttacaagctagaaggaattggagtcttatttttagcctccttaaacaaaacaattatcccccaagaatttcatatccagtgaaactaagcttcataaacaaaggaaagatacagtctcttccagacaaacaaatgctgagagaattcaccactaccaagccagcgctacaagaactgctaaaaggagctctaaatcttgaaacaaattttcaaaacacaccaaaatagaacctcctcaaagcataaatctcacaggacctgtaaaacaataacacaatggaaacaaaaaacaaggtattcaggcaacaaatagcatgatgaatagaacagtacctcatatctcaataataacattgaatgtaaatggcctaaatgctccacctaaaatatacagaatggcagaatagataaaaattcaccaactaagtttctgctgtcctcaggagacttgcctaacacatgaggactcatataaacttaaggtaaaaaggtggaaaaagatattcaatgcaaatggatatcaaaagtgagcaggagtagatattcttatatcagacaaaacaaactttaaagcaacagcagtttaaaaagacaaagagggatattatataatgataaaaggactagtccaacaggaaaatatcacaattctaaatatatatgcacctaacattggagctcccaagtttataaaacaattaatactagacctaaggaatgagatacatgacaacacaataacagtgggatactttaatactccactgacagtgctagataggtcatcaagacagaaagtcaacaaagaaacaatggacttaaactaaaacctagaacaaatggacctaacagatatctacagagcattctacccaacaactccagaatgtacattctgttcatcagcacacagaacatcctccaagatagactatatgataggccacaaaacaagtctcagtaaatttaagaaaatcaaaattatgtcaattagtctctcagaccacagtggaataaaattggagatgagttcaaaaaggaatcctcaaaaccatgcaaatacatggaaatcaaaaaacctgctcctgaatgattgctggctcaacaacgaaatcaagatggaaatttaaaaattctttgaactaaatgatagtagtgacacaacctatcaaaacctctgagatacagaaaaaactaagagataagaagaaagttcatagtattaaatgactagattaaaaagtctgaaagagcacaaatagacaatcttaggtcacacttcagagaactgaagaaacaaaaacaatccaaacccacatccagcagaagaaaagaaataacaaagaggagaactaaataaaattgaaacaaaaaaagaaaaatacaaaagataaatgaaacaaaatgctggttctttgaaaatataagtaaaatcgatagaccattagcatgattaaacaagaaaagaagagagaagatccaaataagttcaattagaaacaaaacaggagatattacaactgataccacagaaatacaaaagaccattcaaggctatgatgaacacctttacatgcataaactagaaaatctagaggagagggataaattcctggaaatatgcaaccctcctagagtaaaccaagaaatatagaacgtctgaacagaccaataatgagcagcgagattaaaatggttatttaaaaattgccaacaaaaaaaaagtcgaggatcacatggattcacagctgaattctatcagacatttaaagaagaattggtaccaattctactgacactactcaaaaagacagagaaagagggaatcctccctaaatccttcaatgaagccagtatcatcctaataccaaaaccaggaaatgacataacaaaaatagaaaactacagatcaatatccctgatcatcatagatgcaaaaatccttatgtcaaaaagataatacaccatgatcaactgggtttcataccagggatacagggatagtttaacacgtaagtcagtaaatgtgatacaccacataagcagaattaaaaatcacatgatcatctcaatagacacagaaaaagcatttgacaaaatccagcatctctttatgattaaaatcctcaacaaaattggcatacaagggacatactttaaggtaataaaacctgtctatgacaaacccacagccaatattataaatggggaaaactcgaaaccatttcccctgagaactggaacaaggcaaggatgcccactctcaccacttctattcagcatagtactggaagtcctacccagagcaatcagacaacagaaagaaataaagggcatccaaattggtaaggaggaagtcaaactgtcactgtttgctgatgatatgattgtatacatgaagacaaaaaagctcctagaacggataaatgaattcatcatagtttcaggttacaaaattaatatgcaaaagtcagtagctctgctatatgccaacagcagccaagctgagaatcaaatcaagagctcaatgccttttacaatagctgaaaaaaataaaaataaaatacttaggaatatacctaaccatcgatgtggaagacctctacaacaaaacactgctgaaagaaatcatagacaacacaaattgaaacacatcatgctcatggatgggtagaatcaatattgtcaaaatgaccatactgccaaaagcaatctagcaattcaatgcaatttccatcaaaataccaccatcattcttcactgaattagaaaaaaaaaaaaaaaaaaaaaaaacacctaaaatccacatggaaccgaaaaagagcccatgtagccaaagcaagactaagcaacaagaacaaatctggaggcatcacatttgcctgacttcaaactattctataaggccatcatcaccaaaacagcatggtactgatataaaaataggcacatagcccattggaacagaatagagaacccagaaataaagccaaatacttacagccaactgatctttgacaaatcaaacaaaaacataaagtgggaaaggacacccatttcaacaaatggtgctgggataattggctagccacatgttgaaaatgaaactggatcctcatctctcaccttatacaaaaatcaactcaagatggatcaaagacttaaatctaagacctgaaaccataaagattctagactatcacctcagaaaaacccttctagacatcagcttaggcaaatacttcatgaccaagaaaccaaaagcaaatgcaacaaaaacaaagataaatagatgggacttaattaaactaaaaagcttctgcacagcgatagaaataatcagcagagttaacagacaacccacagagtgggagagaatcttcacagtctatacatccaacaaaggactaatatcagaatctacagagaactcaagtcagcaagaagaaaataaacgatcccatcaaaaagtgggcaaagaacatgaataaacaattctcaaaagaagatatgcaaactgccaacaaacatatggaaaaatgctcaacatcactaatgatcagggaaatacaaatcaaaaccacaaagagataccacctcactcctgcaacaatgaccataatgaaaaaatcaaaaaataatagatgttggcgtggatgtggtgaaaaagttacacttttacactgttggtgggaatgtaaactagtacaaccactatggaaaacagtgtggagattccttaaaggactaaaagtagatctaccatttgatccagctatcccactactaggtatctacccagaggaaaagaagtcgttatacgaaaaagatacttgcacacacgtttatagcagcacaatttgagattgcaaaaatatggaacgagcccaaatgttcatcaatcaatgagtggataaagaaaatgtggtatatacaccatggaatcctgctcagccatattaaaaaaaagaatgaaataatggcttcacagcaacctgggtggaaatggagactattattctaagtgaagtaactcaggaatggaaaaccaaaaattgtatgttctcactcatatacgaactaagctatgaagatgcaaagttataagaatgacatgttagactttggggattcaggaggaatggtaatgggtggcaagggataaaagttctcgcattgggtgcagtatacactgcttgggtgataggtgcaccaaaatctcagaaatcaccactaaagaacctatctatataatcaaacagcactggttccccaaaaacctgttgaaataaaaaaaatggaaaactaaaaattagacaatttttttttaaaacttgataagtaaaaaaaaaaaaaaaaggttgataagatgatgtgttgttgtacattcatccattatagcaaatgtactattctggtgaaggattttgataacatgggaggctgcgcatgtgtagtgggcagggagattcaggagatctctgtaccttcctttcaattttgctgtgactctaaaatggctccaaaaaaaattttaacaagtgtgaaaaattggacaagcaaagacaaaatattaggaagaactactcaatggttttatatgactgaatgaaaatgtaaaagtaggggaaagttcacaactcacccagtaatcaacagctgcatatggcagaactcatgagttttagattttataacttcatgtaaggaaactgcattgtgcatgacatgaatatcatagaatcgtcacaccagaaaatcaaatacactacctgcacagttaaaataatcattatcttggagaatcagctttgggaaaaatagagtgtctactaagaagaaccatccttggtcaggcacggtggctcacgcctgtccagcactttgggaagccgaggcaggtggatcacttgaggtcaggagtttaagaccagcccggccaacatggtgaaacctcgtctctattaaaaatacaaaaattagccaggcgtggtggtaggcacctgtaatcccagctacttgggaggctgaagcaggagaatcgcttgaacccaggagctggaggttgcagtgagctgagattatgcaattacactccagcctgggcaatagcgtgagactccatctcaaaaaaaaaaagccattctctttatttaggtttgtctctatactctcctacaggtattatatgagtcagaattcatacttcctgtctgccactaatattatgtacattataattttaaataaaaataatatttgagagacaaaaatcagaaaaccaaaataatatgaaggattaaaaaacatatacttacaaataataaaaatcagaaatattaaaatatcaagaaacaatggctcaagcagttgaacagcaggggagctctctaaaaatcattcacaaacctaagagaagtactattttctctgttatataaataaagatgcagagattcactggtgaactaacttgtcccattatatgtggcttaaaataccaaaagtaaaattcacatatagaccttctggctttacaactttggaacccataatcttctttctggggtctattctgggaaattaatctaatatgtggaaaacagggtatatgaagatttccatggcagcattttaattaaaggagcaatatgaatatttgcacggcagcattttaattaaaagagcaataattagaagctatccaaatgttttacagtaggaccatggttaaataatatgtggtacataggcatatgatacaatgttatttttaaaataagaaaatatttctatataagagaatgaaagcaggacataaaaagtataattattttaaatacataaaataggaagtgatacacaaagaaaataattgtatgaagatattaaaatgataagctgtctgtgctctaattttaattattgatatctttttaatgactttaatttggtttcaagtgattttacatagagagttcaaagttcatgagctgttgaaatctacatctgaggaaacaaactaaataaagagaagtttcaaccttagaaagtgcatgtgacttgtgaatattgtgtaacctcaattccagcttaagaatcactaaaggagagaaaagtagctagagcggtacggcagcctccggattctgaggtgttctgcgacttccccagaccctaaccttcccggcctcttccccagagaatcacaatctagatgtggaacagtggatttgaaagctatagcagcaactcatagggcagccggtgaatacatgcagtccccggtaggctttggatcgcgggcaccttcttaggcagaaaagaaatcaagagccagagcacagcacattgaacccacacacatctcagctgctttctgccactttgattgatgaagtgttcaaaattggcaatgctgagatttcacaaatcactcttgtagggatcatcagacatgcagagaagacttcaaccaacattgtttacaaaatagatgacatgacagctgcacccatgaatgttcaccagtgggttgacacagatgacaccagcagtgaaaacactgtagttcctccagaaacatatgtgaaagtggcaggccacctgagatcttttcagaacaaaaagagcctggtagcctttataaatcatgctcctggaggatatgaatgagttcaccatacatattctggaagtgatcgatgcacacatgatcacaaagcgaacagccagccctcagcagagagagcacctatcagcaatccagggaagagtgaagcagcctccctgtggcccaaaatcaggtgttgaatgtgattaagtcttacccaagacctgagggactgaactttcaggatctcaagaaccagctcaaacgcatgtctgtatccccagtcaagcaagctgtggattttctgagcaatgaggggcacgtctattctactgtggaggatgatcattttaaatccacagatgcagaataacgggaactaattgggtacctgagattttttacagctggacctagcttcacaatctgttttctccagctgtgcatatgtttagccaggtggcttctagaagtcagtttcatctataaaaggtctccaccgacatccttttgaaacttactgctcttctgttttgtttgaagctcagagggagatgggcaattgacagggatacaatcccaggtggaattgcttgaggaagttacaaataagcttgtttcatactaacataatgcaaataactcttttataaatgaaaacatgctcatgctctccacaacagggagaaccaaagaaagtcccataagtcaatttgtcccagtcatcgtgaaaccttgccccttctctagggaactacatcagaaagttacctaccaataacacgctccatataaaatatcagaagaaatgaagaggctaaagtaatttaacatttataaaaacatacaaaagacgaggaagaaaatgtggctaattactgtggtcctcacttcataaaggtgtagttgcaatttgtaacttccttcttcctccttccatttcttgttccttttgctttcagccagcactgaggttggttaaggttcttaatatgtcgtggtagttaaaatgttcattcttgagatcagagcctataatggcttcctatggtcaccactggaagaggcaatcctagacatgttccagaatgtctccaaattccaattaaacttctcactggccacagagtatagcagcacccttagcacccttagctgaaagagaatctggaaaatatgtttttggctttctagactccacagtacacaaaacatgaaggaggatgaaatgggtgcagtaatctactatttccaccacagtaattaagttgggggaaaaaaaaagaattactctcttatgaccttcgccgcagtaatgcaggatttttctcggccccttcatcagacttgtgacaggagtgaccccatttactcggcctgccgcattcaagcctttgtgggagggagcacatgaacaagctccatgtggggcccacagccagaacaggcacatgtggataaatgtaagatcctgccagccagttcagctgctggcaggaaaaatctccatgtgggacccatggcagtgcccaggtggtgctaggtgcctgtgacccctaagccccagagggaatgttaacagtgctctcttagctctgctgtccccggacagctgtgtgttagcagctcagctgacagaagcaagctctgtgtggggcctgcactggttcccaggtgagagtgtctgtaaccctggaaccccagagggagtgttacagtgctgtcttacctccactgtccatggatggctgtgtgttagcagctcaactgacaggagcaagctctgtgcagggcctgcggcagtgcccaggtcagggtgcctgtgaccctgaaaccccagaggatgggttacagcattctcttagttctgccatccatggacagctgtgtgttagcagctcagttgaccccttgcctcatcacatggggcaactaccctccactggcaagggcaaagggctggtgtgacagactatctgggtacctgcactcggtgggtcccgagctcttgtctggtgtccaagaagaatgaggtcatatggatgaactgaatgatggggaaggtggaaaattttactgagcaatgaaaatggctctcagtggagaagggagctggaaaggggatgggaagggcaggttgccttccctaaagttaggctatctctcctctgaagtgcagccctctctcatcgcttctgactgatagtgggatgtttctctgcacaggacggtgggggtgggccataggtagttttgaaaaaggcaagattcaattggtaaaaaggcattattcagaaagaacaaataaggagagaatgggcaaaaaaggaatagaagtgctcacttcaggccatgggtttcaggcttctcagcttgaaggtgcagtttcactggggacccatttctgtctgcctagaatttctctgcctccttcctctatcaacagtaaggaagtagatgggagaaagctactctttgttgcactgatatgtagttaagttctagtgcctaaacagagtaaatctttagcttaattgtgggacagtcattgatctcacaaagggatggagtttgctgaagccagttaccataagctcctaacgaggaaagatgatctcaatgcataaaaagggctttgacagaaagctgttcctttctgcctccctccaccctccctacccccagatcctgacaatgctgtttctctacattcaaaccattccagagtatccagtgttctaccacctcttctccattaaactgatacagctcgtgtgattcatctttatgtgaagctcaagaggaaatactcagatgccacatactcagataattcatttgaagtttcatggttttgaatggtaaattgttctgatgacctatgagagaaaagcactccaatttctttgaatgattcttctttaatgtcaggatgcattttcactccttcaggccaccaggctacaaagtagcaggttttgttgttttgctgagtactgctgtagtgctgcaatttacacagatgcaaagcagacagtgattaggaatgtgttttggccttattagtaagacctgttaattgggtgatataggagtgatttcttcctatgggtggactccagcaacatccaaaaaagagaaaaagttcaagcagccacaagcacagaggaagctttaaaattaacctgccatgtgataatttgttgataggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccgtaagtgacctgggctttttgtttgtttcagacaaaggggaaacatcgtataacatttctcaaagccacgtgaggtgcataataagcagagtcaaaggggagttttgattcatagtcttgcttcagtgcttagatctgaatcctcaaactagctcagaaaattctgcattcagagtagacaaaggttatcttcctgtgaaacaaggctaagcgattttgacacagaagggagataaaagaattcaagttcaaaagctcagcagagtagctattaaaatgacactcctggagcaaaaccctccttatctgactccagctggaaggaagcctagattgccagccaactactaagcaggagaaaagattgagatactcacaaagaattaaatgaagaaatgtatttaagaatccttgtcagttcactttcactttttattttgcagctcctagtcaagcacctagcaacctcaggtgggagcagcaaggctctcaggtttctctgggctgggaacccgtcataccattagccaacgaatctgaagttgtgggttacaaggtcagtatttcttcactcttttgcatagatactcatctccgaaattgttattatgaagatggaaaattaataaggcataaaaagacccattaaccaacctattttttctcagtcattttctatctgtatcttagaaagatagccttcctatagatagagaagccaaggcagtcaaaattagtttcaactgcacaaggcacagaaagggaaggagtaggaaaagtagcgacaatctgaatgtagtgtgaagatgactctgtgaagcatgatattaggaccagcagaatttaggcagagaattctggcatattcttccaggagactaactttgctggcagctgacaaatatgggaccatttcgttttagtggaaagtctttctattagcaaggaaacagaagaacaaaaaaaatgtaagggctagaacactagaaagaaaacaaaaaatccagggagagacacagcaagctccaaaacagagccaacattcacatacagtcattctgttctgtgacagtaagatctggaaatttgataacatgtgcaatttgtttttgaaaaataactttgttatctgatttttaaatatatgtgatctatgtattgaattggcttaatttcaaattcttgttctataatgtcagattctgtttgttgcattaaacttcacacagaatcattagttgaatattcacaatatttttaatataataaaatatattaagtataatattttaaaatatttcagtgataatatttcaactgaaagctatcattataggtgggttttcaactatcagagatggtaacacagtattcagtacataaaatgctaaaatttaaggagctaaaaactgaagaagttataaatggaatattttaatttccattaatattatattacacaaactagcatttgttacctactgtaattaggatagatcacagacacacacacacacacacacacacacacacaagtccatcagtaatggtcgggaatattgaatttgatcttttgcagggagtgcagatgggtcattttctataccattcccttactcctctttccatacccttccccaaaagaccatatcctcacaacttctcctcttagggaaatatactgtttaatgcttagggatagcaggcgagaaatatgatagaccattcaggaaccaatctaatatcattagaactatgatgaacaatatcccaaactggagaggcaaagtagaatgcaagagaaaaccagataaacgtgtatggtcaagtggaaggctcatatggtttaggtacctttcaagtgagaatagagaaatactatataactagaaaaatactctattgagcttgggtgtagggatcccaggctaggtgccactactctttgttcacatttgacacctctttcccagtcattgttcttactttttatatatgactgtctccccaaacagactgaagtcctcaaaggcaaggactttatcttacttatttcttgttcctaatgtttctagaatggatgactaacgttggcccagatagaaatgtcttatgcagttatttatatatgtgtattatcaaatatgtatttttttctagcataaccttgccatttgttgttgcttagaggaaaaaatatcactggccactgattcagacagattttagttcaaatcctagttgagtaatttaagtaagttgtttaaactttatcagttttattttcttaacttcacaaatggcagaaatagcaataataatacatattatacaggattttctaaagaataatttgtataaaatgcttggcatataaaatgttctcattaaaaaacagataccatttcttagtgttgttggaggagcatgtctcattaggtacaatttttaaaattttaacaaagaaactgatcgttaaaagttgcctgccagttccctcttaataaagatatcacaagtcatgttggaataccttgttgctgagggaagaatcactagcatagtccattttagttgtgtaaattaatgacaagtaggcacacattgcaaaagatatttttttccttttattttcttgaaatggttgcacttccttatatccctgagaaggaagaattgattcgtataaaaggagtctgctgataacaaatggagtgagacctcaaaaccttctcctttgcaactaaaccttatcggaacctttctgatgagtgggatgatccccactgagagaactgctgacaggaaaggcttcctgagggaaaggggacttcagactggactgggcttaacccagagtttggattctcctcagaacgcgggttttcacagggcagccaaggatgaaagctcctcctgacacaatgggacaggaatatatatttagaaataatagctgagaatataaactaaagagctataacccagagaacacaagcttggagcccgtcttctgagtatgacgttgaagacagctactgcacccttggcaaggatccccacacagcagtgaaagaactgtaccatctgaaggtgcacactaatatagaatgaccagggctgggcatgatactcagaaggagaatccttttgattcctactacatcccaaaaattactgccaaccaagagtggcaccactataatagcgggccacctcttcttaagcacaatgtgtgtcacttacaaaaattaataaaatagggacacaggacactaatcatttctcttcccacaaggtagtttgaggcgggcttgacccattaaaactgaacttgcccctaggattcttggaacatttgaagcagaaaacttcttgctcatcggggaaagggagagtttccatacttaattggaatattaaaaagggaggtcacttaattttcactctttgtctttgcaaactacttcacttttgcaagcagaaaggatcactggaaatgcatattgtgtggaggtttgaggctgagaacttgggattaatgcctgaggtttaaaatgcagggaatatatattccaccttttacattaagtccagtttaagattgaagaattcagaaaagtatttatctgggagacttctaggttgtgaaagttattgaaacataataaatgcagaggaaaaagtagatattttccccatatattcagtgcataaataatgtaataaatgattcttttgtatagttaagctgctatatacaggatagacattctgaaaaagtgcactagaaactggatctcataaagatagagactggtggttatcagaggccaggaaggggaaaggagagtgaggaacaaagagagcttaatccatgggtacaaatatactataagatagaagaaataagatctggtgtttgatagatcagaagggtgactatagttaataatctattgtacacttcaaaatagctagatgagaataatttgagtgttcttagcataaacaatgataaatatttaaggtaatggataacccaattaccctgatttgatctttacacatcatacacatgtatcaaattatcatattaccctgaaaatatatacatctattatgtatcaataaaaaatttaaaaagtaaatgatataaaggaataatacattgtcctttaatctttagtagttgaactcctttcaggcagataaatgtgcattaatacctctaggaattttaaaatttattttgccattttccatggaatataataagaacactataaaaaatatatcagtacattataaaattttaaagcttatattaataaagtaattgtaatcttgaaaagtaaactatagaaatagcacaagataaaacagcagaatttgacatttgagctccccattgtccaagaaagcactgtcttagtccttttgcgctgttataacagatatctgggactgggttatttataaaaaacaaaaatttacttctctcagttctgaaggctgagatgcccaagatcaaggctccagcaaattctgtgtctgatgagggtccacttttggtttccacaatggtgacttgaaagcagtatcctcaagaggggaggaacaccgtgtcctcacttggcagaaggcggaagtgcaaaagggccaacaaccacgagaagcctcttttataagggcattgatcatactcatgaaaggagaagtccttgtgatacaatcacctgttaagggccccacctcttaatactatcacactggcaacacctgaattctgcaggggacacattaaaaccatagcagcatagatcttactttcttactcgatttcagacattgaggtgtcagcaacatatataactagcagatattactagagaaagatgataacagaaattttgctaacagatattaaaaaaaaaaaagaggtttccctatcacaaaatcttgtcagggccttcaaagtgaccaagaatatcatgaaagatagatggaattgaaccacatataattgcacaataggtaacacattaaaactgaattcatttaggtgaacattaagcagtacctagtggtgaaactttccactgatttttttttgagattgtctatgagatgctgggcttcttggaattttgtttaagaaatccagatttaatagtaataatttcaagatatcatagttttcactaacaagtaaggactaaaagcatagagaaccagcaagatgttggaaaggattgtctgttataccaaataataatacaaataatttccactcaaaataactttccatttgagaagctgaatccaatttggtaatttatttagcatatttatgacttttcttcaggtcaataaacatgtgccactttattttgttgtatttacattccccaattcagaatcaactgcctattttattaatacattatatataaatgattgggaaaatgaaacaaaaacttcaaatcaaagttttcttaccttgacttattttttcaaataaatgtttttaaacaaataaaattttatttttacaactcctataatttggggtctctatctagaatccttactaattatagcacgtaagactcaccattactggtgttactaaagaaatgccaaaaaagcttattgactaaagtatattcagccataatttttaatgatctcaaaaatggaaaatatttttctttacacgatgaaagtaatttacccaggttataaagtaaaaacaaccattttatctccaccttattttcttcacacagacttatgcttgagtgaaagggaaaataaaactcaatgttcaggggctatgctttcacttcagcaaatgtccccttccccacaaacaaaaactgttatcccttcagaaaagacacaagcagtcagaaagaattcaggacctcaggctataatccaagcaaaaactattagttttcaaatctgtatctagaaaatagcctttcctagatatacaaccccttcaccaaatatctcccctcacccatatctactttctacctgttaacagagctagggcaaatagaaggaaatcaggcccaaagtttactagttattatacagtccatcaataccgtaatagtccattttcacattgctaataaagtcattcctgagactgagcaatttgtaaaagaaagagttttaatggactcacagttccacgtggctggagaggcctcacgatcacggcggaaggtgaaaggaacgtctcacatggcagcagacaagagaagagaacttgtgcagggaaactcccctttataaaaccatcagatctcatgagacttactcactatcatgagaatagcacgggaaagacctgtccccatgattcagttacctcccaccaggtccctcccataacatgtgggcattgtgggaactacaattcaagaagagatatgggtgagaacacagccaaaccatatcaaatacaaacagaggttctcatttgtttatgcaacttagatatcagttgagattccagattcctgagatatatgtacacttgggttgatactgttttacatacccactagaactttgaagcccatccctgtatttctctagcttcttgggaactgtatagtctatagccactctagcctctgatttcttttattttgtagctcctccttcatcttatattcactctaaataggagactcagccttcttttctctgtttccacaaattaaaaagactcacatataatgacttaagctggaagataggtacatgaggttcattatagtatcctctttacattcatttatgcctgaaatttctcagaatttttaataattgaaatagaaatggctcatgtcacatgcagtatatatatgaagctgactttttggaaatgctggggagatagagttagaaaggaacaacatgcaagcaaacatctgcaacatgcccaaaaagaaatcttgttgttaaaattgtgttcagacaccctgcaggcagtgaattctcactgatactgtgtctcccaacttctattcatctaacttccattgtcttactgactccttccttcccatcccattgtcaccgaggctttagattcctcaccctttttatgaagagcagttgtacccatcaattcttccgaagatgctcagcagaggaataggcctttcctttaatatgagccatccctctcaggagtagtttgggtataaccagcaaaaatttattctgtcatatttttagcacactctcctcaatattctactaccatcaaacatatagaatagccattttcagatcatgcctttgagaatagcaataccacaatcactttctatttaggatcatctctttagataacccactgctctcagttttttttttaataccaaaatttgagaatagtcttgacaatacattagacaattttctttatgcataaacatagctgtcattgcaactgtcaatctataaatgtccatattctctaagaactctctggactccttactgtcaataactatttttttctatgtcttgataacttcttaaccttctcatagttctcattctcatgcatcttttctaaatcaggattttaaaatgagccaacattctctaaagcactgaagattaactattaatttaatgtatctttttacttagtagatctacatatatgtatagcactccatctccctggatatattggcaaaaggccacacttaatctcaaactcgttttgacaccactaactgattttttccccgtctttacctcttaatcctaaatctcaactgatccacaaatttttcttcaactctagaacattagatatgcattgctggatgtatttttctttgtcataagaaatgtaatttattgaaccataataacactgtcctctaaaataatcactcccctgccaatcctcaccaatttacatactttcccattcccataaatttgctttctaattacctcacatggatgatcagaattctaattcatcacgatgctccagacgaaatcaaaagcatacagatatatttgtcacattttaagacaaaagaagctgcttaaggcatcctccaggaagtgttcctgatttccccaatcttgactaagtacccactttgtgcattaccatagcatcaaatatatttcccgctgcagtgcatatcacacttctttgcattgtctgtctgtcttcaatattagactataaatgccaggaagactgtaaccatgtggtcttattctctgatgaatctccggtatgtagtactatgcctggcctgcatgagatgtccaataaatgtttgataatgctgttatcaccttgcatttacactgaggctatagcatccttcacaataaggatttccatagataaaattgttgcacatcataattaaatggagaattcacttccctcccaagaacatgaagtagatttaaaattaaatgaaaaaaaagaaagtgaaatggagggagcatttattactagaattcagagggttcaagtacacgcaggcttcaatatgtggaaatattgcttctctaaagtatttttggatttttttgtatgtaagttaattcaagctcaaaacacattttctgtaagaaaatatatgtcaataattatctaatttcccaagtcagttcatattttatgatgcacttgaaataccaaccctttaacagttaataaacaatgatggcaacagaaggagtagctttctctttttaagcttatcatacaccaggtcctgtgctaggtattctacaggcgctttctcattttactcccctaaaacactaaaattgttattatcatctctatcatacagtagaataaattgaagtttacaaaatttagtaacttgcccaaattttcccagccaggaaggtataggagattttgttttctttgctatgttttgtaggaaactgtttcatatccagatctgtatgaatacaaagccatttttctttccattgtacacttataataccaattatgaaaaagcacaaaaaacagtgactctgaataaaaacacatttaaacacatcttaactgccactacttgactattataccaaaaattttacttgactatttttggaggcaagtaatagtacaatatagtaaaatagctctgaagtgatgatcaaatataaatcttctgatgagatttctaccctaactagccacacggtcttgtacaagtcacctaacctttatggccttcattttctaatatgtaaacccaggattatcctgtgtcctgatttgcagttccaaaattgttttccgtgcatgtatgtttaattataataccacaacagatgtctaaaaagctttagctttgctacaccatgtatccaaatgccgattttaccaaaaagcaaaccactacaaaagcaaaaattaaaaaaataaaattttcactttcaactgtttcctacattgttaaggatttattattggtatgtttaacaaattttgtttactcctttcaaactatttgaagatgagctttccaaacttccttaggatatttcaataaccaagcataacagactctccatgatctgcctcctctctacctacttctctagcctcattcctcactattcccatatatcccctctccattccctgctctcatgccattgtttcttattgcttagatgtagttattaattttatcttacctctttctggaattctccctttctcaaactggtccactctatcatatttaagtatgtagttcagacatcacttcctctggaagtccttcactaaacccctagacaaaattaaactctctcctgtacctccatggcccttttgtgtacttctactgcagtagactgcacatgtattacatttgcttatgtatctgtctaaactgtaagctccttgtgcttatctcagaatgtgacacatagtaggcagtcaatgtgcatttgtaatctttcatatcaaatgtctaaaccttgttattactctcaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtaagttttgacacagtagatttaatttgctgacaaccaacaattacgagatggtatgaaagtcacgaaaattgatgtgatagatttcatggttcagagattttgagggatttctcctctctgatttttatattatcttctgattaatatgaaccatagtaatctgctcacaattgcagaatttctacaaatctagaaaggagttgacattttcattagaatatactgatttgtgaaatgtccttgcctctcctggtctcaagcagtaccttgctagccatttggtttttggagtatagcttttaaactgatattacactggttttgacatacctacatttctgtagttttgattgcctttattgttagacaataaggaatttaaagagaagcttttaaaattgaaatgtgaccatatttattgatttctaaacaaattataaattttattgtacattattattaacaatattaataattgctagctttcactgacccttattatatgtcaggcatggtcaaaagtgctttacatacatcatctaagtttagtaacaatcatatgagataggtgacatttttactgttttgcagaaaacatttaagtaacttgcctaagaccacactattactaagtttcggaaccaggatcaaaacctgcgtatgattgtctccaaaaccacatatctccatcaccaccatcattattacataagcaagggaaaactgattaaaggaagcaagattttagaaatttagaagaaagcaaccatttcgtagagatagtaaaaaaaaaaaaaaaaaagcaaaaattaggcaaatttctaattttaaaagtattagacaattttatgagaacattatgaaacattttctcatgtacaattagtgggtaattaggaacatcatttgttgagcaatcattgccaagcagaattatcaacctacagggaagtgtcccgtcatgctctgtatgtggccctatgttatttaacgtatttatcaacttgaagtcagaccagaggcattgcttgtgatttttttttttatgccaccaagtgaaatgggagataaatacagtgtagaaaagaatgagacagactggaactttgaggaaaagctactgacataatacttgataatttttttaactttttaagttcaggggtacatgtgcaggtttgttacacaggtaaacttaaacttgtgtcatggggttttgttgttcagattatttcatcacccaggtattaagcctagtacccattagttatttttcctgatcctctccctcctcccaacctccaccctctgataggccctagcgtgtactggtcccctctatatgtccatgtgttctcataatttagctgccacttacaatacttgataagttctcacatgaaaatacaggataaggaacattattgataattgataagatttgcatacctgtaaattagatattacatcaacattcatttcatttttttaaaaaactatactgtggttatatttttaaaagccttatttttaggaactatacattaaaatattttgaggaaaagatgcatcatatctgctatctgcaattcatttcaaatgtttcaaaaaaatgtatatatgtacagaaataacaataaagcaagaatgataaactgtcaacatttaaggaatctgggtgaattccttagtctcacaacttttcagtacacctaaaagtatttttaaatgaatagttaaaaatacaaaacataagatgggagaaatctgactttttcagaaattctggtgaaaagatctaagaatttaaattttattgtggtcacacaaaaatttaatatgctttatggttcatttataaaagtatagttttaacaacaagaaaagttataatgtctctgcattaattatttcacaattgaactgttcagatgaaggctgaattttcaagagcatcttaaaagactatttcctgaaaagcaaaatatacgacaaccttcctcttgcttcagcacgtcagattcctagacaacaatacagtgagcatttactgaggcctcatcacgttcctgggattaaactaggtgttttctatatattattttatctttctagcaatcctttgggttaggtattttattcttctctgactctctaaggttactttcaactccaacacaatcagattctatagtattatctgaataagatcagcctcaaccttggaagtacttatgacaaccttaattctcccatttatattttaaattgtaacttctactccaagaaaaaaattgtcaacttttatatttcagttaataaaatttgggcagtgcaacccacttcctgagtttcagtatgggaaactcttacactattgtctaccttagactcagaacctgagtcatgattggtttcatttttatcatattgcaaaaaccaaatgcctaagatattgaatgacttgcccaagtgaaacagctagttagttttatagctggggcaagaacttagtctaatgttgctctttctgttgttttgtggggttgttttgctgtatgaaagtaatatgttttagctttgtagattctatttgaaatttgagacacagaccctacttagcattctgaaagtgagatatttttataaaagtgtcaggtaagttgatttaacaaagatgcagccattcccaatagctagaaaggatgtgttcttgttttttatttattaagcatgcacatacgactccagtgagtctttgtcatctcgcctttcttatagctcacaagtggctatgtgcttcacaataaccccattttgtacaagttgaaatatatgcatcattctccaatatgttgattgataagttctagtagtgtattagctgtaaaatttttcaaaggaaagatttacgctttttgcatttgtgtgtgtgtgtgtgcacgcccatgtgtgtgtttaccaaacaaattattctctagctcttaagcatcaggaaaataaattcagactctatctttgcaactaaaactacccccccaaatcccattacactcagtctagccagagaggattaccttgacagaagattccagcaattgggtagtagattatagtattattattagggttttaactaaggccaatcattgttttaagagagataatacacgagtatctaaatccactaattcctacctcaattactctaagcaagtttacagcctttctaagccccagttccacctgcaagaggagaataaataattgtatttaccatataggaatgttatgaggatcaaataagataacatatataaaaagcttcgtacagtatgtgacatacaataatcatttattaaataatcaattatgatcatgatgcttcagaagacttctggcttgaagaaccactcctgatgttagtatctaaaagtcacttagtttgtggttatgtagggctattaaaactacttcagaccaatcaaccttggatcagtcagtttaatccaacagcgattctaatatattagctgcatacaatgtttttgtctcataaaagatcctctcctgggtataagaaagagtgacgaaagatcaccattttttgccaggtttggcatgagaacctagaatttaagctcactcaactgaaataatcaagaacacataaataaattcagtaaataaaataatgttattagattttaaaatttactagagtaagcatagtcatgtatttcttaatgatgaggataagttctattaaatgcatccttcagcaatttcattgtgtgaacatcatagagtatgcttacacaaacttagatggtatagcttactatacacctaaggcatatggtatagcctattgctcctaggctgtagacatacacaacatgatactgtactgaatactgtaggtaattgtaacacagtgctatttgtgtatctgaacatagaaaaattacagtaaagatatagtcagtataaaagataaaaaaatggtatacctctacagggcagttaacaggaacagagcttgcagggctggaagttctgggtgagtcactgagtgattgccaagtgaatgtgaaggcctatgactttattgtacactgtcatagactttataactgtatacttaggctatattacatttataaaaacaattttttctctaataaacttagcttactgtaactgttttactttataaactttaaattttatctcttttgtaataacacttaaaacatacataatacagattaaaaaaacattttctttatatctgtattctataaactttttaatattttttattttattttgtttgctttttaaactgttttgttagaaactaagtcacaaacatccacattagcataggcttaggcctaggtcaggatcatcaatatcagtcttccatctccacatcctgtctcactagagggtctacaggggcaatcatacacatagagctatcatctcttgtgataataatgccgccttctggaagcccttctgaaggacatgcctgaagttgttttacagttaactgttattctgtaagtaggagtacactaaaataattactaaaagaatagtaaatacataagccaaataacagtcatttgttaccattatcaattaagtactgtacattatacgtttatacaactagcagaacaggtttgtttacaccagcatcaccacaaatacgtgagtaacatattgcattacaacattctaatggctacaacattactaggcaataggaatttttcagttccataataatctcagggggccaccatcagatatgtagtccatggtggactgaaatgtcattatgcagctcatgactgtaaattatgaattcatattgccacaaattttgtaatttttgctccattttctgaactatgcactatcaaaattattttattttttatatctgaatttggaatactttcatcattggtgaaaattaaatctcatgattggatgtgtttgttagacatgacatcaccttttcaatacaatatctcatatatacttgtcccttctatataactttgggaacctcagataatgtctgattttataaatataaagaacactctcatcagaaacaggagcgatcttgcactcattagtcttacatactaaaaacaattctgtcctagctcaagcaaaaccaagataatttgctccatttgatgcttcttttttcacaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagataagtacacaaaaattttcttgaaaaatattgtatgattgcatagtgaaatagcaagatttgtcaatatgctattctatatgcacccctagagcaagtcattagggtagggaataagccatttacattagtgcaagatagaaagcgagtccagatgaatttcagtgctatagtttttcataaagtactatgttatctagcagcaaatataataaatatttatttttaataacaaaagatggtttaacatcaccaaaaaatatgatcactaaaaactgcagacatgctggcatgggtgctaacttaaaaatgagatgaatatgggacagagcgtttccatttctttacctactgccaaaacagatgttgaattaggtccaaggttttcttctaattgcaaaattttgcaaaaattttaagggcaatgaaaatttgttgtgcaaataattatgcatagtctgtagattaaaatggttcaagtataacaaataagttttgatttttaaaaacagttccatgcatcacataccactgataaaatcaactagtaaaataaagacagtctttcttggataaattgaatttttaattaagctgtggaaacatggcatcagtacagggattcagctagtctagccagctatgcactgtttgattctgtggcttgggaagtaatccttatttgctatttcaaagagtcatcttgagcctgagagatcctagagagttgttggaaaatgagatgaaaattttctacttgatgatatcttaaagaagttctaacaagcacaagaatgtgccagagttggcatcatacccatgaagatgcgtgaaaggatagttattgcaaagtcatatgccagagaagagcctggagaaactatggttttataggcgatgttaacaagagaacaaaaattggttttataattttatataatttaaacttgttaactgtatttgcttcattaataacaagcaaaatgaaacaatatggagctcaaattgctagctctcaaggttaatccttgtagaatcagagaagtgattgaagtttctgttctgaacatcctgaaagaatagtttcagagccacagtaaaagtctgtatgtaggttacatattctctttggggaaatgatgtaagacaccctaaacaaacaagaaattagttaaaagactcactcaatgatattatagtaaatactacagatggtaagtatttaagcctgtaagtaagtaattatgaccaagtggcctttcttgaacgcctcctttaaagtgggagaggctggactttgcaaaaacagggatgctaattgtttagctggcaaaacatgagctctcccaagtatagtttacctttatgaattgtgcatctgaataaaagacagaaagaatatttttaatgcaaaataattttacgtatttcatgaatcaagccattttcttcattttccatggtggtgtacaccagatttagtgaaggactttaagaatcaacttcttacttacactctcagaaagcaaagcccagtaaaatattaaacaaataaaatggcaaatttaaattaaccaatatttttaattagctgatggatggtacgtatctgacagagtatttacacatatagaatgtctgatgtattcttacaggaatcagagatatggaatgtttttacttaacatacacagaatatgtattttgcatcataaacctatttaaaaaacaggttttcaatgtttatgtacttatgtgctgcatatctgttactttgtagaaaccagaagagcattcttatcaaggtacattatttttcagctacagtactgagttttttctgctatgggatagtaaccacagtcttaaatcactaaagagactgtatttttgtataatgtccattgaatatgaagaaagcaacagtccttataattagaaatttcatgaaagcaaaagttttgcatacccaaatgaaggtactgtggaccccatgtcaaactgttaaatatattgtgtacgatctgtatatatactatatataaggcatataccgtgtggaaggcacagtcaaataatagttctgtgtactgttcttgtaacattagatctttttaataaataattctctttttattgactttta

SEQ ID NO: 2394 - DNA, 1337912 bp, Homo sapiens; identical to SEQ ID NO: 2393
